United States Patent 9,073,990 (PROTEASE-ACTIVATABLE PORE-FORMING POLYPEPTIDES) - sequence listing, part 4

SEQ ID NO: 9140 - protein, 700 aa, Burkholderia ambifaria
MVFYGINDGYRYIKINIAMIVVIKTNWTLIMKIKQIPYFVGMALFAAQGQAASVTSTETNRDVMSVWSTPLAADANVITESQMKQLNKTNVAQALSTLPGVAIQKSGNRNETQVNVRGFDSRQVPVFFDGIPTYVPYDGTLDLGRFMTSELASVELSTGYTSLLQGPNLMGGAINLTTATPKKPLEANISLNQGFARGADNAHNISARLGGRNDLGFIQVSGSQYKQRFMGLPSSEDNNPLAGSHGRRTNSATDDKRLMLKMGWTPRETDEYVLTYIKQDGDKNSAPNVNTDKQQIWQWPAYDKESIYFNGTTQITDGIALQSRVYHDSFKNTLHQYKSVKDYQKGDFNYSRYDDYSNGADLRADFTIRELDMLSFAAHWKEDIHRSRSNKTNPFDRYKDQTWSVATEYQWVATDKLDIIGGIGYDWRNSDEGKRYLYNKKSGAMEGVQHYDDNSQHAFNWEAMARYHLENEDTVQFSVSERTRFPTQKERYTENKMKNNDSFLINPHLDAERALTFDLTYKGHFTPAWNYTASAYYNQVSDAIMAHHVGVNKKGADLLQNRNSGKVDYMGMDLGTTGQITDWLEAGVNYSYIHADPKHYSVRHVAELPTHKAFAWLKFTPYEPMSITVTEEARSWAFNYIDSEDKVRGFAKTDVRLDYELGHGLSVNSSVNNLFDKSYEYTNGYIEEGRNYWLGIEYKY

SEQ ID NO: 9141 - protein, 492 aa, Burkholderia ambifaria
MKNRFEPARTRRLDALTALLLSLAAAPAFAQSASPAAAESTAGASDTAAVQPADAAAPAPTGFWDRSNLFGNMGGLRDVLGDHGVTLSLQETSEYLYNAAGGTNRGGAYQGVAQFGFNVDTEKAIGLPGGTFNVSGLQIHGTNLTQRYLQTLQTATGIEANSTTRLWELWYQQAFLDGKADVKVGQQSVDQEFMVSQYAATFMNATFGWPVLPATDLPAGGPAYPLSSLGVRLRVKPADAWTAMVGVFDGNPAGRSDGDAQSLNAHGTNFNLRSGAFVIGELQYALNAPPADPKAPPPAGLPGTYKLGFWYQSQHANDPRFGTDGLSLANPDSNGIAATHRGNYGFYAVADQMVWRPSADSPRSVGVFARVMGSPGDRNVVDFAANAGITLKAPFAGRDNDTAGIAVGYAKIGSHARALDGDTGTYTTPGYPVRRAETVIEATYQYQVTPWWQLQADLQHFFRPGGGIPNPNAAGARIGDETVVGVRTTITF

SEQ ID NO: 9142 - protein, 1866 aa, Burkholderia ambifaria
MNIAHSKKSAESFPRFLLPTGVFLALSGAGIVSAYATCSTAGTTVTCSGVANPLAPSYSNSANNLNVTVNPGASVGVLLGVGGNAMSLTGSNTTLTNNGTIDPTVLGTGLGVLSSGAVVGNAAASTTTVTNNGTMSGSTGVAISGVTGMALSVQNGTGGTSTITNTGTMGSTPLVGATLIGADAPVVAAYGGGTVNMTNSGTITGRVSLGSNGTPGLGNTFTNSGTINGGVSMGANSTNTFNAVTGSSVNTAGGTGGAFNITVGPITLGVAATGTVDGGAGGNNTLVLQQGASANGTIAVNNYINFNHLDVTSGNWTINGASTAQDATLAGGVAIIGDNASLGTGTITATGGALQAGTAGLDVSNNVNLGAGGLTVRGATGLSLSGTVSGAGALTKNDGGTLTLSGANSYTGGTNLNAGGLVVGNNGALGTGALNVNASATLDTSTNVTLGNAVNLATGATLTLGGSNDLGLAGTIGGTGGLVKNGAATTTLTGANTYTGDTTINSGTLALGAGGSLASTGTVNLAGAGATFDLAGATGAQTIGSLAGAAGTNVNLGGNSLTLDGSANTTYAGTIGGTGGLTLSGTGTQALTGANVYTGDTNLNGGNVVVGSNTALGFGAVNVNGSSALDATTNVSLANGVNLATGTTLTLGGSTDLGLGGTISGAGGLVKNGAAALTLTGANNYTGGTTLNAGGLVLGNGAALGTGALSVGGAATLDTTTSLSVANAIDIGTSATLTLGGSNALGLSGAISGAGALVKDGAATTTLTGTNTYTGGTTINAGTLAIGAGGSLSSTGTVNLANAGAAFDIGAGGAQSIGALSGAAGTSVNLGANALTLGGTASGTFGGTIGGTGSLTLAGTGTQTLNGANTYTGGTNLNSGSLVLGNNAALGTGTLSVGGAATLDTNASLSVANAIDLGTGATLTLGGSNALGLGGAISGAGALVKDGASTTTLTGTNTYTGGTTVNAGTLAVGAGGSLVSTGTMNLAGAGAALDLSGASGGQTLGALSGVAGSNVSLGANALTLGGTASGTFGGAIGGTGSLTLAGTGTQTLNGASTYSGGTNLNSGGLVLGNNAALGTGALNVGGAATLDTNANLSVANVIDLGTGATLTLGGSNALGLSGAISGTGALVKNGAATTTLTGANTYTGGTTINAGTLAVGAGGSLASTGAMNLAGAGATLDLSGASGGQTLGALSGVAGSNVSLGGNALMLGGTASGTFSGVIGGTGGVTVAGAGVQTLTGSNTYSGGTTIASGGTLQLGNGGTSGSVVGNVVDNGALIVNQSGSVTLANVLSGTGSLTQAGSGQLTLTGTNTLSGPTTVAAGTLAVAGSLGQSAVTVQNGATLTGTGTVGGVVVQSGGIAAASQPGAALNVAGNVTFQPGSTLQVAVTPQQGGSIAAGGTATLNGGTVQVLANQASYQPSTTYTILSASSGVQGAFSQVNSNYAFLMPTLSYDPNHVYLRLVTNGTALPDVATTPNQRAVATAIGALGAGNALYDKVLTTDAATARQAYSMLDGELQASLKSTLLLDSRYVRDAVTDRVRQGLAPGSGPLAALSSGGAALCGDNTGGVTDPTLPPERRIGSREGCYGGTPYQPVVWGQAFGGRSRLGGDGNASTVNRSMTGFIAGADMALNDKWRAGLAAGVTHSSLDNDRSSSASVNSYYLSLYGGAQYGALGVRGGASYTWYRINTDRYPGFAGFSDHDSAGYNAHSAQVFGEVGYALPLGPVALEPFAGLAYVNLHTDGYTESGGAAALRAGGQTTHVGFSTLGLRAASQLGTIASGTFTARGTVGWRHAFGNVRPSSAFTFANGGTSFQVSGVPIARDSAVLEAGIDAHITKRLTLGLTFSGQYGSGVRDNAVLGNILWKF

SEQ ID NO: 9143 - protein, 362 aa, Burkholderia ambifaria
MKLRFGAVAILAVAQGAWAQSSVTMFGLIDAGVSYVSNEGGGKNVKFDDGIFAPNLFGFRGTEDLGGGYRAIFALVNQFSMANGAIIGTGIFGRNAYVGLESNRFGSITLGNQYDFMVDSLFSKNNAISRDISGLYGFRNGPFQRLALPDNPTGAFDWDRTAGSKPIANAVKYSSPTVSGFSGGAMYAFGGVAGSVGADNAVSAGVNYEMGPFGVGAAYTNEKYGPAPGVPSTSVRNWGVGMHYDFGVVTANALMTTVHNSFNDAGVWMAEAGGLWHVRPDVVLGAKYMYMKGNEAVNDNHAHQVSVALQYLFSKRTMVYVSADYQRANNGANAQVNGVLDPNGASSSASQTVARIGLHTVF

SEQ ID NO: 9144 - protein, 734 aa, Burkholderia ambifaria
MLNRHHRLALLACTAFVTLVETTLSHAQSTEEAAGAAEKQGRVTVLKKLSIQGGEKEGVADTPLAEQVTEEELDRNQITSFEDLGRSLEPGVNFNRTSGSVNIRGLEGPRVLTTIDGIPIPFIDDGARDADGGIDSFDFSALSTIDIVRGADSSRAGGGALGGAVVLRTLEPEDLIGEGKTWGGIFKFAYDGEDDSLGGSAAVAARYDNTAALFQGGYRRGHERESNGDVGGYSTTRTEADPADYDQNNLLFKVRQYTESGHTFGFTAERFDRDKDIDFMSGQSLFGNYRPGDYDKLDDTRRERLSLDYEFEATDDNAWFDSASATVYWQRLLRENGVDAYRSTSVIGDYSRLNEAEEEGFGASGYVEKFFETGNLQHQVTLGGDFAIGKLHQYSSGEDSCDTAPSPSCNFLHTNQSDSPDVDSRKIGVYLQDRISIGDGPFALTPGLRLDWYDYAPENTAAYMRNPNYDGLPPGQSDLALSPKLLATYQAAEEVELFAQWAMAFRPPTAEELYLNYGAPGSYLQIGNPDLKPETSQGFEIGANLGDEEFGGRIAAFYNRYRNFIDERWSFDPTGTYPIGITEAINRANVSIHGVEVSGHKVFANGVHVRTALAYAHGRDLDTDEVLGSVAPLKGVLNVGYAAETWGTDLIVTAAMDVSDKSTNSFKAPGYGIVDVTGWWEPEQMPGLRVNAGVYNIFDKTYWDAVNTQNAFTQPADFYSEPGRTFKVSLTQRF

SEQ ID NO: 9145 - protein, 372 aa, Burkholderia ambifaria
MNHPNGRADRLAVPLAALLACMTLPAVAQSSVTLYGRIDTAIEYANAGPNHVTRMGSGNLWASQWGLKGVEDLGGGYATIFKLEDGFNAASGALSNSSALFGREAWVGITGPFGGVQFGELYTILHTTLVTYSLPGLGAGLAWGNATNNFVGPAFLRVRNSMRYTSPRYAGFLLRAMAARGANGTAGQPATLGDTYGAGLNYVRGGLSVDVDYMQQKFSPVAASTLGATSTAANGNYTLGAISYDFNVVKVAALYLRHRGGPDVATAIDSQSAYPHSDIMELSATVPIGRASLLLSIGHYRKVADSDGNADSYGIRFDYPLSKRTVLYTGAAMVRNGAHARFVVNGAAGGGVAVAKPGATASSLVAGILTSF

SEQ ID NO: 9146 - protein, 274 aa, Burkholderia ambifaria
MKKLIVAGVVAGVSTLASAQQAGDNVATLGWLHIMPQDSTNGLTTNLANMPINGPLRLPGSFTSPGTSLTVNNADTVGLTLTHFFTDHIAVTSVLGVPPEFTLTGHGVIRPPGPAGSLGSVDMDKTSNQPAVKNARQWSPTIILQYYFNAPTAKFRPFVGIGVAYSWFSNIELNGNFAKDINENLGSVLAAGAGKPGATSVEGKASSSFTPVYNVGASYAIDKHWGLTATLTYMPLKTYSSLVIKAADGSTLATTRTRLKADPLITFVGISYKF

SEQ ID NO: 9147 - protein, 743 aa, Burkholderia ambifaria
MTVNRTTASPARRRRAKVGVGVGLGITLFAAQAAAAQGDAPAPDADAAASATLPAIAVSGERGGAFRAREASVAGLDDAPLRDTPASVSVVTRAQLDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTTGVDSRGSTSAAVDLGRRFGPDHQFGFRINAAKENMHSYIDGTNGRRTFGSIAADWDISSRASLQFNAEFQQWVQRSAPGYQLLGGTVVPSVNTTSKALGTQPWAKPVTTDALNLNARFDYRFDDDWNAYIAAGRSRTMIDDNSAFAYGCYYAPSCAAGATSPFFFGANGDYDVYDFRSPGEYRRNDDLRAVTTGKFATGPLRHELTLGVSVQRRVVHMANAVYDYVGSENIYGPDVAFAPSPNTAGPSYPQLDSWQYGVFGLDRISIGEHWQVLAGGKEVLLRQRSWDSLDGDATHTDRSVFLPQVALVYKPVNVLSLYASYSKALSLGDQAPVRATNAYAFLPPVESHQFELGAKYDWLDRLSLTAAVFSISKPFQFADPDASGTSYTFVQRGTQRHQGIELGAAGRLTERLSLTASVAAIRARAYDSGSPAYEGHQIINVPALRASLYADYAVPGVAGLNMLGGVEYSGGRNANEEGTARVPSWFVFNLGARYTTKIGGHRTVLRVSVDNLFNKFYWRDAGEQQGDAYLFPGAPRTARVSLTYDF

SEQ ID NO: 9148 - protein, 364 aa, Burkholderia ambifaria
MKTKLGVALATAMALAGPACAQSSVTLYGIIDTGVSYYNNAAHGGSFTGMPTLTGEVPSRWGLRGTEDLGGGYQAFFVLENGFQPGTGALNYGGRLFGRQANVGVNSPFGALTLGRQMNMTMIVLTNADVIGPSIHSMADFDSYLPNARSDNAIGYKGTFHGVTLGATYSFGRDAAGPAGPSATGCAGQVPGDIVACRQYTAMLAYDASNFGLAASHDVMRGGGGALAPLNNPAYTDTRDIVAGYVKIGPAKLGAGWIRRNLAAAAHLQADIVFAGGTYYATPYLALDLQGVRYLQRRETSEGGTNATLLVGRANYFLSKRTTVYTSVGYMFNSANAANAVAAGGTVATGSNQLGVMAGIQQKF

SEQ ID NO: 9149 - protein, 725 aa, Burkholderia ambifaria
MPSRRTPRRARTLRPWRASLPALITLCVASGAHADAEPAQAASAPAPASVSPPERELPMISVNASAAADPTVGYQPRTSSIAGGDARPIKEIPQAVAVVSSSVMQDQQARSLDDVLGNISGITQTNTLGGTRDAFIKRGFGSNNDGSVLVDGVRTPVLHSYLATIDRVEVLKGPASLLYGMQDPGGVINLITRKPEDTFGGSISASRTSHGGSSAQFDLTGPLGKPGQVAGGTLAFRLTGEYDTSRYWRSFGRERNALIAPALSWHDANTSIDVSYQYVDYTMPFDRGTVLVNGRPDDALRYRRYDEPWAQSSGIQETLRARVEHRFSDAWRVRATYGWGRDRYDQYIARGTAFNSATGAMTRTADANLGRNDSDQIATLGLLGNLTLAGMNHALYIGGEYERQRSFRGDTIRGKAIKGFDLYDPVYGLLAPGGTPNVKQSDSLSKVHTYSMIVQDSVKITDRLTAVGGLRWEDWQQESGMGRPFAFADRSHGNVWLPQFGLAYALTPSLTAYANVSRSFKANVASNVTSPLAPEFGRVLEAGLKFDLKPGITGTLAAYQIDKRNVAVTVGDITSTIGTARSRGIELDVAGQITRHLSLIGSYAYTNANDRDSNTSLVNVARHTGSLFAVYDTAIANLPGRWRFGGGARLVGARPGDTANSFTLPGYVTVDAFAAYETTIGKFPTRIQLNVKNLLDKTYYPSSNSNLIVAVGEPRLVTLTTTVSF

SEQ ID NO: 9150 - protein, 397 aa, Burkholderia ambifaria
MNKQLIAAPLLLSLAGIASAQSSVTLYGIVDAGVTYRSNERVGSPGAYTGHSAVGLTTGNLSGSRWGIKGSEDLGGGMRALFVLENGFDITNGTSGQGGRQFGRQAFVGVGSNRYGTVTLGRQYTSLDDFVSPVAPSSFIGGFGAHPGDIDDLDQTARVDSSIKYTSANYAGFTFGALYGFGSQPGSMKQRNTWSVGAAYAAGPLRVGVGYERSDNSKTGATDPTAGKWQSTDDGLFNSSINEGYASAQSQQVIATGATYNFGPAVVGVNYSNVQYRSGAQSLFSGHATFNVAGVFTRWNVQPQTQLFAGYSYTRGSDVEGIDNRAQYHNVTLGAVYDLSKRTSVYLLGAYQHASGTTLDALGRPVAATASVSDKANGHSSDSRSQAIVSLGLRQKF

SEQ ID NO: 9151 - protein, 370 aa, Burkholderia ambifaria
MKTLYKLAPLAMLGAFATHAGAQSSITLYGLISAGVGYATNQGGKNAWQALSGTNQNPRWGLKGKEDLGQGLSAIFQLENGFNVMTGTAAQNGREFGRMAYVGLADRTYGSLTFGRQYDAIHDYIGPVIIASNGVNIGDNDNGYNDIRVQNSVKYVSPVYYGLKFTALYGFSNATGFANNSAYSFGLGYERGPLRWSVVYAQYNHPYSSTNQDGAIANDYGSPLLIFAKSAMSPAVFASRQRIAGTGGFYTIGRAQFAALFTDVRYDYLDNSHLHLQNVGVNVVYTMTPQLFLGAAYAFTNGKYDVIDKRPKWHQVNLQADYFLSKRTDVALTVIAQQAAGDADHAQIFAYARSTGTRQMMATLGVRHVF

SEQ ID NO: 9152 - protein, 808 aa, Burkholderia ambifaria
MNFRVLLAGGAAPLALIAPGAFAAEAPVEAVPTATAPVDAPADAQVSSAGTGANDSGDIVVTARRRAETAQDVPLAISVVGGEHIDSTGSFNVGRLQQLTPTLQFYSSNPRNTAVNIRGLGVPFGLTNDGIEQGVGIYVDDVYNSRVASATFDFLDVKQIEVLRGPQGTLYGKNTTAGAINITTNQPTFDFEGKAEVSVGNLNFVQAKGAISGPITDTLAARFAVSSTSRRGTIYNVTTNQWIQSQDNLGLRGQLLFKPSEAFSITLAGDYSEQDAVCCGSVYVRTGTTQRATNRQFAALAAAQGYTVPSTNPFDRLTDLDSALQAGNKIGGVSLKVKWDVGPGTLTSVTAWRFWDWKPQNDRDFTGLPIVAKSQNPSQQDQYTQELRYNYSGDSLDFVLGAFGFYQRIDTQGTEAHGSASTKWNVNPSSSLYNTQVLDGLTALNTQYLKNTSLAVFGQASWKVTPELTLQPGIRVNYDKKDGFYQRRVFTGAGTEILLDGTTSATKTAQLAIFTPQTISPSFSDWNFSYDFTASYKVARGVLVYATYAKTFKSGGINQNGVPVDASNNPILAAATVKPESVQHYEAGIKTEFWDRRAIFNLSAFRTDIKDYQANVNNGQFGVLRGYLANAGAVRSQGIEADFSVRPSERFNAYVNSAYTDATYRKFVDAPCPPELSGGTSSPANCDISGQRLPGVSKWSFSFGFEANAPVEFLKQDGQVYLGYDGSYRSDFSSNPTPSAYTWIDGYSLSNFRLGFRTDAGLDVYGWVRNAFDQDYFEQLFVGPGNTGLIAGLPGDPRTWGFTVRTNF

SEQ ID NO: 9153 - protein, 386 aa, Burkholderia ambifaria
MNKKLLTIAILAATAGTAHAQSSVTLYGIIDAGISYVNHSKTANGGSGKLFKYDDGVAQGSRWGLRGTEDLGGGLKAIFVLENGFNSGTGALGQGGALFGRQAYVGLSQSQYGTLTFGRQYSFSTDILGSNYSTGGNTVAGNYAYHVNDVDQLTSSRINNAVKFQSANYAGFTFGALYGFSNSTDFAGAPATTSGTTTTAGSSRAYSFGLNYANGPFALGAAYTDIRFPSQATPAFSTTIANISTGNIRDLRTYGVGGRYIFGPATAWLLWTRTQFTPLASGASGTFYNAYEAGLKYAITPALSAAAGYTYTNATQSGSSAHWNQGNVALDYALSKRTDVYGLVIYQKASGNNVQAQIGSSTSYFNTSGNGSSNQIAARVGIRHKF

SEQ ID NO: 9154 - protein, 630 aa, Burkholderia ambifaria
MLKLSWKSLLVSPAVIGAALVAGAASAAPDNVTNAQVLDQLDQYTAEGQSSAIDQVTSVSELRDVQPTAWAYEALKSLVERYGCIVGYPDRTFRGDRALSRWEFAAGLNACMNVMERLIQENVAVLREDIDKLKRLMQEFEAELAALGARVDNLEARTSFLEDHQFSTTTKLTGEVIFAPTAIFGTKKTLNNQTDNNQAVFQNRVRLQFNTSFSGEDLLVTRLAAGNGNRFKSFYPTQNVIDPETGNPIGIVGDYYESPTFTQVHQLSPGDNNNVAVDWLAYYVPLDLGENFRLNNYIAAWGGIWDDFVPTLNPYFDDYTGGKGSLSQFTAQNPIYSIGGGTGIGTSLELGFLSNLLGPTSLSLGYLASTGNNPSSGGSVTNPATGNNYDFSSGGNGLFNGGYSALAQITTNIFDRVSLGFTYVNAYTTPDAAIFGKGGTQGIVGTTAANLNRSELNDDFVNGLGVGAPPVDAATYNNNVSGGSTSGNVINPYDFGGKQTNSYGVQMAWNIADWLSFSAYGSYTNVTLIGKDNGDIWTYGGGFAFPDLGKEGNVLGIFAGVQPYVSGFTNNTLGTTFVTTANPLQVELFYKYQLTDNLSITPGVIWISKPEQTTNATDAFIGTVRGTFTF

SEQ ID NO: 9155 - protein, 754 aa, Burkholderia ambifaria
MHCYPLARRPICAALFGALGLSAAPAYADSSPQSATPLPVAVAASSRADAALLDPVTVTATRTATAASRTAASVSVITDDDLDEQQATNIKDALRYEPGVTVRRTAYRPGSAALGGGRDGDSSINIRGLEGNRVLLMEDGIRLPYAFSFGPLEAGRGDYSDLDMLKRIEILRGPASALYGSDGLTGAVNFITKDPRDLLSIYGRPYYFSLRPSYDSTDRSIGATVSAAGGNDRVQGMIIADGRRGHEIDTRGSNNSASTLRTTSNPQDVYSESLLGKLVLTPTARDTIKFTAETVQRRVSTDVLSAINAPATLGLTTRDRLERNRFSVDYDFRDDTFRWFQNAHVQFYYQDAKQDQYAFETRGTQRSRSRDNQYKERTFGGAAFTESGFSTGPLAHKLLVGVDGSVSRVTNLRDGTVPGVGESFPNKAFPDTDYTLFGAFVQDRIGYGRLLVTPGLRFDTYRLSAAQNDPLFTGKAVSTSANELSPRVSVLYEIAPALIPYVQYAHGFRAPTPDQVNSSFSNPVYGYTSIGNPNLKPETSDTFEAGLRGKAGTGYGIVRYSAAAFTGRYRNFIARTTIAGNGRPNDPFVFQYVNFADARIHGIEGRAEWAMPNGITLKTAMAFTKGSTQNDGAASQPLNTVNPFSAVFGVRYEPGERWFVQTDLLFQAAKRDKDIDRSDCSNRACFAPPSSLVVDLRGGYRFNKHVSATVGIRNLFDRKYWNWSDVRGIAADSQVLDAYTSPGRTVAVSMKVDF

SEQ ID NO: 9156 - protein, 683 aa, Burkholderia ambifaria
MKKQKRRFSVRIKKRGLLAPVLAVSLLSTPAMADDQAPKSDESGDVFTLGNVEVTGKGESIKNPAVEVVTSEDMLQFDTKTVSEAANLVPGVTLAKMGARNESTVYVRGFDLKHAPLFMDGIPIYVPYDGNVDLGRFFTYDLSELVISKGFASVLYGPNTMGGAINMVSKRPTKEFEGSAGTGYSSVDQYHAFANFGTNQGKWYFQGGGSWFDTNGFEMSEHYHNTTYENGGKRNNAYAQDWKVSGKLGLTPNSTDEYALSYIYQNGEKGVPPYAGDNLTNQKKKFWQWPYWRKQSLYFTSNTAIGEKSYVKTRAYYDRFKNSLLIFTNDSYSTVTPNSGNRSWYDDYTYGASIEAGTKLISNNEIKLAFLFKDDVHREDDDATGSPQKRFEERIFTIALEDTIKLTDKLSAILGVSYDFQNTVQAQDYNPIVSGGPNVLHDFDRKNNSDVNAQAALFYAYSDTGKVHAAVARKNRYPSIKDKYSYRFKTYVPNENLDPEVSNNYEIGVEDTFAKNIRVKSTLFFNDISKYILEVKNVEGTKSQLQNVGHVQRYGYELEANAAITESLEAGMNYTFMYNKNRTSDLVITDLPKHKFFAYGTYSPIKQLKLFASLEYDTRRYSSSDGVDEAGEFVVINTKASYEAIKDLVLEAGINNLLDRDYELTEGYPEAGRTYFVQARYKW

SEQ ID NO: 9157 - protein, 385 aa, Burkholderia ambifaria
MKKLALSTLSLALLGAAGAAHAQSSVTLYGVIDTSIAWVHGNNGQANNSWQMLSGNLQGSRWGLKGAEDLGGGLKAIFQLENGFDPGTGHLNQGGRMFGRQAFVGLQSDQYGTLTLGRQYDPLVDLVQAVTADNYFGSVMATPGDVDNNDNSLRVSNAIKYTSPVWAGFQVEGMYALGGVAGKTGSGQTWSVAAAYNNGPVGVAAGYFYAANPSPTTAVGRAGWGSTTSDAIFDGPINSGYATAKSIAIAQVAGQYALGPVTFGLGYSNAQYKPDAFSGFGSTEKYNTGRAFVTYQVTPPLLLGLGYSYTKASGDTKAKYHQVGVGADYSLSKRTDIYLVGAYQHASGTQLVDGVQQSAQASIASYGFAGKSSAELVALGIRHKF

SEQ ID NO: 9158 - protein, 382 aa, Burkholderia ambifaria
MNTKTRNGLLAAGACCALAAPGAHAQSSVTLYGIIDTGVEFVSHANAAGDHVVRMPGVTGELPSRWGLRGTEDLGGGYQAVFTLESGFNVRGGDLGQGGRLFGRQAFVGLKSGFGTLAFGRQYTMTYLALQGADIIGPDIYGLGSLDAYVPNGRADNAVTYVGTYRGVTLGAAYSFGRDGAGTGNSPGQGTCAGQVPGDAVQCRNWSVMLKYDSAYFGAAASYEEQRGGTGAAANFFDGVAPVAFTSSGGKDARTHVSAYAQAAGARIGAGWIGRRVSTGSPAAAGAHSDLFFVGASYAIKPDFVVDGEGYRIVNSAHDTRATMATLRATYLLTKRTAVYAQSSYLWNSAHARYAVSGGGAGTTPVQGMGQLGAMVGVRHMF

SEQ ID NO: 9159 - protein, 701 aa, Burkholderia ambifaria
MSRKNWAAAPMAIVVGTAGLSAAEAQELSLPAIEVSGQRATAPFRAPESTSATRTETDVMEIPFAVSSVDKKLIQTVAATRGEDLYDWVAGVARQNNFGGLWDNYAVRGFAGDGNTSGTDYLVNGFSWNRGISVPRDTATLERMEVLKGPASALYGRGDPGGLISYTTKQPQFARANTIGVSAGSYGALRETLDSTGPVTKSLAYRFIAMNEDNGSFRDTVSSKRYLFAPSFTWDIGADTTLHYEFETARQRAPLDRGVVAVNGQLGAVPASRFMGEPRDGDYDVRNSGHQFTLEHRFNADWSVNAGFAQRDTDLSGRSSEAFALQPDGRTLWRRYRQVAFHSNDVQGRVEVAGKARTAGIGHTFVMGVDAYRFNYDQFVSRSTPTAAAPYAIDIFDPVYGQPAPVPRTATNLLERDDGQGLYAQDTLAFGSHWKVLAGLRWDRFHQSVENRLKGVTTTQLQTALSPRLGIVYEASPALSLYANTAYSFRPNNGADVNGRAFDPEKGRGYEAGVKWAGTRWLATVAAFYVNKRNVLTADPANAGFSRAAGEVRSRGVEFEWNGELGHGLRGIVNLAYVDAQVTHDSVLTPGARLVDIPRLSGSALLMYETALPLVDKAGAGAGVIYVGRRAGNTANTQDGFDLPAYATVQLNGYVQVNKHLRASVVLNNLFNRTYYVSSYNNLWVTPGAPRSLFASLAYTF

SEQ ID NO: 9160 - protein, 723 aa, Burkholderia ambifaria
MNARYVLLASSGVLALALASTAVAQTTPAPSEAFALDEVVVTAQKRSENLQDVPLTLSVFGAKEIEQARIVQVQDVANRTPGLNFDTFPSSQPRPTLRGIGSSDRGAAGDPSVSVFIDEVYYGRPSAVAFDAFDVERIEVLKGPQGTLLGKNVVGGALSIINRKPQADGFDAGASVTVGNYSRLEGAGFVNAPLADGKAAVRLSLSSRNHDGYTRNAYAGGRAEDQATDSGRLQLLLQPNDAFSAILAVDGTRDRGNSDARHAVQVDPSVPASALWRIKGQRDEYYAENNGRNDRDTWGVRANLNWDLSAFALTYVGSYRELTYHYAEDFDGGNPTLYALNFRGGQDEKSSFYSHELRASALPSSKLRWVVGAYYFGADTQRTDSLLADIKSRPTPPATYAAKDLFHQDAQTDSWALFVDATWPVTDQINVFGGLRYSKDQKDYALNNLDSTALLRAATRYSIDASHDWDKLTWRLGGDFSPSDNVMLYGVVSTGFKSGGYQDTPSTATSATTPFNPENATLYELGAKTTLLDRRLTWNTSIYQTDYKDLQVRSTRGFDTITTNAGSARIRGLETSLDARLGERLRVAASYAYTDGKFLNLVDRGQDRSGNHMTRSPKHKVTLSPSYAQPLSSGARLTGAVDLAYETKIWDDIDNNPITVRKPKLLADGRVVYDSAGGHWNLSVWGKNLTDRLYRTHQVVFQGADLATFGAPRTFGATLNWKY

SEQ ID NO: 9161 - protein, 332 aa, Burkholderia ambifaria
MKSQRKLLAVMAAAGSLAAGAASAQSNVQLYGTVDAFVGSVRASGDAHSTAAVESSGLTTSYWGIGGQEALGNGLNAEFALESFFRTDNGKVGRFDGDAMFGRNAYVGLNGGFGAIKLGRNTTPWFVSMLLFNPLADSATFSPMFLHTYTTPPGSPVGNSVAGDTAWDNSVLYQSPGFGGLRFNAIYSTGETTGHQGKQNYGGNATYFNGNFGATLAVQRVAVNAPEFAASGASYQMAYLAGASYDFKVVKLFGQYAQSDNDFNAQSRQRDKTVQVGASAPLGPGSLMATWVRTWQGGNEIIGSARRDTTRWRTTIRSPSAPTCMPPGGMTR

SEQ ID NO: 9162 - protein, 405 aa, Burkholderia ambifaria
MKKRVAFAMTAVGLAAATAAHAQSSVTLYGIVDNAIAYQNNSSATGATTGGHSKVQMATGIWAGSRFGLKGSEDLGGGTKAIFQLEAGFNANNGSSQWANGIFTRQAWVGLSNQTYGTLTAGRQYTAYYTLLSPYSPTTWLTGYYGAHPGDIDSLDTSYRANNSLVYMSPKFYGFTVGGSYSFGGVAGSVNRGSTWSAAVQYLNGPAGIAVGFQRINNATLGGGVWGANSTAQNGLDTSGNGAEQAVSSINNGYKTAQAQQRLAVTAGYQFTPAWDVSVSYSNVQYIPGTLSGFKNTAIFNTAGAVLHWKAAPQWDFAAGYSYTRATQSNGISSSAKYHQVTLSQYYSLSKRTGLYAVEAYQHASGNTLTPTGGVILATTSTGDGVGAGSKQNQIAAGVGLIHRF

SEQ ID NO: 9163 - protein, 380 aa, Burkholderia ambifaria
MNKTLIAAASATALFAPLAHAQSSVTLYGLIDAGIAYTNNVNGGSPWRVTTGTINGSRFGLRGTEDLGGGLKALFVLENGFNANNGALGQDGKLFGRHAYVGLSHSGYGTLTLGRQYDTMVDFVAPLSATAGDFGDTGFAHPFDNDNLNHSVRINNAVKYTSDTIAGFKVGALYGFSNSTNFAGNRAYSVAASYTNGPLKLAGAYLQMNGTKGSTSASPGATDVAEAKSVSQGGWSVGADRMRTYGGGVSYGFGPATVGFVYTRSQYDNSGSFGSTGQVAFNNYDVNLRYAVTPAVSLGAAYVYTDASVSNPDSKHGTDPKWHQVDLQAVYKLSRRTDLYAEAMYQHASGRGYQAFINTSGGASSTANQIVGTIGMRTRF

SEQ ID NO: 9164 - protein, 390 aa, Burkholderia ambifaria
MKRIRSLALLALPASLYAAGAHAQSSVTLYGIVDAGIAYVHNAQNANGSNASNLVKFSSGNLSGSRWGLRGTEDLGGGLAALFQLENGFNIGTGALGQGQREFGRKAIVGLSSGTYGTVTLGRQYDPVVDLVQGLTEDNYFGGVFATPGDLDNYDNSLRVSNSVKYTSPLIAGFQAEALYGFGGVAGATGSGRTYSFALGYANGPLSLGAGYFFANGGTTTANGIRSWTSSSDTLFNTVINQGFSSAKSIQIVRVAGQYVAGPATFGIAYSNTQYGADTLSAFRQTAKFNNGSAFFNWQFSPALRAGVGYNYTSLTGPTSAHYNQVNVGADYALSKRTDLYALFGYQKASGHTLDANGARVNATASVGSYGVNSGTDTQELAIVGIRHKF

SEQ ID NO: 9165 - protein, 355 aa, Burkholderia ambifaria
MKNRIVIGCAALAGAIASTGAFAQSSVTLYGNLDAALLYTSKTLDAATGANAGHQFAMTDTGMTPTTFGMTGTEDLGGGLKAKFQLESGFAVTNGAFAHSNGNFFGRQAWVGLDGGFGTIKAGVQYSPFLLAIFDSDPRNFSHFGSGLINYVDNVLVTGLFNPNAVSYTSPTIAGLTGSAMFAFGGKAGDFQAGRQYSASVKYEHDGFMINAAFYDGNDGTNPTPTPSTVAFVGRTIGAAYRFGPVTAKASFASYKVGGSFSNNVYGGGLDYQATPAVDLNGGVWFTSDRNDTANHSLLAAVGTTYSLSKATALYAQVAMVNNHGAMNTGLGINNALYAVTGTTIGANLGIRHLF

SEQ ID NO: 9166 - protein, 478 aa, Burkholderia ambifaria
MRPGILWIARSFACLICLASAHAQNLSATPELPTEETEAKGAKLDTSGNLLGDMGGLRSWLYGYGVTFSLIEIDQVFGNTTGGKEQRPAYIGVTAATLTADLEKSIGLEGGLFNVSALQIHSRSITQAQLLTFNNISDSEAWWSTRLFEMWYQQGFFDDKFDIKIGQIDLDTEFWISQYSAFFHNASFGWALMPSLELYSGGPSYPMGALGVRLRYRPDNQWTFLFAGADDNPTGGPFSNPVDPSNQSLHPSGTFFNLGNGALLIGEMQYTLNPPPSDKSKATDDPGLPGTYRLGGLYDTASFPDPRFDTAGHLLASPQSNGYPMQHKGNWMLYGIMDQMIWRPSVDSPTALGFFARASGTNDDRNIVSFAVDAGFNFKGALAGRENDTFGIGWGMGQVGNRARAADRDHYYFSSDFYPIGGAEHHFELTYAAQVTPWLIVQPDFQYTWNPSGGILNPNTGKLIGNELVLGLHAGITF

SEQ ID NO: 9167 - protein, 1129 aa, Burkholderia ambifaria
MGTAQATLLNAIRCVCFIGIASLPALAQFRGTIQGTISDTSGAVIPGAKVTLTNTETQRKQTSTASEEGFYHFAGLAPGRYTVEASANGMRKGIVTGIALEPESATGVNITLQAGEVTESVTVSSDAAPPLQTESANVTADLSTAAVRTLPQVGRDPYELLRLAPGVFGSGARSAGGGSVALPNASGPGGSNASIFQTENQVPIVANGQRTSLNNFEIDGVSVNSLTWGGAAVVTPNQESVKAVRVSSSDYSAEAGRNSGAQIEVVSQNGTNQFHGSGVFKYNDPILNAYNKFGGPNGAPQVRVNQLLRQFAGSAGGPIVKNKLFFFVSYEGLRQGTTNYTTAYVETPEYRQQVLAERPQSIIAQVFSNPGIQPRVASYLPTACPAGFAAGACRQVAGGLDLGSLTGARGQYVDTGSQPAGGGLDGVPDVSFAQLTLPGSLQGNQYNARMDFNPTSADSFALSTYISALHQLSSDSAGGSRPLGDLPLKPLNTAATATYNRTLSPTTLNELRFNFTRFADDGVSDAANVNFGIPRLEVEGLALPDRIRFGAPQSETTPAKFAQNQYELRDNLTKVWGNHALKFGAEARWEQDNNSLVGGARPLYTFTGLFNLANDAPTFEQINANPTTGAPADAQRYFRSHTIAFYGQDQWKIQPGLTLTLGLRWEYFSPIAEARNRLTNLVLAAPYTLLGARVESLGQLFHRDRNNFGPRLGFAYNPSGWKKLVVRGGFGVYFNRQPNVLFANSRGNPPLLARFGLCCGTAASPFDNGQIQYSLGTGSSIYGYPANPALAVGIDPLTGAVTNRTVEVWGSQQNFPTAYAFVYSWNLEYALPGRMVASAGYQGSTDHHLIRIVNENFLYPNNPAFGPVYFPQPDVNSNYNALNLTLTRSFAGGFGLQANYRWSKSIDQLSNEGPGSSANQTYPQDQRTERGPSDFDATHSLTIAAQYELPWYKKRGGVAGALLGGYQLAPIFTWHTGFPYTVKIGQSVSTPGGPTLGPIRPVQYYGNAVYDNSNDAFINGTNWPGGGKTYFDIQSAGPPGIGRNTFRGPRYFSVDLSAVKQIRLSSRFHLGEAAALEIRANLYNLFNTLNLTPFGFFDSGVFADSPQFGRATQPGLAGRVVEFQGRVSF

SEQ ID NO: 9168 - protein, 1459 aa, Burkholderia ambifaria
MNRVYRLVWNRTLRAPQVVSERTRASHGGIDASHGAMPARRCAASIISIGMSLGLAGTALPGWAATCTVSTIANCSAPGGDGIPDRSGNGGSGNGGGGGASALGGGTTTIQVPGGPTSGGTGGTGAMNDSGQSGPGGAPGVAPAGDAVINGNTQGGAGQGFDGFNFAGGGGGGGAGVYSTGTGVTVNNGVTVQGGTGGNGGAGTSGPASNGGGGGGGGGALVIVTPAADVTNRGTLIGGNGGNGGGGGNPGGGGGGGDGLLTVGPGSQVTNLGTIVGGVGGAAGGGGSTAGASGAGVNLGGGFTVLSNVGAITGGAGNGGAAGAGVIANGGDVIVNGGTIAGGLFADGVTRAAAIRFNGANDTLQLVGGSNIIGDLDVAAGASATITAGTPGLALSNHITLGDVASRVTLNSNTTDLAVSGVISGTGNVAVSGSHTITLTGDSTYTGGTTISAGTLQIGNGGATGSVVGDIVNNGTLAFNRSDTVSYGGTISGTGSLVQAGTGTLAIAGAAGYAGSTTVNAGTLALIGAGSIAASSGVINNGTFDISGTTSGATINALTGTGTVALGGQTLTLANAAGTFGGTIGGTGAVTVGGGTQTLSAVNTYTGVTTVNAGTLALTGAGSIAASSGVVNNGTFDISGTTSGATINALTGTGTVALGGRTLTLANAAGTFAGTIGGTGAVIVGGGTQTLSGANTYTGVTAVNAGTLALIGAGSIATSSGVVNNGMFDISGTTAGAMINALTGTGTVALGDQTLTLANATGTFSGAIGGTGGLTVAGGTQNLSGANGYTGATSISAGTLALSGAGSIANSSGVINNGTFDISGTTSGATVNALTGTGTVALGGRTLTLANASGTFSGAIGGTGGLTVAGGTQTLSGVNTYTGATMVNAGTLALSGAGRLASSTSVTLAGATAALDLSAGGSQTVAHLSGVAGSRVVLGGNALTLSDDSSQTFSGSLSGTGGLVKQGAGTLTLNGVSSAFSGTTTVAGGTLAVGDAANAGAVLGGNVVVNSLGTLRGHGTVSGDVSSSGVVAPGGSIGTLSVGGNYTQAAGGTLSIEVSPTEASQLRVGGAATLNGSLAVLFDPGTYTARRYTVLSAANGVTGRFANVGTTTAGANLGALQSSVDYGANGVDLLLAEAAGPTPAGPTVIAPTKTSIYTALGTTALLQAQGASSTLLGRLVGPQDNAAGSRNVWAVASGSSTKVGGTGGAPGFLTHAYGFLAGAGGRLGDATVGAAGGYTHTTLGEDTTGASGAIDTLRVALYGAQPVGAVNLSATVGYGLDFLSQKRPFGSAGTAEGDHLGHEFTAATQASLPMDAGGLRIAPHIGLRYAYVRGSGFGESGANGQNLHVGPDSARSLQPYVGVSLDKAFGDALRPVNVQLRVAYAHEVLGARRVVQVGSQDGTVFAAPGTDLPRSFLTTGAGVTLQAAKATTVSLGFDATIDTSHVSAQSAYVRVNHAF

SEQ ID NO: 9169 - protein, 264 aa, Burkholderia ambifaria
MTLPTTIYSFPAYLSRFSSTDKPVKLKFHQYARATLLSNRGRDHNCDGRRTVEIHKLDLSDWQAFNKLATRCNAYDGITMNGDNSFGWNHEATLDNIHAQKYNKAYAGARLTAELKYLLQDVESFEPNSKYTIHEVVLGPGYGTPDYTGQTIGYVVTLPAQMPNCWSSELPTIDLYIDQLRTVTGVSNALGFIIAALLNAYSDLPHDLKIGLRSLSSSAAIYSGLGFERVPQERDISCARMYLTPANHPDLWTQENGEWIYLRN

SEQ ID NO: 9170 - protein, 361 aa, Burkholderia ambifaria
MKWGGFYNSHVGYVTVDSDTPAHAGADFDGVDVYANTEIHFKPSVTLDNGLTFGVDIQMEGTNNGGGATGIDETYLSISGDALGKIDLGNENSAGYKMTVAAPQVKGGIGINSPSISGFVPISNGAGGNLPWLFRDSGISSYAEVLANNDVPRITYYTPSFNGLTLGVSYAAASNVAGTGANAGNNFGVNRNAGVTDIFDIGIAYSQSFSGVDLDLSARWGTAESNVAGTSDPEVWGVGASVGFSGFVIGGGYSENDNGGIRAFDSEGWSLGVTYDIAGPWSVGFDTYQGEYNGVGAGSGDAAEYEAYQLVGSRSLGAGVTWAVYAAYVEGTVNADAGGTFGNANTTTEGTLIGTSINLSF

SEQ ID NO: 9171 - protein, 988 aa, Methylobacterium populi
MRNSKLSQSIRLAILCSLSAPVALISNSVLAEEAAQKDKNIEVIAITGSRIRQVGAESVSPIISIGEKELGFLQEPEVEQILRSLPATIPGDGSNVNNGSAGAATIDLRGLGSQRSLILMDGRRMIPFNYNGSVDASTIPSALIKSIDIVTGGASATYGSDAIAGAVNVLLKNDFEGVDLDLKHSRTGDNDGDKSSIALTIGSSLANGKGNAAISIGWMQRDQVLLGDRSLGLLGIETANGANYQQFLNGEAPAPAPSECSAPNSVASGGSTTAIPTRFAIVGAGASAAGQFRNDGTLVNKECSVFNFNPYNFYQTPTERYTATALAHYDITEEQQIYTNFSYANNSVDTQVAPSGTFGAAFNLPLRNPLIGNQAREFMIGAANTALSNGLLDSTNWQDLNNNGVVDADDYLKVQLRRRTLELGARTERFDSEQFQFVVGSRGQLFGDWEYDAYYQYGESNRTTVRAGYTNLTNIQNALDSFDGVTCNNGDSTCVPINLFGGYGTITDEMAGYAQAVALQQQKYSQEIATVIVNGPVDMIQLPTADAPLALSFGYETRTEKGLFEPDECLKLAPASCQGGAGGNQLPVKGGFKVDELFFEGALPILADLPAAQSLDLSFGYRWADYDTVGNNETWKLGFNWRPVDSVLFRVMQQQATRAPNVGEIASPVVTSLDNSKLDPCSVANAENIDARLRQLCISTGMSDAQVGNVQDVVSGQVNVIQGTDPNNQPGAEQADTLTAGIVWTPEFDFAQNLTLSVDYYDIDIKDTIDKFSAQEITDACYIYGDVNACAKIKRVGGDLTVDGAGIEQLTTNLKYQRAQGVEIGFNLAFDLTEMGQLEFSGTVNKYLKQESQSSDTLPVLDCKGHFGTSCDPIPEVQWVQRTTWNYEDTTVSLQWRHSDGISAEPSERAGVFETFQTIGGYNYFDLFASYNYSDNIKLTFGIDNLFEKEPPVVGNEAGDTSSNSGNTFPSNYDVLGRKFKMGIKFQF

SEQ ID NO: 9172 - protein, 738 aa, Methylobacterium populi
MTRRNLIVLLMCSVSYPAIAQQAVMLDEITVMAQKRPEQAADVPISIDVWSGQRLEESRTLRRDQALSATPNAQMGTVSGSLYTNFTAIRGVGSALIDTDPAVGLYVDGVAAGASQTYGGNLLDIDRVEILRGPQGTLYGRNNLAGSVNVISNLPDPSRTYGEFGVDYGRFNTARSFGFFNTPIGNSGWAVRGALSGSRNDGYTPDDATGGKVNSLQDISGRFSVMGPVSDTVDFLGSVEHERQRTVDGAFMSEADFQAGRRSVDIVNPFNGTLSTTTARAQFTARLDNGDRLVSLTGFRTNETDFKGNSFPQGYFAATNAFFRSAGVAGFQYRADNPFNGSYDQISQEFRYESDHNERFKWVGGLYAERSHGSRQYGLTNSFDSGGFLSGSGVTLQSKGVTDTTALAAFADGTFALTERWKIFGGARLGYDHKEFSYDFRSDNASFNTIFAPVVAGFAPAYLASLSAPYVTPRFGTQFEVSDKLNVYASISRGYKSGGFNAGFVARGDEKAFDAETLWSYEAGWKGRFLADRLSLNGSVFFMDWRNQQVQTFNVATQSTPIQNAPKSRSYGAELEARLKIDDHWSVRAGLGYVDATYVDFKNALATGASTTIDVGGNQQQYVSKFSGTVGIGYAWNVGYDDLQGSAEVAYQFRSGFYFDVANTLRQPAYGLLNARIGVENERYAAHLWGLNLADQRYRVSATDFGLGSLVAVGTPLTVGATFKIKFSQQNDAHAVVK

SEQ ID NO: 9173 - protein, 537 aa, Methylobacterium populi
MSTRSFCSRLLLLFLVGLVGGGPAIAAAQTADDAYRFSNRFPAVGTRATGMSGAGGVGGWADPSALYTNPAGLGYYQASEISGSLSGLLSRDESTYQIFVDGPASQNTGDNATARLGHLTGIYNVDTERGSLVFALGFNRTSAFDRELTYSGKNSSSSITDTFLPFGEEFDVSEDNGTVNIDVFPVVPFVAFQAGAVEFFNSRFQNDQYPFLQAVAPGQSIQQDGTVTRGGSMNEFSFAGAVEVAPDVMIGGAANISYGTYVFENELTETATRPGSNDGYSVVVGDRLLEGFRSMFFRERFTSDLTGFNLRLGLSANAAEDVRLGFTVETPTWYSIDETFTDAFIRTEFGNGSLAYGDDPDEDAARGEFQYQLQTPWRLSTGVSYTRDPFLISADVEFVDWSQTRLDADETEFDVTNETLEEYDYVVNWRGGIEYRSENGLSLRTGIAYRPGARGFDFTLADGEETDRSRLFLSAGAGVQLSERLSLNAAWMQERSTDQFLPYASVTPPGESEPIDVPVIDEDVVRNQIRVGFRYSF

SEQ ID NO: 9174 - protein, 674 aa, Methylobacterium populi
MSIVRNSALPLPCLSRSETFKKVRSHMKFMKVLTPWIYRKDLWVTAFLLTAIPGSFAHTLVDIAGEPRHAAQATGVSGDGKIVIGMKVPDDPFAITVGFQYIDGHLQPLEAVRPQCSVYPNGITPDGTVIVGTNYAIGMGSVAVKWVNGKVSELPMLPDTLDSVASAVSADGRVIGGNRNINLGASVAVKWEDDVITQLPSLPDAMNACVNGISSDGSIIVGTMVDVSWRNTAVQWIGDQLSVIGTLGGTTSVASAISTDGTVIVGGSENADSQTHAYAYKNGVMSDIGTLGGFYSLAHAVSSDGSVIVGVSTNSEHRYHAFQYADGQMVDLGTLGGPESYAQGVSGDGKVIVGRAQVPSGDWHAFLCPFQAPSPAPVHGGSTVVTSQNPRGMVDINATYSSLKNSQQQLQRLLIQHSAKVESVSSGAPSFTSVKGAISKQSPAVQNDVQKGTFLSYRSQVHGNVQNQQLLTGAFMDWKLASAPKCGFKVALHYGSQDALVERAALPYTEQGLGSSVLSGFGGQVQGRYDFNLGETVVLQPFMGIQVLHLSREGYSEKNVRFPVSYDSVAYSAATSFMGAHVFASLSPKMSTAATLGVERDLNSHIDEFKGSVSAMGNFVLENSTVSVLRPFASLAMYYDVRQQQLVTLSVVMNQQPLTGTLSLVSQSSYNLSF

SEQ ID NO: 9175 - protein, 795 aa, Methylobacterium populi
MHTHLSALATAVVAALLASPALAQTAAPANGPANTLDTVIVTGTRVSDRTVAESQSPIDIISAESLQATGTPELATALARALPSLNFPRPALSDGTSAIRPAQLRGLSPDQVLVLVNGKRRHTSALLNLNGTIGRGSAAVDLNTIPVAAIARVEVLRDGASAQYGSDAIAGVVNIVLKGAEKGGSLQAGFGQYSAGDGNNYELSGDTGVAYGGDRGWLHVAAQLNQQDPTDRARGYAGAPSASQPAVGQKAFKIGDPQVNAQAVSANTEFAFSDSITGYAFATASNRDITSFAFFRAPGSTTQNILSVYPQGFLPEIQSDAKDRSLVAGVRGSTASGWDWDASYTYGDNRIDFHTRNTLNVSLGPTSPTSFYDGALETTQNIVNLNVKRGFDWGLAYPVTVAFGAEYRNETWNQSPGEVGSYFQSGTLAGGAQGFGGFAPSVSGQYSRDSHALYADIEADFTDKFSAGLAGRYEDYSDFGSQASGKLSARHAFTDKIALRGTVSSGFRAPSLAQQYFQSTSTTFLAGNPNPFEIRTFPANSTVARALGAEPLDAETSLSYSLGLVLQPTDALYLTVDAYQIEVNDRIVLSSNLTGAGVRNLLESQGIFGINGGRYFTNAVDTRTRGVDVVGSYRWQLAASSLDLTAGYNYSETEVRSVAANPAALSANGLSLERIDRTERGRIEEGFPRDKFLISGSWNLEHWTLALGATRYGKFSTRPADASNDQTFGAKWVVDASASYKVDRWTLTLGADNVLNEYPDENNVANSTSGQFPYSNLSPFGFNGAYVYGRINYRW

SEQ ID NO: 9176 - protein, 735 aa, Methylobacterium populi
MAAPVRASTHAFRLHPLATALCCALGAAWTPAAHAQALAEAALPAVEVSDQATADANGLLPLNKTVGTASRLGLTARETPASVHIVDRAAIEARGAQDTQEILRSIPGVTAYSPPGNIGISYRGFGTGSVSQLFNGINLQYSIAARPVDSWIYDRVEAIGGASGFLYGAGGVGGTLNYITKLAQRDSFTEGQLRLGSYGLKEASVGLNRRLGDATDSQGTTHYLRLDLNHRDAGSWVGGTQSRSTQLAASLLSDLGGGLTHTLAYEAQHERVDRPYWGTPLLNPLRGQARIDEATLGKNYNSADGLYAQRVQWLRSITEWRASDRLKLSNTFYAYDALRDYRNVETYRFTPDNSAVVRSAALLQRHDQRMVGDRIEGSYLGELAGRRSEWAFGLDVSVNRQTRFPNSLSGTVSTVNPYDFTTENFYDIPGMAPGFRPDRDNKVTTTALYLENRTALTPALHLLTALRHERIDVDLTNRRDVTPALPASYSRSYSPTTGRVGLVWDATPEANLYAQFSTAADPPSGMLMGASFADAINNTGLTTGRQVEAGSKLSFWQGKGTAALAVYHITRRNISTQDPQDSTRTVLVGQQSSRGVELSMGLAPTPRWSVQGNWSHVDARYDNYQQGGVSLAGKRPTNTPASVLNLWTSYRITPALEVNAGLRRVGGIYADAANTLSWPAYTLLDLGLSYRIDPRMTVIARLRNATDRVYAASLTSTMAYLGAPRTADITLRVAF

SEQ ID NO: 9177 - protein, 828 aa, Methylobacterium populi
MPHLYPTPATKLTQAVRLVLFGMSLASAPCLLLMPAQAMAQSQTAYHVPAGPLGNAITQFGVQAGVTISFDTEQTRNLSSAGLEGSYSVEEGLVRLLSNSGLQAQRQGNGGYVLVPADYGTAMELGPLNIDSNRLDATSEGTQSYTARAVTIGKGVHTLKETPQAVTVMTRKMLDDQNLNTLEQVLDKTPGITVYDSPMGGKYFYSRGFNLDGQYQYDGVPLDVGGNYVQANSFSSDMAFYDRVEILKGAAGMMKGSGSSAGGVNFVRKRGQDKAATTVTLSAGSWDNYRGQVDVGGPLNESGSVRGRAVAALQDRQYFYDTAKRQDQILYGAIDWDVSADTTLGFGLAYEDVDATPCYAGVPRYADGSDLKLSRSTCLGASWNDLQSQRITGFADFKHRFNDDWTLNFASVYTHNDQDIEYAYSEGTVPVGANTASMAVRAGRFDYDQDDYGFDSYIDGKFEAFGLQHELIIGANASRQKTHDYFALILLDGKQNPFNPSPNFPRPSKDDYLVNPTRGGSVPTDSTTTQYGTYANLRLKLAEPLTLVLGARVSWYRNKSDSYTEFYDYWVNNRSEENGQVTPFAAVLYDLNDQWTAYASYADIFQPQSDKVNAERQPLQPKTGANYEIGIKGELLGGALNTSFNLFRTVENHRAESDYIETCPSGDGYCYTDSGKVRAQGFEAEISGSPIERLQLLAGYTYTQTKYLKTIEDSDPTELTFTSSFIPRHMFKVWGDYQLGGALERWTLGAGLNSQSENFRTTRNTRVEQAGYTVWNGRVQYRLDQNWTVALNGNNLFDKKYYATIGAPGWGNFYGEPRNFMVTLQGAF

SEQ ID NO: 9178 - protein, 698 aa, Methylobacterium populi
MPRRRWHTPSPYGPRGNGPGRSLPSLLMRSTLSRSTAALKPSVRPSMPAILAAIALFPSASVFAQDATPDESSTTTPASASANGPAPASAPAAAPAAAQAASGQTLAPVVVTASRTAQSVTEALPHTTVVTQEDIVNSQAPDLRSLLRNQAGVEFSTNGGMGTNTSLFMRGANSNQVLIMIDGVRISGVSNGNAQIANILPDQIDHIEVVRGNVSALYGSDAVGGVVQIFTKSGAGQAPAANAQVEYGSNNTRQGTVGYGGQIGATSFNVTGSMYKTDGFSAINAAQWNADNPKSAARGIGPNPANNPYENKSISGQIKHQFTQDWDAGVATYYSNSQLSYDNAYGKPTDDYRMDSKLYTLSAFVNGKVLSDWTTHFKVAQSEDRSEGTINGLFDSLFSTRTRQFNWQNEYALTPDHTLMFGTDWLQQELASSSYNAPSRNVFSVYGGYEGRIGKHQIQLNGRNDHYSDFGDQGSFFAGYGYYLTSAVKLLANVSNAFRAPTFNELYYPYYGQPNLQPERAKSAEVGVQVETASTGLLRVTAFETRYNDLIVSALQPSGLYLAQNVNKAKVQGIEASWRASLWGTDVGASVTFQNPLDETNNTQLLRRARRHASFDVGRNFGNWRFGGEWLVSSARLDSGSRTLGGYGIVNLNARYNIDKQWFVAARVENLFDKNYQLAYPYNTQGRAGFITLGWRQK

SEQ ID NO: 9179 - protein, 1140 aa, Methylobacterium populi
MPMVEAAPTAQQQLLEQVRLGEATHREDLVQQSLYRLELIDPNNPDVVAARFRSLLRQGDIDGAQKQLDRLSQLAPSSNAYKSSRTTMLLSTPDGRQALQQARLQATTGHAEEAVASYNKLFNGAPPEGDIAVEYWSTVAKIPARRGEAINQLKRINADAPGNTGLQNNLALLLFSSDRRDEGFAVLEQMAKSNAGREGASKIWYGQIKDMPVSDASVSALKKYLSIFSDGDSVAAAQSQLAEQQKQLADPAFRARAQGLAAVDSGMAGKAIPELQQAVRANPKDSEALGALGQAYSQKGDRANAVANLEKALALDPHSSNNDKWNSLLKVNRYWLAIQQGDAALKANNPDRAERLFQQARNVDNTDSYAVLGLGDVAMARKDYPAAERYYQQTLRMDSGNTNAVRGLANIYRQQSPEKAEAFIASLSASQRRSIDDIERSLQNDRLAQQAEALENQGKWAQAAALQRQRLALDPGSVWITYRLSQDLWQAGQRSQADTLMRNLAQQKSNDPEQVYAYGLYLSGHDQDRAALAHINSLPRAQWNSNIQELVNRLQSDQVLETANRLRESGKEAEAEAMLRQQPPSTRIDLTLADWAQQRRDYTAARAAYQNVLTREPANADAILGLTEVDIAAGDKAAARSQLAKLPATDNASLNTQRRVALAQAQLGDTAAAQRTFNKLIPQAKSQPPSMESAMVLRDGAKFEAQAGDPTQALETYKDAMVASGVTTTRPQDNDTFTRLTRNDEKDDWLKRGVRSDAADLYRQQDLNVTLEHDYWGSSGTGGYSDLKAHTTMLQVDAPYSDGRMFFRSDFVNMNVGSFSTNADGKWDDNWGTCTLQDCSGNRSQSDSGASVAVGWRNDVWSWDIGTTPMGFNVVDVVGGISYSDDIGPLGYTVNAHRRPISSSLLAFGGQKDSPSNTGKKWGGVRADGVGLSLSYDKGEANGVWASLSGDQLTGKNVEDNWRVRWMTGYYYKVINQNNRRVTIGLNNMIWHYDKDLSGYSLGQGGYYSPQEYLSFAIPVMWRERTENWSWELGASGSWSHSRTKTMPRYPLMNLIPTDWQEEAARQSNDGGSSQGFGYTARALLERRVTSNWFVGTAIDIQQAKDYAPSHFLLYVRYSAAGWQGDMDLPPQPLIPYADW

SEQ ID NO: 9180 - protein, 344 aa, Methylobacterium populi
MPTRQVLFGLALLGAAGTAWADDSRFSVAAGRSAPVASGSGAAVPPAANPVMAAGMGMAVANGSGQGAGRLVAEPGLRGLTLQPTFAYRLNDALSIGIGARLVQGAVIRPGGAPADAPPAYLDSDTGAGLNLGLLYRVSDSTWLGLAYASGYELNLDERAGVADPVANVARGRPETNRTIAEARAPDSVTASISHRLDSGWMLSASLGWMGWSALQRSEGEAPSPAAASVGGAHQYRDTWRLALGAEQQLGEHLHWSMGLSYDSSPLPGDQRNLDDPLPENLRLAAGLSYRMDQGVELQLGYSLIWLGEAESRQNGRTRNDGILSAEPPSSTLHVIGGGMVWRF

SEQ ID NO: 9181 - protein, 440 aa, Methylobacterium populi
MGGIALTTVLLAGVAAPAMAGSFYVQEQSTRGQGRANSGEGADKGVQSLWWNPAAIAGTQRQVYTGMHGLILDSDVNDRGSSLTYNVPTPAIASRTAPVNGDPHVHNVVESGIIPNFAVSMPIGERFNVGMAVQAPFNFTTKYEPTDFARYDALTSELRSANVSLVAAMTVTDWLDIGAGFDAQYAKATLSSALPNVAIPGVFAPTYAVSPSTDGRNQLEGDGWDYGWNAGAQMHFGKLDLGLSYRSKIEHELEGTVNLSGLTGVLAAANVSADGVASFTTPWYATVSARYAVNDRLTLNAQVNQIGWSEFDAIRVTYGTSGSSTIVQDYDDVTSGAIGFDYKIDPTMTVRAGLGYDPTPTPDDHRTARIPDGDRFLYTAGLSKSVGSMTFDGAVTYIDIDTATINDTRDVYGNGLVVSTLRGEAKGHGVGFSMGATWNF

SEQ ID NO: 9182 - protein, 730 aa, Methylobacterium populi
MARSTHTQINTRICRLAVVVATACGGFAASALAADGQKEETITVSAAAAQESAWGPAPTIAAKRSATATKTDTPIEKTPQSVSVVTREEMDTRQPTTVKEALSYSPSVFSTRGSSSTYDVVTIRGFTTSTTVNTNQYLDGMKLQGNNYSEISMDPYFLERVELMRGPTSVLYGNSNPGGIVSMVSKRPTTEPLREVQFKMGSHNLWQTGFDFSDAIDDAGVWSYRLTGLGRSQNAQQEMAKSSRYAIAPSFSWRPDNNTDFTFLSNFQSDPYAGFYGWLPRSGTIVPYYDANGKAHKLPTDFNEGEENNKMSRRQQMVGYSFSHAFDDTFTLRQNLRYTREHTLYRSVYGNAFVAPSTINRAYVRSDEDMNAFSVDTQLQSNFATGAVDHKLLTGVDYSRMRNDINADYGTASPLNMLDPQYGNPDINVNFLYDVINRQEQTGLYVQDQAEWNKWVMTLGGRYDFAKTSTYTRSSGALAEINDQQFTWRGGINYLFDNGVSPYFSYSESFEPVSGSTLGRKPFEPSRGKQYEAGVKYVPKDMPVVLTAAVYQLTKDKNLTADPANNSFSVQGGEIRSRGIELEAKAAVSANVNVTASYSFTDAKYTHDTLFEDKRPAEVPRNMASLWADYTFHDTALSGLTVGAGGRYVGNTVSYYAYGDKQNQPFNVASYTVADAMVKYDLARLGLPGSSVALNVNNLFDREYVSSCYKDYACYWGAERQVTATATFRF

SEQ ID NO: 9183 - protein, 285 aa, Methylobacterium populi
MIASHRLALAATLATGTLLGVLTGSFASPAAAADLLPPPPPPPVQVEPVTIGSGWYLRGDLTQSWYDHPRDDAILDPNDPGMPPLVGLRLSSETGYGGGVGYQINPWLRVDATIDQRAASSFRGYSSRSVFETGYNLEAGKVDVLTGLVNVYADIGTWYGFTPYVGAGVGFADKRMSRNYTQTTCLIDGCDGSAGTGPRNAAFRANHSVMTFAWALTAGLSYDIGAGFSVDAAYRYIDLGRIRSGLDEFGGLTRVKDLTASEFRIGLRYRFADGLLASPVRNFGN

SEQ ID NO: 9184 - protein, 945 aa, Methylobacterium populi
MRRRNTGAIRPQSNRLYVTASAIAITVAMASPGVVWAQATTPPPSDTTVDELVVTGIRAGIQNSINIKKNETSIVEAVSAEDIGKLPDVSIAESIARLPGLAAQRVNGRAQVISIRGLAPDFTTTLLNGRQQASSGDNRAVEFDQYPSELLSSVVIYKTPDAQVSGMGLSGTADLRTVRPLAFGKRAVAVNIRGEKTEGRKLNDDASNWGGRFSASYINQFADGTFGVALGYAHLDSPSQVKHYKAYGYEAFDFAVTPDSADNALMLNGQEVFATSRNNKRDAFIGIFEYQPNDSIHSTLDLYYSKFDQQETTRGAQWFSNGWADNATFTGVTTRDVGGSAMAASGVLHNGVPILRNDYNTRKDELFSAGLNNEFRLGERTKLFADLSYSSNNRREQIMETYAGYGLGVGGVTPATSDVGRTFDTIGFKVADDDFSQYDEGLNYADASKVSLGDRAPWGGWGHDGAIRYPHVKEEVSAIDLRLEHEFDGFITSVDLGANATHREKTKTVSDNDLFLKNGRQQILVDAADLEKPTSLGFAGFGSVLSVDIGDVWQKYYNSAPILDANYFDKNWEITEDVQTFFAKANFRTGDLRGNVGVQVVHQSQESSGVVILGQPVVPTQINAKEDYTDVLPSLNMIYDLGHGQRLRFALSKTMARPRMDEMRANLTPGFNSLVCSGQPCAPGTVVNPWSASGGNPHLRPWEAKAADVAYEWYIGSATYVSVAGFYKKLDTYIYNQTRTFDFTGIPLPSSASAIPPGVIISNIGQITQPANGKGGVVKGLEFSGALDLGKVLEALSGFGVQGSLSLTKSNLNPTPDTTQKVRIAGLSGTVYNLTGYYEKGGFQARISQRYRSGFKGDVVQLFATRGATEILADKQVDAQIGYTFQEGRLEGLGFLLQVNNLTNSPYRTRLGLDGGGTKTASGDSLPETYEEYGRQFLFGVNYRF

SEQ ID NO: 9185 - protein, 592 aa, Methylobacterium populi
MRVRKGPYYADEGDFSSAGALNLDLIDRVNRGLAEMTFGSFGYKRAFVMNSVKLGEGNLLFAGEANIYNGPWSNPDEVRKLNGMVRYSQGTATDGFSATAMAYGNRWNSTDQIPLRAITSGLLGRFDAEDPSDGGRANRFSLSTRVAQTDDLGSWKANAYVIKSGLDLFNNFTYYLSDPTLGDQFHQHDDRVVAGGAVSRTFVGSFAGLPSETTIGLQTRYDDINVALTTTYQRNFLANTRSDKVKETSVAAYIQNTVRWTDWFRTTLGWRGDYYTTTVNSLFDTNNSGKASATMGSPKFSMTFGPFYKTELFVGAGMGMHSNDARGSTIREVPVDRVQDPNAASDPVGASPLLVRTKGAEVGLRTRLIPGLDSTFSLFMLDQASEIVFVGDGGDTEASRASRRYGIEWTNRYKPLKWLTLDTDVAWSHARFVGFNQDQADAYAELAGYPEAQIGNAPGNYVPGAPTLIASAGITIGEATGWFTGLRWRYLGERPLTEDNVFRSPATSVFNGRIGYRFENGWRIQLDAINLFDAKADQITYAYGSLLKTDNLYAMCGSGSPPPSAVCGTGVMDRVLHPIEPLAIRLTLAGRF

SEQ ID NO: 9186 - protein, 407 aa, Methylobacterium populi
MNAGAAAAGCNNEFYSVDYNYGGSQSYGLPGGLLSGEDATFTVAGDFQFFKIEVKGQVLCNSVATCNGYTYTAPATDNYYFLATGQSGPGTGKSGTATYSCTAATTGPGTGGSGSGGGTTTNSGSPTGGGLPAAAQGAGSTVAAGGSATAVGNAINNAITGNGPNLSTRGLFLSSGGTSSPMQAWASLQGRNYSGDVDGRSYEFTLGADFEVGAGTRLGLFLSSGRADLDIAGVDVETDALSFGPYFKTRLSDTYEITGYALFARPDYDIGGTSYEAERRAAGLTANANYMWGNTEIESFLGVSGFSEDHPNAGALSSRTVSALTGSIGTKAIFAQGAPLRPYVSIGADFHRYDDGVNGRKTHNTPRIGTGFTYNTGNGSLSMDLNGGQIFEDTRDVELRMNYNFNF

SEQ ID NO: 9187 - protein, 454 aa, Methylobacterium populi
MCGASIAAICTSTPALAQDVDAAAVLEELAAMRAEMAAMANRIESLESELETAQQVAAQANAAAAAASESAAAASESAAAAGDTQIAFKGAPEIKGESGWSFKPRGRLQYDAGFVSSPDSTGRPDGFGNEVRRARLGVQGDMPGGFGYKFELDFDGTDVAITDGFLSYATGDVEFVIGQHNNFQGLEELTSSLSISHMERAAFTDAFGFERRVGASATYANDAVLVQGGLFTDAVDDLSNKNWGVDGRVVYFPKLGETQLHFGGSVHYTDLESGMTVRYRQRPAVHFTSERFINTGNLGASSEFGFGGEVAIVHGPFHATGEAFWQNVDRPGALTDPTFFGGYVEVGLFLTEGDSRGYKGGKFDRIKPGSPVGEGGAGAVQVNVRYDRLDLNDGGIIGGTQDAFLASLIWSPTDWTRFMLGYAHLKYEDAVHPTAGGDTSYSVDSLGVRAQIDF

SEQ ID NO: 9188 - protein, 1016 aa, Methylobacterium populi
MSPFFHLAVILSLAASLACAQSSVASGELHGTVADPSGALVPAAIITVENSVTGLTRTVPTDEAGEYRVPSLPPGEYKVKIQKRGFRTQVSSDLRITVGQIAVLESKLEPGVDNEIVLVTSQAPMVESERSHQAETLQQEWIQNLPINRRDYLTYTLLAPGVVDATALADNADFRVKQTPHSGLSFYGSNGRGNSVTVDGGEMNDTTGGVRENVSQDAVEEFQINRSNYSAELGGATGGVINIVTRSGTNQFHGGLFGYFRNDALDAGNPFARVLEGNTLTRIKPSSRREQFGANLGGPIRRDRTFFFAAFEGLIRNESSVVSLLTDPSIFGPTPDQEALLRTLPAATAGPLRALLTSPQSTIDLFQRNSGVFPFATHDWKFSVRIDHQLGSKGQLFLRHSYAHLHEQNANLQALVGATRGTEVSLADPTTIAGWTQTLTPRLINDLRAQWNYHNLLTDSVEKYGPEIRIQGYGVFNHDWVLPTRWLERRYDLKDHLTWQRGTHSFKFGAQALIRGIHAENKVFFAGRFTFGDLPGSVLGIPGLPDSFTLNALQTFNLGLAQTFLYGAGNPVIAQTYPYYGFFAQDSWKLRPNLTIDVGVRYELDTHKAPLRTDTNNFAPRIAFAWNPSADKKTTVRGGYGIFYAPIYFQIDYVVQALNVINGNRQIAQVFSTILDTTAANSANVFSTLRAQNVIGVPTPARSITTADLAQFGMNFTHSGPLPPFTLIFENARDFVNPYSQQSSLSVERQFGQNWALSLEYAYVRTLKITRLRDSNLKPAPVDPALGIRVWSDPVRDFVDPLIAQRNIFESSGRAFYSGLIVELRRRLSRSLSLDANYTLSRAVDEVTDYTIDYEPTDQTNMNADRALSSFHEKHKFVAYAMWTAPGNLQFTPIFRANSGRPFNLLVGYDLNGDRHDTTDRPAGAGRNTGIGPDFWSLDLRVGRSFKLRETTALDFTAEAFNLFNHLNYASINNVVGNITGPFNLTGRADRTPSQPLGFTSAFDSRRIQLGARVRF

SEQ ID NO: 9189 - protein, 352 aa, Methylobacterium populi
MVHCQLRAVLAASGASFAQSSVTLYGIADVYLGNTKLTGHDGVSTTTNSLGSGGVSTDRWGFKGSEDLGGGLKANFLLEQGFNIDTGAAKGTGNNAAGLPVAGAQGFARQSYVGFSGGFGEVKLGKMWTAFDDVNGATDAVFDSALSPMYYVFTSTNYNANPGNSVYYTTPTFSGFSGTVSYGLGENKTAAQNAGSNAAFNVQYTGGPVYVALGYQSEKDNGNVSSRDFTRVNASYDLGVVKLMGNLGRTKANDKSTNEWQLGVDYPVGSALTLSASYAASKGGVLTTFAPTAAGTADVKRTGFGIGASYSLSKRTSLYGGYMAAKEEANANFVGTADAETKLFAVGLRHAF

SEQ ID NO: 9190 - protein, 863 aa, Methylobacterium populi
MISTTFIQAQKADLSFSIHLKKANLKEFIFEIEKASGYSFIYGEEIILKHPITLSLRKAPLSLILQKAFAGQNISFKINKNHIILKKYALQSSKKSFTLNGYVLDSISKETLIGANIYDQKNGVGTTTNPFGYFSITLPEGGTKLNFSYIGYAVKQVSLHLWKDTMLTIQLHNDNQLNEVIILSDKPETGIQSSRMGASSIPIPHIKNTPALMSEADVLKSIQLLPGVQNGMNGTSGLYVRGGGPDQNLYLLDGVPLYNVDHTLGLLSVFTPEAVKKVDLYKSSFPARFGGRLSSIVDVRTNDGNMQLYHGSLTIGLLTSHLQFEGPIWKDHTSFIISARRSYIDCFLPLVMPKDERGGYSLYDINAKLNHRFSEQDRLFISFYKGKDHVYYKYKDEDKFKQTHNWGNILLNTRWNHVFTPQLFSNTTLAYNRYVFDIRQEETSSIQQPDGSTIINGSNNLFHSGISDLSISTDFDYHPLPAHNIKFGAKYIYHQFAPEVQTVNQHNSDNGYPQTNDNYSLNNSHIHAHDFSLYAEDDLILNEHWKINAGLHFSFFNVQKQTYLSLQPRLSISFQATSNIILKSSFSQMSQCTQLLSTASLAMPSDLWVPVTRHIRPMKSFQYAVGVYYTGIKNWEFSIEGYYKDMYNVLEYKDGESFLGSSHNWEDKVEMGKGRSFGVEFMAQKTAGLLTGWINYTLSKSDRQFSTDGINNGKRFPYQYDRRHTLNLTLNYQLTRRIDFNMSWTYASGCMATLPTEKTHTELPPTNVPPSWIMDNLNKGDMDHSSSRNNYRLPASHQLNIGFNFHKQTRHGERIWNISILNAYNAMNPNFVYISREAQTGKPILKKMTILPCIPSFSYTYKF

SEQ ID NO: 9191 - protein, 688 aa, Methylobacterium populi
MSPSLSSPLRRSTLTLALASVLIPALAMADDTPVPADPQTPPSSDTRHDATPSSGRHIKDLDKVVVTASPLRDAAGELSRPVEVLAGERLDEVRASSLGETVASLPGVQSSNFGPGVGRPIIRGLDGPRVAVLRDGLSTQDVSTVSQDHSPAIEPFLANQIEVLKGPSTLLYGSGAIGGVVNVVDGRIAETPVDGFSGRAEVRFDGGDKDGNTDMFRVDAGNGSGLSIHADGVYRNQNDYDTPQGRQANSFLDSKVGSIGASLAGDWGFVGLSASRFRDNYGNPGEPGDLSIGERGVSLKLQQDRYDLKGGLTDPWGDGSALRYSFGHTDYAHTEFEGAEVGTVFTKRANEGRVEASFTFGGGWQTAFGLQGSDTTFQAVGEESFVPKTDTRSLGLFGVARNSWDRVTAEVGARVDKVKYSTDIGVDRDFTPTSFSASAGFRFNEQWRLTANLDHAERAPAEEELFANGPHIATLAFEIGDANLKTEKANQAELGLNFQNDWVDAKIAAYYNRYNDFVYIVDTGGQWFNEEDNDFLPIRQWTQADAIFHGFEGEATFHLANNDTGAWDLRVFGDTVQARLKDGGNLPRIAPGRVGAEMRWNADAWRASLGAIRTMKQDKVAVNETATDGYTMVDAHLAYHVDRGANAWEVFLDGNNLTNQDARVHTSFLKDDVMLPGRNASFGVRLFF

SEQ ID NO: 9192 - protein, 706 aa, Methylobacterium populi
MPSRPRPSFVSHLLPGSLALCGLVIACAAQGEERRSLEPMVVTGSYNPSDTFDLPFSVDSIERRQIADGQLGINLSEVLPRVPGLVVQNRQNYAQDLQISSRGYGARSAFGIRGLKLLADGIPASTPDGQGQAATLNLDVAERIEVLRGPASTIYGSNAGGVIQMFSRDGQGAPRVGAETTVGSDGLSRNHLYTEGEGDGVGFLVDASRMDTDGYRDHSAARRDQTFAKLNFRPDADSRLALIYSSLEQNDTEDPLGQTWDAYKHDPRSVTANAELYDTRKSIDHQQAGMNYERYFGEATLQVNAYVGKRSVVQYLSIPRGVVSNSQRGGGVVDFDRDFHGGTVRWLQPVRQAPGELNLTVGLDYDQSRDDRRGYQNFNGDQLGVKGELRRDEVDTATSLDPYLQASWAIDAWTLQAGVRHSTMKMEVDDRYLSNGDASGSRRYRKNTPSFSVMYAFTPDLHGYLSAGKGFETPTQAEMAYAPVAANAPDVFNFGLKPATSSQYEAGLKARLWGNTRVNAAIFQIRTEDEIVVASSLGGRTSYQNAGKTLRRGFELGLESELSEHWNANLAYTRLSATYDSDFEAGGKTIGKGKHLPGVPESSLFGELVWKPAEGISMGWEGMYRSQVYVEDSNSEKAAPSYAVFNWRTRFEQRLGAWAFHQLVRLDNLFDRQYVGSVIVGDGNRRYYEAAPGLSWYAGAGVEYQF

SEQ ID NO: 9193 - protein, 879 aa, Methylobacterium populi
MARSVPPLTTDDGAYGMASRARRFSRGRIGGRMAGIALAGVSIAVVAQAAQAGAMTGAVTGEAKRARGIAAKTILAEAPAEGGPVRLAIPKGALETGLVAFTEQAGVKLVYPTELTARLETQGLDGEFSPIEALARLLEGTGLTYRPAGASTITLVNPRYVQLGAEPAGTVTLDELHVQGQAQGRGTAAGLPPPTGTVGQPPVPYAGGQVGSGTRVGLLGNRSVLKTPFSITGYTEKLIEDQQAVSLADVVLNNSSVRNDAPPYSERDSYFIRGFSVTNLDTAFDGLFYLANPRRSFTEGLERVEILLGPSALLSGGTGRVGGTINLIPKRAYDEPFARLTTTYLSDAQIWTHADLGRRFGAFKEWGVRFNGAYRTGATPLDNNSIEVGVAALGLDYRGDRFRASLDMTHSTQNVTAPTSLFNAVAPGIQIPRAPNNRTNTANPFEYNDSRYGMIAGRAEYDVLPDTTVYIAGGASRYNEDFLTSNYRVTSVTGQATNQLAIQPQEIQGLTGEVGLRTRFSTGFLNHQVNIAAVSANNKNFRSGFVPPVFTPYTINIYNPTYLPTGSVPTIGLPRSAAQPLFAQLTARSVAVADTLSFFGDDRFLLTLGGRYQEIDQQGYATRPGPTQGQVTSNYQEGRFSPAITFVLSPFENLSFYGNYIESLDPVAAAPAVAINANALFPPAVGRQKEIGVKYDFGTIAATAALFEIELPNAFTDPGTRIYSVSGRQRNRGVELNVFGEVVPGLRLLGGVTFIDAELVNTPGGQFNGRAAPGVPDTAFNLYAEYDLPPWLAPGLTLTGRAIYTSSMFYDQANTQSVPDWTRFDAGLRYTTEGVNGKPVVFRAFVQNLLDDSYWASAARGFLAVGAPRTFIVSASVDF

SEQ ID NO: 9194 - protein, 719 aa, Methylobacterium populi
MRADRVLGRFFGAGLASLSTAIATSALAQGAALAPDAALAQDATLAPGATLAQGAADPTQRSIVLPQMVVSGEKIERPLEDTASSVAILPAEDLEDKSGAASVADAIADVPNVLYTGTVGAPIIRGQDTQGPNFGSTAFFGGTIPRATVNLDGHYQNYYEYVFGTTSIWDVESVEVFRGPQTTSQGANAIAGAIIVNTKDPTFEPEASYLAEIGSYSRRRTALALSGPIIADQLAARMAIDYSGRDTFVEYVNSNFDTGDADLDFRSLTARGKLLWEPEALPDLTAKLTYAFGSANRPTWESASRPYDELDNATLSMPSWEQRTHTGIADLSYAFANDITLFNQTQYSDTHVDRVTEPANNGSAVIDQNTVSNELRLTLGDTESTLSGMTGLYLARTRSKDTLHIRGLSRFDDEKQHAGLFSEMAYRLTDRWTLTGGLRYQRDHILRSGTSSYARTALDYDESFDAWLPKVSLAYDVTPEVTVGALVNRGYNPGGVNLSFASSKYVTFEPETVWNYEVFSRAKLLDDRLILTGNLFYSRHSDSQRLLPDYLNGVQYGSVVVNADKAQSYGLELAVDYKMRDDLRVRAGAGLLKTRIGSFSNAEGTSYEGNEFGRAPSYTLSLGMDWDITPKVRLSGEVKHTDGYYSTDENISAYAVENYTVANARIGYAPREYLEVYVFANNIFDKRAPAYLYDDRSAGGIVANMIEPRTVGIGVKGTF

SEQ ID NO: 9195 - protein, 872 aa, Methylobacterium populi
MSPRLNSRSPVPCARLQNCTLSLLTAAILLAGAHAAPVMAADAPASSSQRMGNYNFAIAQQPLVSALNAFTAVTGWQVGLPAELGSGVSSPGVRGSLPPEKALDRLLSGTNLSYRKLGNNNIVLEKRSAANVVNLQQVTISATRQEQDINSVPSTVSVHTREELDRQNVNTIKELVRYEPGVSVGGAGQRAGISGYNIRGIDSDRILTQVDGVEVPDHFFSGPYAKTNRNYVDPEIVKRVEILRGPASVLYGSSAIGGAVSYYTLDADDIIKPGEDFGARLKTGYSSADESWLKSGTFAGRVGEFDGLLHLSQRDGHETESYGSNNGTGLNRTAANPEDARTTNVLAKLGWNYADDARLGLTYEKYKDDRDTNQKSAVGGLFLNGVGQNWYRSRVGNDTITRERFGLENSFALESPIADQIKWSLNYQIAKTDQTTSERYNPVSIFSPVARDVQRERKTLYQEKQWVFDAQLDKAFALGETDHQLTYGTTLKQQKVTGSRYGTASCLAVGAGCTAIGAPSPSAGDSVKKSSDFPDPTINTYSLFVQDQISWNAWTFTPGLRYDYTQLKPKLTQEFLNVANPTGNFPVSDDKKTWHRVSPKFGLTYSFDEHYTAYGQYSEGFRTPSAKALYGRFENITTGYIVEPNSNLKPETSKGYETGLRGNFDAGSFDVSVFYNQYRDFINEDAITAGALQSVIQSNNIKHATIKGAEARGRLNLDAFGAPQGLYSIGSLAYAYGRNNDNGEPINSVNPLKGVFGLGYDQDNYGALLSWTLVKRKDRVDNSTFKAPDGRTTSGQFKTPGYGILDLSGFYKVTDDLTVNAGLYNLTDKKYWNWDDVRGYDSVGEAGQTAPANLDRLTQPGRNFSVNLVWDI

SEQ ID NO: 9196 - protein, 730 aa, Methylobacterium populi
MPSRLFHALRHCSTPAHLVLAGPLFFASACWAETLVDADTQLDAGSTLDSYRVIGPAVLTATGATTLQIAAQAGATVNLSDSQVTAESNGNGLALNGASATVHRSTIRSDARGLALSAAGAGNGSRALINDSVIEGGVQGATLNASSAELQRSELRGTGASSEGARLVAGTLIARDGSTISGGNYGARILEDDGRGSTLVVDNSLIEGRNGPAIAVGRGAGFAASAQIDVINGASLSGGNGMLLHVAEDAAANLRVNNSHLVGDIVAASGGTANVLLENFATLKGRLDNVASLEINSGGEWTLVDNSQVTDLSLDNGAVRFGGPGEFFTLSVENLTGNGTFIMEADFSTSQSDFLDVTGTASGNHQLLISASGNDPLTDNSLHVVHTAAGDSQFSLLGGSVDLGAYSYDLVQRGDNDWYLDATTRTVSPGTQTVMALANVVPTIWYGELGVLRSRMGDVRRNPGKAGGWVRSYGNQFNVSATSGAAYQQQQQGLSIGADAPLAAGDGNWLVGITAGYSNSDLNLARGSSASVDSYHAGAYATWLDPESGYYIDTVARINRFRNQADVRLSDGSKAKGDYSNLGAGVSLEVGRHLNLADDWFLEPFAQLSGLVVQGKDYSLDNGMRANSNSTHSLLGKVGTSVGRTFSAGTGRSVQPYLRVAAVHEFVNDNQVKVNDNRFSSNLAGSRAEIGAGVAVAWGEKWQAHADFDYSHGSKLEQPWGVSVGARYNW

SEQ ID NO: 9197 - protein, 724 aa, Methylobacterium populi
MLKYLLVGILLFASNCVFSQTTYKAKIIDKDSGTPLVGATILVKEISLGAVSDENGIVTIQEIPAGNYTLDIRFLGYETQKVNRTFPLETSDKPEVFYLEHAHEEMEVLVVRSNRSSRVIEDVPTRVEIIAGEELSEKGNMKPGDIRMLLNESTGIQTQQTSATSYNSSIRIQGLDGKYTQLLRDGLPLYAGYSSGLSLMQIAPLDLAQVEVIKGASSTLYGGGAIAGLVNLISKTPEDKPELSIMLNGTSALGLDASAYYAAKKGKIGTTIFTSYNKGTAYDPAEIGLTAIPKFDRFTINPKLFWYMNSQSSLVLGLNLMQEDRLGGNIDFIEGESMINPYFEKNTTDRISTSLNYQNQLSETSQLTVKNSLSFYDRSIEVPDFLFSGKQFSSFSEVNINTQGENSEWIGGLNLWTDQFTQKEGNEALPLDYTLNTYGVFIQNLWNVSEQWTLESGFRLDYQKDYGAFPLPKISAMFKPSDALTFRLGGGLGYKSPTVFTEDAERNQFQNILPIDPKLFEAEKSAGTNLDINYKVAIGDELSLVANTLFFYTRIQNPLLLTPAGSNYEFQQPQGSLETQGVEVNMKWNYKDFKLFVGYTFADVQQQYNDIKSTYPLVAKHRINNVLMYEKHENFWIGLEAYYFSPQQLNDGKSGKSYWIVGLMSEKKFGEKFSIFLNFENFLDTRQTRFDTIYTGSLSNPEFRDIYAPVDGFVINGGIKFRLL

SEQ ID NO: 9198 - protein, 763 aa, Methylobacterium populi
MTGGSNRIKTVVPVLALAGCFLAPADAQNLSSAEVNNNAQEEVKTAPSKKKDKSDVIVVTATGLSQASSTTKTHTPIIESPQSISIVSRDEIELRASPTIADALAYTAGVQAEPSGIDSRVDEVSVRGFGAGGFSSNNNFVDGLRLPSGGQWTRTSFDPFSLQQIEVLKGPSGALYGQTAPGGVVNLVTKRPTKKSQGEFFLQGAGYTHLGNWQGQASGDVSGKLNKDGTLSGRIVGLARYGDTQVNHVQTGRYYVSPSLTWEISPDTKWTVLAQYQRDQGGSTFQFLPATGTLYASKGRHIANDANIGEPKWDNFNRNQVMAGSFFEHHFNHFLTLRNNTRYTYLNTLYRATVLSGDTLQSCSAAIAGCVAGETVNRRAVEGRGRSQGVATDTQLEGHVDTGAVRHVMLFGTDYFYTDWTHDRDLVKSSLVLPMLNIFDPVSRGSAGYGAALSPQVYTSTISQQNGIYFQDQIKFKRLRVTVGGRQDWAKDDTLNRLTGKRYLTHSNAFTWRAGAVYLFDNGLAPYFSYAKSFQPQVSDPSTSLDGTPFKPTTGDQYEAGIRYQYGKSIYITFGAYQITQRNMTTPDPNGALCGTSTCLVQTGEGRVRGLELEGRATLPWNMAIIFTGTRSDAKVTQSNTASQIGNYLPQAPKWMASLFIDQRIRHGFFTGLGIGGGVRYTGHSYGDTNNTLSIPGYTLFDSFLRYDFANRFPRYKGLSLSINMRNIANKRYVATCTAASACYYGQGRSLTLRLGYSWGGTA

SEQ ID NO: 9199 - protein, 508 aa, Methylobacterium populi
MGSIFGQEIRLISLIILFVLSSIAKVSATNIPVEENSKLNKIISVSQLADITHDSWAFQALQALTEQYDCVSQETTDNQTMTRYEFATKLNACILKINNSNFENFNRETLTTIQKLQTEFSAELATFHNRVDLLEQKVATLETQQFSPQVELAGEVIFAVTGVAGGKKANSRTKPINDNFVLSDRLRLSLEASFTGEDKLQIRLQGRNTPELADVTGTKMANLGFDGDDDNEVEVDELDYRFRLGKQTRVTLYALGGGLGDFVPSVNPLFSGSGDGSISTFGRENPIRRQGGGAGIGISHNFNDSLNFSLGYVTNNAANPEKGIFASPYGAIAQFTLEPTKNTALSVTYIHSYNNVNTGTGSELTNNPFNNQADAITANSFGAEASWQINPTITLGGRVGLIHATAEDLPATPNATISTWALLLTLNDIGKENSFAGFVVGQPPKITHNSFGDAFEDQDTSLHLEAFYHLQITDNLAITPGLFLITNPEHNNNNDKIYIGTVRTTFTF

SEQ ID NO: 9200 - protein, 866 aa, Methylobacterium populi
MRSARRRTPARLAPLPAMLAAAGLLQSLGATPAAAACAPTLAPASGQSVQCDGAVVNQSVEAAAGSQNVTITVAPGALFSTNATRALSVDDRSRIVNEGTIQMAGGAGASRGAMVGFGDNNQLINRGSITTSGSGVRGISVPNVGSTGTLVDNSGSIRTQGASAHGIAINGPGNRVQNSGAITVNGTDAKGVYLQGGSPAANVLVNGGTIHARGASSNGIFGPDGVHVNTTNANGFHARVENLPGGRILSDHSYALRGQNGNDTFINAGYLQGHGGAGRDTAVYMGPQGTGTLILRTGSAIAGLADGGGAASHAYLEGSGTVDNRFANFRTLTMRGADWRWTSDAAFTESVDLRTGTFFLAGTLASPANRLAAGAVLAGTGTLAGALRNAGEIRPGPNDGSGYGALTVRGDYTGAGGALRVNTVLAGDGAASDRLVIDGGHAGGSTPVTVVNRGGQGALTAADGILVVQAINGASSDAGAFSLAAPLNAGAYEYRLYRGGATGAAPDSWYLRSRAYLVEDQLAGSLAEAEAIADDIGRRTGERPSIEDTPLYRPEVALYSSIPMLARRMGLAQLGTFHERQGNQALLARDGERVAAWARAYGGNSKQALDGDAQPGIDARLAGVQLGQDLYSSVRPDGGQHRFGLFGGYGQARGDTHGSAGGERDAATGRLTIDGYSVGGYWTYVGPRGWYVDAVLANTWMDIDTDSKAGRDADTRGQAFTASLESGYPLALSERWTLEPQAQLIYQHTRVDGFSDAVSEVRIRDDNALTARLGARLQGEYAAAAQVWRPYAALNFWRTFSGENTVVLGEDSIDTRRGATSLELAAGASVTLARSLALYGRLAYATSIDSQYLRGASAQLGMRYTW

SEQ ID NO: 9201 - protein, 351 aa, Methylobacterium populi
MSRYSARTGNPNLKMEESEHAEIGWDQKIGNFWNIKIEGYQNTFSNLSIADPYAMDPFSRNRDLMRESLDPNADLSLVRRSNLNYSNSMTGYSRGVEVFIKKEASAESGLYGWISYTKSITKRNRNLPELTKQEYSSWLAESSAKDLIHQENTDYYYANFYRDGSYDVLFKNSKEELYDFDRTHMFNMVIGWKFGEKAQIGLRGTYLTNYAYTPVVGSKSITSEQFNSQLLPSAAPPPPSSSSNSSSSLFSIYQPVYSDMLRSARLPHYHQFDLRFDRFIPTSWGRMTAYLELVNITGSRIAVSADTFVPIFPFVPGANPETQYIYLNGLQSLRTEKNKIPYLNFGIEFRF

SEQ ID NO: 9202 - protein, 206 aa, Methylobacterium populi
MPASRIRHSTDGSGMVRHAVVGDRQARPCNRSTRLAEPARPATGEPSRASAAGRARQSSRSLTTEPFQASNTNRHVIGAACAAVLGATATAAAHAQSSVALHGLLDASIAYTNNQSGKHTWRQGRGLPSHTVFGLSGSDGPGARLRVAPRAGRIVDAYASRGDDRHPASVPTVRSDGAPRTPPSVRRANSACRRRGRKRIGGPDRW

SEQ ID NO: 9203 - protein, 785 aa, Methylobacterium populi
MFEDRAVSARPAPRAGQIARLLASTFLSGTALLGLAVPGLAQEAAGAVELSELSVTGEGRGATLGGALYGPGGAQGAVPGYVASRSTVATKTDTPILETAQSISVIGRKQIEDQNALSINQALRYTPSVTTEQRGGAGSTRLEQFLIRGFNAPVFLDGMALIGGRDANATIEPYRLERIDVIKGPASVLYGQSGPGGIVNLVSKVPQFVRHGEVFVQGGGFSEVRGGVDVGGPIQSDVPWLADQFAYRIVGFGWNGDGPVDTTRVERALINPSLSWRPSADTQLTIIGNYQRDPFSGFYGGFPAVGTVFPRNFGNGIIGRLPVNFYDGDRGIERSDRTQASIEYLFDHRFSENLRFHSAGRYLRTQGDYRSVYSAFNPRNGPFASGPLIPRAVIGTNVAAEAYTMDSNFVANFDTGFIAHTALLGVDHRTFSTRTSGSPFPDAPDLNVLAPNYNMNIAVPAFNTVSRVDAQQTGVYFQDQAKFDRLVLTLGGRYDVARQTGPTRSFAAGRPSTLTLQNAPADAFTGRASLLYLFDSGVAPYVSYSQAFEPIVAGRVFDPAFGTVGRVPDPQSSDQYEAGIKYQPPGTDILLTAAFFDIRQSNRTTADPVNGSAFVVQTGQVGVQGMEFEARVNLTEGVTLVGGFSLLDIRNVRDDGRTANDLTPGQTVPLQGRSPVLVPDSTASLLATYRFSEGPLLGLEVGGGVRYLGPSWGDAANTFKVPASVLVDATLNYDLKYLDATLQGFSMQLNANNLLDERYVSGCNGYTSCYYGLPQTVYATLRYRW

SEQ ID NO: 9204 - protein, 1254 aa, Methylobacterium populi
MDTRNFWIRDYLDLAQNKGVFQPGAYGVKTPLKNGGEFSFPEVTIPDFSPVSAKGATTAIGNAYSVTASHNGTIHHAVKTQTWGQSDYHYVDRVTKGDFAVQRLDKFVVETAGATEHADFNLSAAEALERYGIEFNGKKQIIGFRVGSGATGVTSYGVGQTYNPLLRSASMFQLNWNNMLATNNTGGFYNEVTGGDSGSGFYLYDNQRKKWVILGTTYGKAFSSKDTWAFFARYDQNTVDTLKNTFTQEVNLNGQKMTVNNKNITVNGNTTAIELTRNNKNKDLKFHGGGSIELTDNLNSGTGGLIFDEGQHYSVIGKDKTYKGAGVEIGKGTVVDWSVKGAANDNLHKTGAGTLNVNVAQGNNLKTGDGTVFLNAEKAFNAIYVASGRGTVKLGQADALDKNSDYRGIYFTSRGGTLDLNGFSQSFKKIAATDVGTIITNTSDKTATLSLQNPSRYVYHGSITGNTNIEHTGTQKSADSSLIIDGNINTHNDITVRNSQLRLQGHATTHAIFRDGPRHCYVPGVLCDKDFVADFARLESEANKKNNSAYKTNNQVASFDQPDWETRHFRFKTLNLENAEFTTARNSVVEGDIVASNSTLKLGGDVPVFIDMYDGINITGNGFGFRQDVREGRSADDGSSSYTGNITLQKGSTLDINNRFTGGIEAHDSQVNVTSPDALLQNSGVFMNSTLSVRDGGHLTAQKGLYSDGRVQIGKNGTLSLSGTPENGADNTWMPVLTYMTEGYDLTGDNATLDISQQAHVSGDVHATSSSTIRIGSENPGSVSSSVSPVLAAGVFSGYNAAYYGAITGGKGNVSMNNGLWQLTGDSDINSLTTRNSRVQSEEKGAFRTLTVNTLDATGSDFVLRTDLKGADKISITEKASGSDNTLNVSFMKNPSPGQSLNIPLVSAPAGTSGDIFKAGTRVTGFSRVTPTLHVDTTGGSTKWILDGFRTEADKAAAAKADSFMNAGYKNFMTEVNNLNKRMGELRDTNGDAGAWARIMNGAGSADGGYSDNYTHVQVGFDKKHVLDGVDLFTGITMTYTDSSADSDAFSGKTKSVGGGLYASALFNSGAYIDLIGKYIHHNNDYTGNFAGLGTKHYGTHSWYAGAETGYRYHLTEDTFIEPQAELVYGAVSGKTFRWKDGEMDLSMKNKDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAINANFRYMF

SEQ ID NO: 9205 - protein, 839 aa, Methylobacterium populi
MRVLRGSLIASVALLPGHVMAQGAGGGQAVTLEEISVVSNTPVAASRRVVATQTPSGLREVTVLDGIDRNKLPQNTSVLTSGDVSRVGFPSTVRALDERVGSISVNNAQGNPFQPTITYRGFEASPLGGSPQGVAVYLNGARFNTSFGDTVQWDLIPDIAVDRIELEGSNPAFGLNALGGSLAVTLKNGFTYQGSEINVLGGSFGRGAVAFQHGQRIDNIGLYVAGTKLGEDGWRKHSPSRLNQIYADLGVQGEKSEFHFNVIGASNSLTGNGTAPVELLKADRSDVFTYPDQTKNDFLRFQLSGTYDVTPTITVQGNAYYGLFRQRTANGDAADVENCEVDERFVCSEGADDNQFFLRDRTGSPVRTDRLRTFNFGGINPTFADRFDEGGPYAFLNQTRTSTDNFGATVQTVIRETLFGLPNRFVLGGQYDGGRTRFGADNSIGGLTLDRGFSPPGIVVSSDDGIITPVSVHTSNDYGGIYFSNNTDLTDRLTLTLQGRFNMAKIVLRDQIGTALNGDHYYQRFNPGVGATYKVIPDYLVAYGGYTEANRAPTPAELSCADPLAPCSLTNFFVGDPPLKQVVARTVEAGVRGRIPQPDEYFGGILSWKAGFFSTRNDDDILFVPAPDTIGRAFFRNVGSTKRQGVEASLFYNAPRWNAFIDYAFVDATFESPVELAAPGNPFNSAGGDESGVVLVRPGNRLPGVAPHQLKVGVQYQVTPEWRVGALARFATGKFLVGDPTNQNKTTGDFAVVGLNTSYRVASNIELYGYIENAFNANYATFGTFSPVNEVPIVRVPNATSNRSLAPGAPVAAFGGLRILFEPPPAAPVVEPFPLVRKG

SEQ ID NO: 9206 - protein, 776 aa, Methylobacterium populi
MTSPALALLFALPLLAQSDLGELRLTVRDPSGAPLAAHAELASTATGTRVAIDLAADGRYSFRALPSGIYRLRITHSNFAPVTELITLRPAIPQAHEVTLSLAAVDTSVLVTESATLVDPTATSTTYHVSSEELKQRVESLPGRGLTDLVVMQPGWTIEANGILHPRESEYDTQYVVNGFPVYDNRSPAFAPAADVDDVESLKIYAGGIPAEFGQKLGGVIEVNTVRNTNPGFHGALVLQHGSFATDSAFASAQWVAGRTTASVNGEGFLTDHYLDPPVTANFTNHGSNSSVGATVEHDFDDSNRLRLSVDRRETGFLVPNDYLQQAAGQRQDRTAAATEGQAYAQHIFSPTLIGTFGVMARDLTARLWSNPLATPIAAGQDRGFREAYVKASLAGHHGRHEWKTGIDARFAEIREEFDYQIVAYRLNPGNVRIFSRNTPASYTFNGTSPDREQAAYAQDTVRLGAVTVSAGLRFDHYALLIHDSAVSPRLAASWNVRPLGVVLHASFDRIFGTPPFENLLVSSAPSSRLGIGFYLPVKAAHGNYYEGGFTRALGGQLRLDATYFRRDVSDFKDDDPLLNTAVSFPIAFQHAEIRGIEVKLALPRWHGLSGFASYANTIGTGQYPISGGLFLDSDDAALLKSTDRFPISQDQRNTARALLRYQFLPRLWTAWSANYNSGLPSEDISNLPPMSFLNAQYGSEIVAKVNFDRARVRPSFTLNASVGADLWRHEKRSVTFQLDVTNVTNRLNLINFTSFLSGTALAPPRGASARIRWDW

SEQ ID NO: 9207 - protein, 973 aa, Methylobacterium populi
MFDSHRPGRVLRPSRLCIALLAVGLACAAPSSVLAQSAASGHAALQRFDIPAQPLDEALRSYMRQSGVQVVYPATLAQGVSSHAVSGNLSSDEALARLLQGSGLAVRRVGTDAVTLESATPVQADSGVIVTDTLSVAGDRVDSGATSDEARLLDGYRSVGSTTTLNRTHLERFRGTSNGDIVKGVAGVTAGDPRVGNGFDVNIRGIQGQGRVPVIIDGGQSSMDTYRGYAGQSQRTYLDPDLISSLTITKGPSLQANASGGIGGVVEMETLKIGDVLREGRDFGVRVRGGLANNSANNLPSYSAAPRNDRSATGSQFFNVAAAGHWDRFDLVAAYAYRDNGNYFSGKHGYDDFPQTRRTLAPLNPPRTEVFNTSARSKSALLKGTWRIDDAQMLEAGYRRYEGTAGEIMASQIIRVDRDRIPQWDPGHVDMDSYTLRYRFNPDSELVDLRVNAAYTDTDSVMYNSLTGITPWYFDRRTEWYDAPSFSGDPGYKDAYRNPLRQKRFGLDASNTSKFDTRAGAFTLDYGLSYSDEDIAPGSSGPVMHDDLINNRFLRNAERKEYSAVASLKWQPDEHWELLAGGRWNRVDVHDRNRLATPDAYEVQGQYRYTELLNGNPALPSWRAKRIALLNWYPDANGNFTQESLLASPYKKGTVGDIGGWNFYDAGKAQDLEVPVSWTWSQPIRRRDTAFSPTASVAYRFSEDTMVYVKYAEGTKLPSLFETTLGLFTAAKPVGELKPERARSWEIGASTIRYDLFTAGDRLALKLAYFDTRIDDLITRDYRTLSAGLIRNVDQFKVSGMEFQSSYDSGKVFADLSAHYYFKAKTCAPDIAAERRAYGAQRRNDELANTPNCVDGGFEGSYTNTQNPPRYMVNLTLGSRLFDERLTFGTRVVHNAGPISKLDKDWNVGLSAIQQLYRPTTLVDLFASWSFNDQLSVEAGVDNVTDRYYLDPLALGVMPAPGRTARLALTWRY

SEQ ID NO: 9208 - protein, 455 aa, Methylobacterium populi
MPGYGTVLPNPNGDLSKNLFTGDQNWNKFEKEVGLYGVKLNHEFSNDWTLLVNTRYMDGSALQHNTYGTGLAADGRTLSRNAYLTDEKSKGWVSDAQVNGNFNTGNLMHNLLIGLDYQQLDSKVDYFDVATSTIDIYNPNNNQLSEEEIKKQMASATNYGNQVDSKQLGLYLQDQMRLNRLVMIAGVRFDNYKSDTTANSTGATTTLDQNNTSYRVGALYEFDNGISPYINYADSFEPVAGTDKDGNAFKPSTGHQWEAGVKYNSADMAKMLNIAAFHITKKGALVKDPNGSLPQHQIQVGESVSKGVEVESKWYATDRLDLAVNYTYQNVEITEDTDPTQIGKKPVWVPDQMANLWANYNFYGTALDGAILGGGVRYIGETQLDAANSGTIPGYTVVDLSLGYDLGILGSSMKGSSASVAVTNLFNNETYTCYDSLNCWANDERRIVARLKFGF

SEQ ID NO: 9209 - protein, 719 aa, Methylobacterium populi
MSRKRYGLGPWFGSFAGIGIAGLVVSPLQAEEVALDEISVVSDKPARSAGPGAAGPAPKPADPVGVLPVVTDRFSTVTVVSGAELARSQPTSLGEALFDKPGLSATTFAPGSASRPIIRGLDNHRVRILENGTGVQDMSDLGEDHAVPINPLINDRIEVIRGPAGLRYGSQAVGGVVSVENNRIPTSIPPGGVAGRVTTGYSAVDNGRNAAATVDAGSGNVAVHADAFRSAADDYNTPLGIQRNSFNESQGGAFGTSYLFDRGFVGLSFSHFDSVYGIPGISSAAQRTRLDPVQDKLQARGEYRPLDGPFAAIRFWAGGSNYRHNEFGTDANGVQGIEAVFKNRAAEGRIEFDHVPVETAFGTFSGQLGFQADRRKLRISGAEGGLLRPTDTRVQAAYLFEELALGGGLRFQAAGRIEGNRVAGTQALFPSNFLPDGPGDEPVESRRIRRFAPKSASLSALQDLPHGFVGSLTGSYVERAPTSPELFSRGPHEASATFEIGDPNLKPERARTVEVAIRRAEGPFRLDATGYVTRYTGFVYKRLTGFTCGDTFDSCGIGGGDLRQVAYSQAGATFAGAEIASQIDLVPVGDGFAGISAQYDFVRAQFDDGRFVPRIPPHRVGGGVFLRADGWFAQLSLLHAFAQTQTGTLETPTPGYNDLKAEIAYSRPLDPAIHGLSEVTLGLRGTNLLDDVIRNAASFRKDEVVLPGRNVRLFLTARF

SEQ ID NO: 9210 - protein, 698 aa, Methylobacterium populi
MGTCVAQADEPAKQAAPAKRSKPHVVQGGDQAGKSKPATTSSNVPARTSSPAVSTQTAELPELISVSAARRPTSVDDIGTSMTIVTEQQIQTQQRRGLADILERQPGLNVVQTGGPGGTTSIFMRGNNANEVKVRLDGMDVNDGSSAQGMFDAAQFMTDGMGRIEILRGPQSGLYGADAMAGVIDITTAQGEGRFKPFVRIEGGGYGTFNQVFGARGSKGRFHYNVEFSHYRMDGFNNIPSYIERAYNADWRQRHEGNRNDNRSANIRLGYDVARNFDLGLTTRLIQGNNHSYSLYDLQNEYFGYSGVREQNNTNEAIVRGTAHHVSFNGLFDQVIGLGYMTNRNRWTETGTSYGSPINPDPDYYRSDRLKIDWHGTFNFRQYGQFMVGAEHFHETFNTSQAGGISGPGYDTSAGMDTTAGYGQYQGNWNHILYGAANIRYDANSRYGNHVTWRVAPAIHVPGTGTIIKASAGSGFHGPSLYQLFANQGGYGYSEKGNPNLKAEQLIGYDAGVEQKLLHDSLNFGATWYDNRVRNLIQSTLSIDSSYNYNYSYANVDRARMYGVEAFLNWKARRDLQFNLSYTWTHARNETDDTELQRRPQHKFNFNTTWTPIQDLTFSGNILYTSAWRDLPVIGSESCSVCAKGHGYFTIDIAANYKINRYVSVYARADNLLNRQYEDPIGYLQPGRAGYGGFTLNY

SEQ ID NO: 9211 - protein, 486 aa, Methylobacterium populi
MLERMTQTRARRRRGVRIGTAGALLAASLTTATGVSAQQPSPVGQFNDQTQPRTDPRIAEKPSDPVRVGPLAPWATHMAERGLTFDINIYNFYQANPSAGLRTGEQSNSTYFVLSMTADMQRIANISGGTIKFTQTFFGNVRNLNMAADIGDTTVGYQPPFNPNNNRLSLLTYQQKLLDDRLVIEVGRTHPDRYYGLPPCNSINSCFQDLFYINAGFTSPLYAVWGANAAYQLSPTSYVQAGAFSVNPGTNALSGYDFGYERLSGALVMTEIGTKTDYTMTAYPGRASLTGFFNTADHDDNFKTVFGTSKGLNPGAPVLQKSGTSGIVLTGTQTVWRADGGLVANPHPTSISLYTGTGYSFDPTVPIRFNSFVGVRLDAPDQSRPNDSYGLKMNWQRLSENYTQFLSDANFISGGSGAPYSRDKFVFEANAHFDVGAGVIIEPVVQYVVNPNSFWNPFTARRAKDGFYAGATLVVPLGTLLGLAPG

SEQ ID NO: 9212 - protein, 437 aa, Opitutus terrae
MQQYKLINPDRDVPSVKKELSLIALSLFSALPAVASQQSDSQGFIDDSHLDLFFRNAYISRDYHQGQQDKAEWGQGLIATFESGYTQGRVGFGVDGIAQYGVRLDGGRGKSGAGGIDFFRQEDDGRAKSDLAKFGATAKMRFSNTVLSYGNQRPALPIVTADSSRLLFESYTGTMLTSKEIDGLEVNAGYFTDQQRKSDDRHDSGLKSLTFGGASYQFNDQFSGALYASHNEEVMNKQYLGMNFKQPFSTGQQLILDFNGYNSRLDQRYADSLDTGRSNTIWSLAASYIWDVHTFKVAYQQSSGSTGYNYGGYRDRGGVGDGGNTIWLANSYWSDFNGEDERSWQASYGLDFAGLGLPGLSWTTAYVRGDNIKTSETSNGKEHEWFNQVQYQVQDGPAKDLTLKLRYSVLRVSSNASDYNVGGDEIRAYVEYPFKVF

SEQ ID NO: 9213 - protein, 282 aa, Opitutus terrae
MRTFLLASAGAVALAGSAFAADLPSRAPPPAYVPPAPIFTWTGVYIGGQIGYAWTNPNVTYGDAGYTVGGFPLGYADSYNVGGNANGVIGGAHVGYNLQLGQWVLGLEGDVDGSSISKTVSVSPYSSYYADYIPTTFHSNLGIQGSIRGRVGIAWDRALLYATGGVAFGGFTSYVSTSYANPQGILSNFPFSGNDSFSQTRVGWTVGGGLEYAITNNWSVRGEYRYTDFGHTSNYLVNAFPVYPGDVSVGAWVHRHLTENRVQVGFSYKFDTFQPAPVVAKY

SEQ ID NO: 9214 - protein, 160 aa, Opitutus terrae
MSANVNGYAVANIGYGNVDTQIDSEADVSYSAALGYRFHRQWYVEGGYISLIDADTDEQSLSSKGPYLALLGKASSPKGELYYKLGVASVDIEQVSINSSACGTEALACGYDDTIVAGLAGLGFDYYVGMKSMVRVEYTYFGGKDDFSAHIVNLGFRYNF

SEQ ID NO: 9215 - protein, 205 aa, Opitutus terrae
MQKLFLAVGVSSLALASFCSAQAADPVRRAHHGGRGVVPTIATNRYVPIRHDFNGPYAGLSALYNGSFGEEAHHNAGGSIFAGYNVEDSCIMYGVEGDVRYTVPVLADNIHSLHGIGGSLRIRGGYEVSDSLLLYATVGPDVAQKYETGKAGEITPIAIGGTAGVGVEVGGLSESLVARLEYRASKYSKVEGFYNTISLGVGMKF

SEQ ID NO: 9216 - protein, 355 aa, Opitutus terrae
MNTHSRTTLAAAAALLAAAGTLPGAAHAQSAVTLYGRVVAGVEYIDKIADPATGQAHSLTRAADNQWGTSMIGLRGKEDLGGGLSAVFNLEGGFSATKGTTGTAFFNRRSLVGLSSASWGTLMVGKNLFNSNDVWNIDPTGQQFMSSATLVRGRNWPGVNNLIEYTTPNFGGFTANVQVGLGEQTGSNKQLRNEGLSLAYAANDLEVRAMFNSRRDANGNYSDAYNYSRDAILGGTYRIGAAKLFAAYEAISAPDAVAGAPSKLKHGWLGVRYDVTPALTLIGAGYRVSANRGNGNATLLMVGADYYLSKRTFLYASLGGVNNSSTANYAADVTVNGPGAGASQRAVYFGMGHSF

SEQ ID NO: 9217 - protein, 367 aa, Opitutus terrae
MNTTVSRALRTGREASPKATFKATVIGALLAIASTSSFAQSSVQLYGQVDEWVGVTKFPGSQAAWNVSGGGMSTSYWGIKGAEDLGNGYKAIFTLEDFFRAQNGKYGRFDGDTFFGRNAYVGIESPYGTVTAGRLTTQLFVSTILFNPFIDSYVFSPMVYHVFLGLGTFPTYTTDMGVVGDSGWNNAIQYSTPDFSGLSGSAMYALGNSADHNGSKKYSAQFLYFHGPFAATGVFQYVNFNNSPTDLGSLVAGLKSQSVGQVGVSYDLKYVKFYGQYMYTKNDQDVSSWHVNTAQGGVSVPLGTGTVMASYAYSRDSGGLDQMHQSAAIGYDYPLSKRTDVYAAYLYDKYTSLASGYTAGVGLRAKF

SEQ ID NO: 9218 - protein, 943 aa, Opitutus terrae
MKPNVPSALRREPALIAWFLGSTALSRVTSDTITSLSLVSALTAVIPGHAAAQTHDIDRAAAYYLASEVGLSVRPVFVGGTLRTDLTKGVYGQNFTLDGSPTNTIDQFGKDSTFTGVFSDGTAGIAGNLVFTNSGSDGSIPNSNIIGLLEEVGQNYALNGSPTNAIDQLIRVAAFTNLSGGTAGITGNLTPSNSSNSGSVTLTGTNIYTGMTTIMPGAHLIIGSGGSITHSNIIANSGFLEVAPQGAVAVSGISSNRFGLILNEGSWTGNVANSIALAINTGTWNGNVANYIGVAGNAGTWNGNVTNYTGLAINAGAWNGNVANYTGLAINVRTWNGNVANYAGQVTNLGTWNGTATNYAGQVINSGNWNGTAANYTGQTTNLGTWNGNVSNYAGQTTNLGTWNGNISNYAGETINVRNWNGSLLSNTGGILNNGTWNSPFLTNDRGSVTTTGTVNVASTLTNGGTFYAKGTVNASLIENTGSFNVIGPLTGTIGTFNNAGTLNLANGNVTDVFRVGAYQGQGGRLIVDVNLLNNTNAVRGDVLQADTTSGTTYVSIDNVAHGRSYFATPIPIIQSSGGGTTFDLVDTPSAGLVDYNLAEVSRHNWSLVSSINPRSSSFSASTVASALALNTGFFQNASSFVSLPESPEPNKWAGGPWIRIADGRNDVNAIGTTPNGNGGARSAPSLVRTRFNGFQTGVDLGYYNIENSGFSAVLGMTAGRATLNSSELSGYNSTNAIQVPFIGIYGLFAGHGFFADFQVREDFYQMNLSYPEAYVHGNSLTGTSLGANGSIGYHWNITKDFFVEPTAALIYSDLHVNGLQVGIDPANDVYGTVTFQPIESLLGRFGGRIGANYVLEDIDLVMQPFLIANVWREFAGDAKSTFNANGSAVPISLTRVGTFGQVGLGFSSSVLNTGLVGFFHGDYRLGDQFRGYALNAGLRYQF

SEQ ID NO: 9219 - protein, 723 aa, Opitutus terrae
MPACFRPCALATAIGTTLALFNAAHAAERIPSVTPSQLPTVQVTADLDGSTESSRSYTTDSMGTATGLSLTSRQTPQSVSVVTRQQIEDRGLLSTADALSTAPGISVTRSDANRYSFSARGFDIDNYQFDGVVMPVLSPWNFGENNLDMVVYDRIEIVRGANGLMTGAGNPSAAVNYVRKRPLREFAASGGISLGSWDARRAWVDVSSPLSREGRVRGRVVAAQAEGDSYTAGLDSTAKTLYGVVSVDLGEDTGLIAGISYQGNDNRGFGSGFALFNADGTRTRFDRSVSATAPWARMTTDTRNGFFDFNHRFGNDWQARVSYSRSHTDMEMKHLYRGGYPDPATGAMPNGNSFTRYDGPVRREAISASLSGPFQLFGRQHTASIGWSRSRDEIALGQYRALAPLPPLASYLDWHGPGTPEPIWASSKTQADDLDNQQSGAYAVARLSLADSLHVIVGGRLSNWETDQVYFGAKRKYRYRNEFVPYAGVVWDINNYSSVYASYTGIFKPQNNRNESGQILDPVRGRSYELGLKGSWLQERLNASAALFRTQQDNLAEATGGLVEGSTQAAYRAVKGATVDGLELELAGEPLPGWSLGTSFTTFIAQDAQGRAINTAKPRSLFKLFTTWRLPGAWDQLTIGGGVDWQNRMYQTATAPGNRRVPVEQPSYALVNLMARYQFSSNVSAAVNINNLFDRHYYSQIGFYNQGWYGAPRNVMLTLKVGY

SEQ ID NO: 9220 - protein, 356 aa, Opitutus terrae
MKTSLTSEEIKTTFCTVSSSILLCSSMEAQAGPVADEATPWYRQDIPVMTLPATVVTPGPQRLSPQPDLRGTNLITEDLAPSAWEQLYGPTSRQAQTDVLSPGFATPGTGDFKGPAVLTLKSSSGHTQQVGLIGGVNQIKGNGNGLITSRALADPTTDTLNLQGQSLGAYYSLIGPQGWHVDLSASGGRVSGFSRNEQGARLATEGSAMTLSVEGGFPIGLGENWVVEPQAQLINQRITLDTPYAGSGNASSSDITSWSGRVGARLKGSYDLNGLPVEPYVRTNLWHTVYTGDTVTLDQVDKISSSRKSSTVEVGLGLVARMTPTVSLYVSADYSSDVDDNDLNGLIGSLGVRMRW

SEQ ID NO: 9221 - protein, 759 aa, Opitutus terrae
MTPNSLFRTSLALPVLLLPHSLFAGEVINDGSIVVGSPTVVDQVTIADGTTLEVQAGASIEVGTAHAVTHVIDWTTITVINAGSISTTDNLYDAINNLEATLHLENSGIIYGMEDAVDTGDASYIENSGTLHGGDEGILARGRIEELINSGTILAERDDGVQAEEIGSFTNSGTITSLTDDGILLLDSAGVDSFINSGSISAYDRGLFARHLGYFYNSGDISAGREAVQIEGDGQTVINHGSLNSEFDNGVDIWSLDSFINTGTITTGGYGLLLDGEDGSGYGRSVYNSGTITSEGTGIRATHVERLVNTGTIFSESSAIELDHGTIINSGSLTGDWEAAVRFSQDEATGAATLINSGLIRNVYSPANAAILFEAGGPGHLVLAPGSVIIGTIDMAGTEDTLTVENGLSIANTFIGTPEAVEANGAAYAVSGNQVAVADTSGLAAVDNAFVDLTNSIAEGVNTRLSGLTRQRAGSGVPAAEAPEQSRGLWFSGFGGGSRWKGTGATTENTHGYGGILVGLDGQFRETQYLGAFVGTSIGRTLVSHDSQETEITSVFGGIYGQQQFDNHALSFILSGGYSEYDSDRSVANNTVATGTETASADYGSWFILPELTYATELSILQHTLLPSVSLRYAGGTIHGFTESGSDGNLSVDDRDIHEFTGRIRLAVRAFESAPLFVEGFVALEGRLSRGDNTLNGALLGQDIGFDLDGRDEALRGYIGLNAGGEISTRTNWFARAEAATGSDVDVHGEGQAGLSIRF

SEQ ID NO: 9222 - protein, 693 aa, Opitutus terrae
MPMDCYVKRISTFVGAICGVLTANSWASAESGRVPLPVQASVSSIFDWTGFYVGTHFGYAAGASNWSATQADGSAPRLMGRLDFYPQYDAFKGTGSFSSGLQAGYNYQAASRLLLGVEADISFPNSVSATQTFSTTLGDQASYGETVLHAGSVRGRVGYAFDNWLVYGTGGFGWSFDQFTRTQLMGSPMGGSAVPGTLEKHSLWRLGWVAGAGVELPVAPSWTAKLEYLLSEFGGQSISFPAGAQKFEGDYASHSIRLGLNYQLRDPGKKDVASANGISALETENFSLHGQTTFVGQYAAPFRAPYRGPNSLAPNSARETLDITFYAGMRLWEGAELWINPEIDQGFGLSNTLGVAGFPSGEAYKVGAEYPYTRLQRMFVRQTIDLGGEKQKVESNFNQFAGSQTADRLVITIGKFGVGDVFDTNKYAHDPRTDFLNWSIIDSGAFDYAADAWGYTYGAAAEWYRGAWTLRAGLFDLSKVPNSTELDPRFSQFQALAEIEHRHELWGQPGKIAVTGFLSRGRMGSFDDAVRLAQVTNQPADVAAVRRYRSRSGISMNLEQQLMPNVGLFARAGIADGKVEPYEFADIDKTVAAGLSVSGDLWGRAGDTAGIAGVLNSISKSHQSYFNAGGLGILIGDGQLPNPGLEKIIEAYYSLAVTPASRLTFDYQLIANPAYNRDRGPVSVFGTRLHAQF

SEQ ID NO: 9223 - protein, 853 aa, Opitutus terrae
MALALYATIACSSGNAIAQEGGPRLLEEVVVFAQKREQSILDVPVSVSSYGEEALDRAQLRDLSELQQVAPSLVFNSSTGATQSILTIRGIGTAGQNSGLEQSVGVFIDNVYRGRPGAALGDFVDLESIEVLRGPQGTLFGRNTSAGVINVRSKAPEHEFGGNLQAGIGDYGYTQLRGSLTGPITDNLAWRIAGTWQQRDGYIEDTFSGEEWNDRDRYSARGQLLWDVNDTSSLRVIVDYTETDERCCVPVQVFDASSAALLIGSPVGLGALNPAFANFAIGAPLQDGTPGTTPGDQEVVFSGTYPDIDNFEGSRTTSASADDSFEDGGISAEFKTSVTDDIDMTVIGAYRFFETNPYGDIDMRTADIWQGGRGQDIDETSLELRFDGTTGNADWSVGAYYFDQDIDATGRFAWGADASTYLASVGIARLAGDADIIAEGGSIADILGSGLIDIGNAAPGGAANPLNWLPTAGLEGTGSQETVGYNATSYALFGQVTFNLSDRLSWTIGGRYSDEEKDATYLTTANDPFSNRDLRQTALTGTDGLFWALRPLQVHNGSLPGAASFEDDDFSATTNLNYEVNESVSVYARFAQGYKAGGLNLNGTIGQQPGNPTPTYIGNDFESETSDSFEVGAKSFLLDNTLQLNATVFYQTTENFQTNSFDGAGFTLRNAGEIEGTGIELDYTWMPNDNWTVSGGLVLQDIEYGDFTNASSTIAQQEFAGLRARALGIVPDQDLTGETPNFVSDVTWAGSVAYRKPISAGLAFNGAVSWRYRSEFTTGQDNDPLTAQDAFTTVNATIGIGDLDDQWRLEFWGKNLTDETVINIGFDTPAQTGSMSAFVEPPRMYGATLNYSF

SEQ ID NO: 9224 - protein, 365 aa, Opitutus terrae
MTSAIHHALRGPAARATVPCLCAAALAGAASLATAQGSVTLYGRIVSGVDYMNRIAEGPGRSSDQLRHAGQWGATWWGLRGAEDLGGGLSAVFHLESQFSADDGTVGDSFFNRYAVVGLRSQTYGTLLLGRAMGIPDGEVWALDPMGLQAMGAGTLQGNRTWGSRPNAISYQSPAWGGLSFRTQLGLNGEAGRSRAGRQAAASVGYEQGPLVLKAFYEEIRDGNGAFASLYKASRLYTVGATYRVGGLKLFTGYSQIRSGALTVADADNPAGARSQQTYWMGANYQATPALVLAGGAYRANRSGGGASLVSLGANYHLSRRTMLYGTVGAVSNGGGASFSVEANSARPAPGSGQQGVYTGIVHSF

SEQ ID NO: 9225 - protein, 849 aa, Opitutus terrae
MKPGKILFLLLLTGSVWSLINHPANSQEAPSPTPLNTQSPVPNAQELTQVTGVRVVPTAQGLEVILDSTAAEKLQVSTQNQGNSLIADITNAQLNLSGENTFSQNNPVTGVTTVTVVNQNDNTIRVTVTGEKSLPKFELFDSDTGLILAFTATEVAQDSPAEADEPIELVVTATRTETPIQNVPRSITVIDREQIAAQASTSRNLIEILGKTVPGLAPPAQGASNFGLTLRGRNPQVLIDGVPQSTTRNASRDLRTIDSAAIERIEVVRGPSAIYGDGATGGVINIITRRPTEEKLTSRTEVGVSAALGNLSGDSFSTNLQHFISAKQDNFDFTFNFAVAKTGGFFDAQGDRIPSDPNAQGGFSDASSINLFGKFGVDIDTNQRLQLTFNRFDEKQDTDIASDPSVNTIPGRQKARALEGLSLDERPGNENTFINLQYTHDDLFNSKLQAQLYYRDYLTRFFPFDGRSFASLGNEIFQSRVESEKYGGRLQIETPLFNQGAAKLLWGVDYSHEDTSQPVSVFDQTAFVASGGLAFRKTGDRSWTPPLELRSLGLFAQLNWEISDRFVFNGGVRYENADVSVNDFRTLANPNVTIGGGDLNFNATLFNLGAVYALNPQLSVFANYAQGFSLSDIGLALRNAPPGFSVESLNPEPQKVDNYEIGIRGQWDTIQASLSAFYNESDLGTTFTAPGTVIRAPERIYGLEAAIDAQPSSTWQVGGTFTLIGGEIDSNNDGDYESLDGFRIPPLKLTAYVENETLPGWRNRLQALYSGNREVFGNNNTAFGRRPVESYFTVDYISSIKLGAGTLQLGLENLFNSQYFPVASQLQANDSAYAAARGRTLSIKYSFDW

SEQ ID NO: 9226 - protein, 267 aa, Opitutus terrae
MNRTLSSLALAGGLLAGGQAIAGDLMQWQNNSLTYLYGQDFKIDPEIQQTITFEHASGWSFGDLFLAVEVIKYNTEATNGAGDGHTFYGEFSPRFSLGKITGADFSFGPIKDVLIATTYGFGEDDVESYLIGPAVDLDIPGFDYFQLNTYLRTTDGSRPGSNVWQITPVWSYTIPVGESDILIDGFMDWVVDNDSNRRGDYHANLHFNPQIKYDLGKALKWGEKQLYVGIEYDYWKNKYGIKDGGDVSQFVGPTDQNTASLLVKAHF

SEQ ID NO: 9227 - protein, 929 aa, Opitutus terrae
MSQVSKGRVRALKLGASSGAMLMALAVAGAAAAQTAPAPADDTAVEEVVVTGFRASLDQALNVKRTAVGSVDVIVAEDIAKFPDQNLAESLQRIPGISIVRDGGEGRAITVRGLGSRFTRVRVNGMEAVATTSDGASANRERGFDFNVFASELFSSLVVHKTAEASLDEGSLGAVVDLNTGNPLAGKDGVTLALSAQGQYNDLSKELGPRLAGLLSYRHPSGLWAASVSGAYSKQEQIEATNNTVRWSQARFNRVGTTNCFTTQNSGGSYVPSVGCNEAALAFHPRIPRYGEVTHNRERIGLTGSFQYAPTEKTKLSVDGLYSKYKAVRNEKWAEVLFRSNERSINVRDYTIDENNNLIKGTFDNAWVRLEHYERELDTTFYQLSANLTHEFSDKFKVQGLAGFSKSDADIPYETTIIFDDRDATGYSYDYTDMKKPKLAFGTSISDPTNFQFAEFRDRPSNNTNKFKTVGFNADWAITDELTWKAGAVFRQFDLNLREGARDSTYCAAFTCAAGTYGAPVTSALTTNFTLTGADAPAGTTISWAAPNLDAATALINLYNRPLIAQAGNTRSVTEKDTGAFLQFDVKSQIGGLDYALNAGTRYVKTEQSSTGINSGQTVTVERTYEDWLPAANLALYPTEKIIIRGSAAKVMTRPNLSSLTPGGSVDGFNYRITTGNPQLKPYRATAYDASVEWYFARESIFSIAVFKKDIASFPLSSSVQGTYASTGLPTSLILASSPAAADPEGRPWTIGTTIDGQGASLKGVEFAIQGPFSFLPGFWSNFGGIANLTLVDSNVDYSVNGAATSATGTFPTLVKRAETATLFDLSKRAFNVTLYYEADKFSARASAAYRSGFVDATSDTGNVFEGYNSSVNVDASMRYRLTDQFEVSLEGTNLTDEYRDRFTDLEADRNYEYNHFGRTVMFGVRYKM

SEQ ID NO: 9228 - protein, 771 aa, Opitutus terrae
MNDRPHIGQRYIRLFGLTVSLVALALGQQAQAQKVTQPAADQAVNAADADEILVTAQRRTQNILDVPIAITAFSGNQLNELGVRDARQLGAITPGLMVKPSLSDQNLVFTIRGVGINSFFAANNPSTSVYVNQVPLSFSPMLAFQMFDIERIEVLKGPQGTLYGRNTTSGAVNFITRKPSADWNGFLQGDYGRYDDLRLEGAVGGPVAPGLNFRLAATTRQRGTGWQFNRVTGKHIGEQHYTAGRFQLGWEPSDNLNILLEAHGGRTRGDSLEYEHVGVRQPAARTATCAPFLAGHRAEGQCVALSGYFDPDNDPYAGDYNDPNSIHTDTYGASATVEWNLPTMTLTAIGGHEYFKRRLEFDGDGSPFAASGNRFDDKIKSTSTEVRLSSNKEWSFEWILGATYSHDDIGGDFLSDATSALNSIVSAPYEQKTDAYAAYANVIVPLVGRLKLNGGLRYTHEKRSFLNVTRDLAPYGTAASQLLARGICRPQSDPSVAPVICSSQTGSFSNSDLSWTAGLDYKLEGDGLVYAKVSKGFKSGGINAAINFGASGTPFKPETLYAYETGLKGSFLDRRLRYSTAVYYYDWRDMQVFTLTQQGPLSVRVLTNAGQGEAYGAEGDLTYLASDFLTLTFGGNYNHTKIKKYVTTVAAQDATGNQFANSPKWTLFGLVKQQIPLGDDYRATVTVDANYRSSQFFEIANRPIFREPGYALVNARLAFAPTGGAWEIAFWAKNLFDKRYRVDMIEVTAAGAALNAYGEPRTYGASARYTF

SEQ ID NO: 9229 - protein, 170 aa, Opitutus terrae
MQIRIISAILGTLFTTSVLADTSGYYAGASVLSAETDLAGESEYNSGYEVHLGYKINSSFAVEASYLDLGGYDTTKSNVKYSIDSDAISLSALYTYPIGNFNLIGKLGYFSQSSDVTAVPITNNFSDDSSGGVLFGAGLSYKFNKMIEIKSEFNVASDTNYGAIGLNFYF

SEQ ID NO: 9230 - protein, 897 aa, Opitutus terrae
MQVTGVRRANAAAVESKRAATNITDVISATDVRALPDSTIVEALRRVPGLSVLPATDNEHPRDEAATPVLRGLGPSYNNVTIDGLTIASPGTPNGTLGSITRGVRLDLLPASMVSELQVVKTFTPDLDPNATGGAINLKTRSAFENGGKPFFSADAALGHANDVGKPRDQEDPGYRVNATGSRTFGSEQQYGVTVSANYQTLSSYTETHMTTDTVHYGFYDNNGVLQSGANLGNGWAVPQQDKYWYVQDQRDRYGVTGKFEMRPSAALEAYAMAGYYYFKDDMERNEVIIDPRNRGKVFNQTATSGSYPGGDIEVGYSNQIVTTRTKVAQLGTIWRPTDRQQFSARGAWSDATYDEPIRMIKYATGITRPVPVPVGQTGSGVTIHATPNYAFNYDTSGFDQRFGVSPQAYNNLDNYSLLYWRPDYKRTAADRILTGRLDYGFNQGESDQGIGFAAGVSYTTDKPSYDIYRVEYQPNSTAPAFGLADVAGTGRPPMRYVGLNLLSIDPNKANRVLAATPLSAFNSTDQQAFSNQDNFTHTEKTFGSYGLISYRSDRLNVQAGVHFDSTTLDTVGRERQLDRASNRYVYVDNPTTADYNYLLPSAVMTYHLTDALDLRAGASRTLGRPPYDAYAARTSIGFVNTTDAGNPNAQGVTVTIGNPDIKPRVSNNLDLSLEWRLPGDFDAFASAAVFDKHIQDEIFTLSRADSFTFDGTTYANALISTPANAAKARIRGVEFNGIVNTLGPIAPWLSGVGFSANVALLDGSLDVPYSVGSGSSVSQSERKLDNLVGQPDYTANATLFYNTGGLELRAAYNRQGKALRSIVSNTDWQDLYWSPRSQLDFTATYAVSKQLSLIGQVSNMTHSRITSVTGPGQNLLKDSYSVPTTYWVGLRFTPTL

SEQ ID NO: 9231 - protein, 857 aa, Opitutus terrae
MKRPQYWPSACAIAITIALTPHVYAADEGVERIEVTGSRIKRTDIEGPSPIQSINKDDIANMGFDNLQQLLERMPANGAGAFSTRGNSQDSTANGAASISLRGMGPDATLVLINGRRVAISSFAEGITNSFVDINNIPVSAIERIDILKDGASAIYGSDAIAGVVNIILRKNFEGIEINLGYGEASGSSYDEQSGSMLWGMQSDKGSASIILDYFKNSTLAATEMGRFGTANQSPYGGEDFRSSRGFPGYFYVDGVKTIDPDCPPDSATASGSCLFDYGPYNLTIPAAERVGAIAQFDYHLSDEMTAFLEVAAQHNTSEAGGAPTPLDEDAMLTVPGTHPNNPWGKDIEIGRYRTVDAGARRWDIESDTLRLVAGLRGNIDEWDWEVSAQKGRSESTQKGDRTQGWVRTDFLQAEIDAGNYNPFGGTMNSQDVIDRITTSLVRQGVSHLTAYDASITGPAFTLADREVMMAAGVEYREEDVSDVPDDQFQRGLIFGTEAVSAQADRDQYAAYVEFSIPVTDSFELQLAGRYDHYSDFGSTTNPKVAFQWGISDQLTARASWATGFRAPSLAQIGLGPSRESSFFIDTYRCAADNVDCTALDYNTEFAGNSELDAEESETWNAGLIWAPSQKFDIGFDVFSITQDNKIDKQPLGEIYLANCNDQNSTVCERLAPQPGQTLGPISLIHSSFINLSSQEVQGVDVSSHYGLEMDRFGDLKFGLEYSYLHKFEKDKLDYTGEYRYPQHRWLLTTNWTMDDFAANINFSYIGEFEDTPDIDFDGSLDFEVNKSRMVESQLLVDMSGSYRFNDTFKWTVGVNNVMDEEPPFAIGDGDTDLYGYVIATHNPMGRYFYTKLSMRF

SEQ ID NO: 9232 - protein, 902 aa, Opitutus terrae
MNTRKTLLSAAIVSCIAFSAHAQQAAQTATDLDTVQVTGIRGSMEKSLDTKREANARVEVVTAEDVGKLPAHNVADTLQRLPGVNISSSSADEGGFDEADRVSLRGTSPSLTQTLINGHTVGTADWFVLSQGNNVGRSVSYSLLPSELVRSVEVNKSSQAKLQDGGTTGTVNILTRKPLEFSKQLTAEGSIGMVRSDQAKSNDPQLSALFNYKNDEGNFGVMVQAFSQKRELRREAQEIPGGFFQIDPNGTVAKSNPDLAGVYAPGLLGSTLFEQTRERKGGLVSLQFKPLDNLTLGLEGFSSELKANNYNRNFMLWGGRILNDRTVEDANGNKILIPGQAPNPGYVIKDGVLSNATFAGQADRDYAVYDMIYRESKAKTNYITFDADWQISDNLGMKFQAGSTKGTGETPRQYIAEVNLARGGGATWATHGNGSPIDWNVGGNIGPSGVTDFGTWGNQQVTAIDKEKWATLDFNQYFADAGVLNSIDFGARFGDHKREAKSPEGATPGAIWNALKNGATANFPGGFANGIGGSFPRDLWYFTPGALKEAVTNNSTWLSGNDGPTGRHNYGAEWKVSEKNFAAYVQGNFSGDRWSGNVGLRYVNIKQDIDTYAAATGSTVPDVSSLFGAWTREALENKHNRVLPSANFKYDLRDDLVLRVAASQTQTLPDFSALGASSYGSDLNRTGGGGNPKLKPVVSTNFDANLEWYFMPRGMLSIGAYSMRLKDYVAFSTEKEMLFSELTNRLEEYNISRPRNADGKVRGIEVAYEQPIGEYFGVNANYTYADGSTDHTWADGSDNLLGTSKNTYNVGAYFENDTFGARVSYTRRSSFLIGLSGANPYYQDDFGTLSASLSYKATDWLSISFDALNLNNPTYKYYQTAAIPTSFYSNGRQYYLNFRFKY

SEQ ID NO: 9233 - protein, 357 aa, Opitutus terrae
MTKRQILAAAAVSLAMPVMAQTASSVTLYGILNVAVRSQTGLTSTYGRSPVDTTVVASGVGPTSRWGLRGTEDLGGGLRATFNLESGINVDTGTQANAVTYFDRASTVGLAGAWGTTTVGRQNTLLADSAGVADPIGLRFAGLNPNIQNVSLTGHQLGVEYGTTGSSTASNRQNNSIKYSVPIGPVVARAMHSFGEVAQSSSRKSTSGLGVDYLTEELKITTAYTRFKDANDRRLTAANVGASWLALPSLRVMANMGYNRGFTSATAEATNRIVAGGVNYSIAPAIDLLAGYYKVDRRRTAQPDDGFKRLLAFVEYKLSRRSKVYLELDTTRWKGNYLGAGNKSTSNGVSLGITHAF

SEQ ID NO: 9234 - protein, 893 aa, Opitutus terrae
MGAVLLSTCTLQSTLVFATCILQANPSQTRFSIKLQNVTLEEFVKQMEQKTGYSFIYGEEVRLNSRITLAVRDLTINEILRKVFEMQPIGFEISGKHILLHKRPMPQKTVSRRFTISGYVTDGASSETLIGANVLDSRQRVGTATNPFGFYTLTLPEGDAELSFSYLGYETRHSSFPLNKDTVLNIRLNTNNELAEVIILSDKKEAGIQATAMGAHEIPMAQIQHTPAVLGEADILKTIQLMPGVQAGTEGFSGLYVRGGGPDQNLILLDGIPVYNADHLLGVFSIFTPEAVKKVTLFKSSFPARYGGRLSSIVDVRTNDGDMKRYHGALSIGTLTDKIHLEGPIVKDRTSFSLSGRTTHTAFMGKAFSSDGDEFNYYFYDLNAKVNHKFNDRSRLFLSFYHGKDHYHYNFKESYGTSDCYESKNGLNWGNTIVAGRWNYVFTNKLFSNTTVAFNSYRMILKGRAKEENIYSSSQSYFYQYDSEYRSGIRDWSFRTDFDYTPIPSHHIKFGVEYLYHTFRPETNTSKMKEEENGVTEQDTLYNSISNSYLHGHEASVYAEDNFDIGSRTSLNAGVHISLFNTQGKNYFSIQPRLSVHYRFDHGFSVKASFSQMAQYVHQLSSTPLAMPTDLWVPITKNIRPMRANQYSLGGYYTGIRSWEFSIEGYYKQMRNVLEYQNGVSFFGSSTNWEEKVEMGKGRSMGIEFMAQKTIGKTTGWLAYTLAKADRQFKDGSINDGERFPYKYDRRHSISLCLNHKFSERIDIGASWIYNSGGTVTLPEQQTVILKPDGSIEQTDYISKRNNYRLPASHRLNIGVNFNKKTKHGMRTWNISLYNAYNSMNPTLVYGKRRDYDYLAYKDEHGKYTGGYNTSKLFIKKITLLPIIPSVTYTYKF

SEQ ID NO: 9235 - protein, 948 aa, Opitutus terrae
MSSLRTQVATLALAVSTALWITPVCAADAEQTTKNTEEKAKQAEEAKEEDVERIAVYGIRSSIKESMFLKQNATSVVDLVVADDIGKFPDENLAEALQRIPGITITRNGGEGQNILVRGLGAGYNVTTLNGRKLASEYAGRDFNFDTIASELVNVLAVYKSPEARLTEGGIGAIVDIQTRKPLDLDGFTLQASAKGIHESRTGDIHPHASFIIGDQNDDGSLGALFSAVYSKKTLRADTYSADGFFDEDEGWGVDSAGVPVDANNNGTIDEGEIFASKIPSYMYFANAQDVRERIGSTLALQWRPSDDLTLSLDGLFSRYNTDGNRYQIGFVNYDESWTPGTPLFTDAQFDDLGRVVKMKQTGDNTMVELLNISTPRQTDTWQLGLNAEWHPTDQWSVYADAAYSQAENKNKGDNRFIVARGFVDSIGIDYSTGNTLPDVVISPALTSDQTYGAHYSYNSGTGVKDKVNDFKLEAIYEPEDSLVSKVHFGVNYVKQSKTQNAFGSRNPSQFSRGGFYLTRDGYDFAPGQVFTQGEFELFRIPENVFVPANFDNFLDGENSVSPDPWPSFDYDALLAFYRSINAEAADASIVATQSKSGSYEVSEAVTSAFVQVTLEDELWELPYMLNLGLRASHTQVDSSGFGYDLSKVVLDSAGNPTNNDWRAVLPVGHEGSYSNVLPSLNFRLNLQDDLLLRVSAAQTLSRPSLYALRTWANPDFVNRKEGLPTLSRGNPGVSAEEAYQGDVTLEWYYGDSSSLAAGVFVKDIQSFIENDENAMDVEGNRYMVNQPESGEYGALITGYEVAWQQSLEQWLPSPLDGFGVQLNYTYVDSEYDDPARKEQNLPFAGMSENSYNAVLYYEKYGLQGRFAYNWRSKFLVDPEAWGGPAWINAYGQLDASLSYALLENLNVFVEASNLGNDRYSGYIKRPDQVNYLERFGTQIAFGVRGSF

SEQ ID NO: 9236 - protein, 897 aa, Opitutus terrae
MHSRTTTLALCITAALYCSGSAMAAGQEQQAPASTPSATTELDTVTVTGYRASLEKSQSVKRAANSIVDAISAEDIGKFPDTNAAESLAHVPGISVDRQFGEGEKVSINGTDPALNRVLLNGQTIASGDWGGNPSDTSGRTFNYTLLSPEIIGLMEVYKTPEARIDEGSIGGTVIVHTRKPLDLPKNTIRGSVGYNYNDRSKEGNPRGSALWSWKNDDETFGALISATRDEQDLARAGIEYFGYTTGKGIPPTATITGDGSNIATARVPAGISSAFFQQTRERNGLQGALQWKPDENNEFNLTGIYIKGKYNNYSQARYVCPACNDDLKKVTRANVENGVVTSATVSDNTQGGVNDQPYAQMDTNYRESTVTTKSLNLRHDWSGEKWVFTTQIGDTEATGGKNPEYLMKYLMQDGGYNYAFDGRNTAVNYDNGGAANWALPGNPAGLAPGAETIPGTSPSVSPMQAGGIYYQKSKDQEKYFQWDASRDLALGPFNKLQFGYKYINHDNGVDARGNRINTTDPVSLTQFNPGTTQSSLYDGLGASGDLTTWPTANLGAVRNYLLSQPQGPYRTDYGSSFDVKEITQNVYTQLNFESGQWRGNVGVRLIDTTDKSEFWQSNDNGNTYQRTAQTNDYRKALPSFNVAYDVTDDTVLRFSAAKVIARPRYADLAGTFTVNSGNGNLTAQGGNPNLKPYESTNYDLAAEWYFAPSSMLSGEVFYRDISSYIVNTTVAQQLNPAPPAVPGLYQVTTPVNVSDAKVKGASVNYQQTFGLGFGLQANYTYAKADTSTDLNLPYLSRDTYNVIPYWEHGGWMVRVNYSYRSKYFTQIGRLGSEDFADSYKQLDLTASYQINDTMGLTFGATNLLDSTYKLYSGTRDTPTAFYKNGRGYQAQLNFKF

SEQ ID NO: 9237 - protein, 664 aa, Opitutus terrae
MIQNPQLTARLAIALIAGASINFASGQDTESSEDSVYDLAPFVVSGETYAFGAQKIVHVTAEDLERLQASDLSDIFSQDPSIMVGGGISAAEKIYVRGIEDKMLNVSIDGATQAGYLSHHQGQYSIEPELLKFATAEPGAGGAAVGPGALAGAIKFENKGASDFLTGDATFGSFSKASYGSNGDQLKLTGALFGNVSDSVSALFAYTYSDSNDYKDGNGDTVDLTATDTNRAFLKLDAQIDAKQSLDFSFEDRDSKGTYRHRPNFAGYFNHPVAPNVPVEMEFARQTATLGYGYYSAEDNLDFQANLYHTDNSIDRTGQYEMGYKSLGLDLSNTAAYGDHEPSYGFNYRDDSAYFTGKGQAVGFARPLVYNTIPDETIEIIGFFAQDEWQVSEQLQASFGLRWDEYVYNDKDGQTFKNSGFSPNLGISFAATEELDLNISYGTAFRGVTPIDLITANEGGVTNHDSIDPEWAENTEIGFQYDNGTYFANGTLYQQTINDVIISSGIRDNSGDLEVDGYDFSFGLRQGEFTSSLGVSHSNPELDGVALVDTDFGLGSSYGRTWNANTDYAFTDQQIHVGWSLNYVEKYDESPESLAHKPSYFVNDFYVQWVTGEDDNIAVTLTLDNAFDKYYVDQATAGYNARLARVAGLAAPGRDIRLSTSIKF

SEQ ID NO: 9238 - protein, 414 aa, Opitutus terrae
MNKLRLTILLGGSLACVGSLFSIDSYASTSFGSPNTVDNTIKDNTRKKESWREKLASEHNLTLGLDYQVLGLSASSPTAGGDDNSAAGVVRFYGSWNLTGLESGNVGGLVWKVEHRHAYTDTAPKAYSFIEPGLGYIGMIGPAYSDQGGRLTNLYWKQQFNQGKTALMAGYLDTSDYVDTYALASPWTGFTNLAFSTGAGAIGLPDDGVLGLAVGHMLDDNFYIIAGAADAKGRSDKPSDGFETLFNDHKLFTTFELGWTASQEHIYTDNVHVTLWHMDGGTQHNLTQPSESGQGINFSASFFVTPQLMPFVRGGISQGDVALYDNSLTMGLGYFGLGGEKNNLGFAINFSEVNENLGKAYGVTDDKQFTSEVYYNMSLGEFVQLTPNIQYIDNPAISTEDDTWVIGLRARVSF

SEQ ID NO: 9239 - protein, 656 aa, Opitutus terrae
MNLLLHGGCGLLEFKVSIRFQKLPIVCLLAASPALAQEELAFYALPPVFVSSTHTAVSEKDQPFSTTVITAEQIRQSGYTTVRDVLSKLALVNVRTPLDGSRSASVDLRGFGETASANVVFVVDGVKLNDNEGVTPRYGSIPVSSIETIEVIRGGSSVAYGSGASGGVIRITTKKGRGREGFGGDVFASYGSYDTKELGATLYGGANGFSLVFNGSKEFTNGYRDNSEASRDLGSLALDWQGDVYSAGASFSAEGSKSRFPGSLNRAQFEQNPKQTNSPNDFGSFERNTFRFYGEADYGNWGTGVRVSRRTHEALGSFDFGTFVFDARSEYEQDQISPYLTFTLPHSTGAHVIRVGYDIEKAALRGFDAGTLESNAIFIEDDWTVNDVLRINAGSRYERSEQQKASGQTRDYSLVAHQLGASWKAAENLTLFSKLARSFRIPNANENGFAGVGTTRVPFLNPQIADEFEVGLKTGLWNGEFSSTLFVMDVDNELFFDPTIVDPTMFINGLNSNLDELRRQGAELKWNGSIRKDLRMIAAYQYLDAEFKSGSLSGGRVPLVAAHNLKVATEYDWTSSVSTEAILNIQSDQRSAANTDLQIPGFGVLDLNWRYRADSYSVVFQVQNVLDKQYYRTQFGPNGIYPEIGRAFFVNLNAEF

SEQ ID NO: 9240 - protein, 678 aa, Opitutus terrae
MRPSSILSLLALNAGLATPALAEQIELDSLTIEEPRAGDPTAPTQAEKRAEFARIPGGATLVDGETYKTGRSSTLQDALGLATGVFVQPRFGAEESRLSIRGSGLQRTFHGRGLLLMQDGAPVNLADGSFDFQVIEPLATDHIEVLRGANAWHYGTATLGGAVNFVAPSGKSAPPLDLRYEGGSFDSHRLFLAAARDFGAWDAYLSVTDSSQDGFRDHARQDNQRYFANLGGRLGERLFTRFYVTHVETDSELPGNLTKAQLRDDDEQAAAGNLSNDQRRDFTLDRIGNRTVWLLDGGHSLELASFYSEKDLWHPIYQVLDVDSEDYGLRLTHKWQHQGWRWTGGIEFNHGRNRDVRHQNVGGHAGRKLNELRQTARNLNAFAELEIPLAERWALIGGLAWLHQKREVDDRYKCNASVAGRCVFQDESFESTYVGRVARLGVRHDLAEGIQVFANFSQSYEPPTFSELTGGQVVSKNDAQRARTWEAGLRYARGGVALDLALYRSEIRDELLALNDDNGDPLGTVNADRTLHQGIELGGSWSVGAFVLRGQYLFNDFRFDDDDVYGDNRLAGVPRQFLKGELLWQRAGWYAGPTFEWVPSHYAVDHAETLYTDRYALWGLKAGYRPARGPAFFIEGRNLSDRSYAATTGVIADARGQDSAQFLPGDGRSVYAGLEWRL

SEQ ID NO: 9241 - protein, 772 aa, Opitutus terrae
MTPSISPLASAVLLTLSAPAFAQPDDVSAPPGAVDLDAIRVQQERAQKPSSPKYTEALRDTPQTITVVTKQTMDQQNLLSLRDVLSTLPGITFGAGEGGGGYGDSINLRGFTASSDITTDGVRDSAQYSRSDTFNLESVELINGANSAMSGAGSVGGNINLVTKTAGQGNFTNVMIGGGSDRYGRLTADSNYDFENGTAVRLNAMGHTQDVPGRDEEFRHRWGFAPSVAFGLGSDTRFTLSYLHQHDNNLPQYGVPFALSPFNDGQLPGVDRETYYGYRNVARQEIDVDMLTGVLEMDFDDNVKLRSLARLQRVDQRTTATAPEGTWCLPDNTNAYTGRACVGQPPSTWSPNSGPRGLVRDTENFIAHSQTDLTATLHTGAIEHRVVAGVAFSKEDFELDSGSLFRNADGSTTGITYPLQSFDNPYNIWTGPQNYFRTGRSKGSLTNQAVYLFDTLQFNEQWMLNLGGRYEHNEGDTTTYTVNATGGITGVAAGFPAGSKDDLFSYRAGLVFKPVDNASLYLSYANAKTPSKASVNGSCTPIATSTVGANCNVEPETAVNIELGGKWDALDERLALTAAVFRNERENYKVNSGDPLVPEQVLDGKARVDGIALGAAGYLTDRWSIFANYTFLDSEVLQSVSNRTASLTGDPIAGRELVQTPRNAGNLWTTYQLNQWTFGYGVNYQGSFYPNNTSTAVYRKTDAYWVHRAMVGLRVNTWLSLQLNVNNLFDKVYYTSIRNNLTVNAAGTVTAGSGWALPGDGRSAVLNATFSF

SEQ ID NO: 9242 - protein, 770 aa, Opitutus terrae
MAGSGSASVAVTCHRRCRGIVSIMSPFHRRFCGRSLLSAVAALPLTTSGPVRAQALLTQLDEIAVQGGVGIGLPANAPADAIGADAAAALRTPSLTQSSPVGLNLRTPSRSASRLGLTPLETPASLDIISGETIRLRGQTSVLEAVSQNGTGITAFGSPGNGLGFFTARGFAGQNSIQTLFDGTRLYVGANTVTFPFDTWNVERIEVLRGPASVLYGDGAIGGIVNVVSKKPLFTPLNVARFGLGEDGIARAAVDSTGPIGESLAYRLNVSGNRAGGWITPEGDFRNFAVSGALTLQANPDLAFTLSHDFGYQEPTRYWGTPLVNGRVPDTIRFNNYNVRDSKIAWTDNWTQFRTEWAPSADVTVRSTAYRLQSRRHWRDVEQYRFNPATGLVDRSDYLEIGHSQEQVGNRFDATFRGALFGLANTFSAGFDVNHVSFRHANNFTFSETPTSVPLNGYDPGFFPPDGRASPAYATRTNQASVFAEDRLFLTDRLSFLTGVRFDAPRLHREDLRSGATFERSFRALGYRFALLYEPTPDTSLYAQYATATDPVNSLITLSQSLAGFELSTGRQVEVGAKGLVFGGAVEWTLAGYRIVKDNLISAVPGQPTVSTQVGQQSSLGAEAALSWLPAPSWRIDANLALLHAQYDDFTQNVGGVAVSYAGNQPINVPEQVANLWVNWTFARDWEGRIGLQHVGEVFSDFGNTARRPAYTLVNLGLDHQVTAGSRLSLRVFNLFDTTYAVDGSAVNGVGTAWVLGRPRSLEVAYTIAW

SEQ ID NO: 9243 - protein, 385 aa, Opitutus terrae
MNRRRKLLIPLLFCGAMLTACDDKSAENAAAMTPEVGVVTLSPGSVNVLSELPGRTVPYEVAEIRPQVGGIIIKRNFIEGDKVNQGDSLYQIDPAPLQAELNSAKGSLAKALSTASNARITFNRQASLLKTNYVSRQDYDTARTQLNEAEANVTVAKAAVEQATINLQYANVTSPITGVSGKSSVTVGALVTANQADSLVTVQRLDPIYVDLTQSVQDFLRMKEEVASGQIKQVQGSTPVQLNLENGKRYSQTGTLKFSDPTVDETTGSVTLRAIFPNPNGDLLPGMYVTALVDEGSRQNVLLVPQEGVTHNAQGKATALILDKDDVVQLREIEASKAIGDQWVVTSGLQAGDRVIVSGLQRIRPGIKARAISSSQENASTESKQ

SEQ ID NO: 9244 - protein, 382 aa, Opitutus terrae
MNKPLSFACAVAAPILFSHSAMAQFDYSKYIETDGSFKRFSVSAGWLHANPTGDATPVKNTTAISDGTSHNNGSVRSGTVKRVLDPDQGLDSAAENQARFDEINGGLSLPGDDNTDLSNTALGNLSGTTVINGLQKFATPGTGLESDDVDTLGMLLNYHIDDNWSVEVKAGFPPKVDILGKGTVVAPFRGVVTPSGIAEQAIGDFNIKDDIVITDLSQGSKASTARAWLPATELHYKFGKSGVNKFRPYVGAGVMYAYFNDLKLNSGIRQDLVDAGHMIQNIKDGNAGTSLQYDGPDGRTTPSSSGMHVKVKADSAWAPIVTVGATYDFDDSWFAVGSLSYAKLDSDSTITVSNDNGEQLIKAVSKIDIDPYISYLGVGYRF

SEQ ID NO: 9245 - protein, 602 aa, Opitutus terrae
MSPNAPPIYDSNGQLNFQEWNDAGMPYAYPFGSLKALSYSKTSLATAKLMLSYELLNGLQLSTSLGYNTSHNVGGGEMPISSQNPLTNPTGMMVVGTNDNQNWTIEPQLNYESVIGKGNLSVLLAASLQGTVTSGQSIQGLGYEDDNLLGSITLAPFTRLFDTYGQYKYAAVSGRVGYNWEKKYFINLSGRRDGSSRFGPGKRYGNFGALGAAWIASEEAWVKNALPSFMGFLKFRGSYGLTGSDGVGDYQYMSQWSNQPNYSPLYPYGGVTPLTSMHAVNPDYRWQVNKKLEFATEMGFFNDKITLMVAYYQNRCGNQLTSYPTPFYTGFGSVTANWPATIQNSGWEFSAASTVIAKSDFKWDLSLNGGTNKNILIDYPDLELSPYATEYVIGKSVNDRYYLHYIGIDPMTGQYAFEDRNGDGTVGVNSAAIPGKGEDDRYVVINSDPKFTGSLSNSFRYKSIALSFSLYYKNQMGLSAFYSGPPAGGFFNIPTEIYENRWQYPGQNAKYAALTTVNGSGSNSLVGSSDLYYTDASFLRLQNVAFSYTLSDKLLKNKELSFTVNAQNLWVLTKYKGIDPDTQNFGSMPTSKTITAGLNLTF

SEQ ID NO: 9246 - protein, 748 aa, Opitutus terrae
MNRSHTGRRARPGFPLPRAALRRVPSWAAALACATAMPVAVAAQDAPDAGEPAADASLLAPIVVDGRRETGVGPVQGIAADVSRAGTKTDTAIVEVPQGLSVVTREQMDRQDVHSVGDSLRYTPGAYADSRPGGVLESVFLRGFGGFAAAAINPQMLDGLPLPKGVNWAASVVDPWTLERIDVLRGPASVLYGQASPGGIVDMVSKRPTRDAQHLLAVQTGNRDRGQLAFDFSGPVTKDGTWRYRIDGLARRADEQIDYSRQQRIVVAPSLTWQPNADTSFTLLGSFQRDPHNNFAGWLPALGTLWPDSGRRIPTHFFPGLPGFDTYDRTQAMIGYAFEHRFNSTWKVRQNVRYTHLDVDFAGAAVNFIAPYLSPGVLNRSLSWSREHVNHLALDNQAEMRVMTGPVEHTVLAGLSYEHAVANLVGSGFGAAPPLDTRAPAYGQPFTVPPVAQQTRQTPDRIGVYLQDQVRWDRWVFTLGGREEWSRTTTDDLLRSASVRQSTRAFTGRAGAVYLFDSGFAPYMSYSTSFEPALGTRFDGQPFTPTKAKQFEVGLRYQSLDRLQNASIAAFDIRQRNVLTADPEHPFFSVQTGEVRSRGIELEGRTRVWKQLDVIAAYTYLDTTVQADTDPTVVGKRVAAVPRHLASLWLDYAVERPGLRGLRVGGGVRYVGRSAGDNVNTFDVPAVVLFDLGLSYDLGVERPAWKGWRVAAHVNNLFDRTYVSSCFSAGGCFYGTRLMVTGDVSYRW

SEQ ID NO: 9247 - protein, 698 aa, Opitutus terrae
MHLRRRLLLASMLVGAAASAAPAFAEEAASAGAEVSELVVTARRENRTSKGATGLDLSLVETPQAVTVIDRDFMDVFGLDDANSVLMLTPGVNVEEVETDRTYYNARGFDIRSMQVDGVGLPFTRNVAGDVDVAGYEKVEAVHGANGLLTGTGNPSGTINYVRKRPTNAFRGGAELTAGSWDRIRGEVDVSGPFSPSGRWAGRLVVAAEDRDSWLDLNSSARTFVYGVVEGQIGDNAIVTAGYTQQDSSAEGVLWGALPLLYTDGTQAEWDESATTSMDWTEWDIRTRTSFVELVYALPAGWEAKGTLTYNDFKEPSRLFYVYGNPDPETGLGLFGNPGRYDQANNSTLFDGVLSGPLEIAGKRHEIVLGVTSAKSQSGYLQYAVPFTDPAWGALPPFGTWSGDEIAEPTWEPPVQAANFTNRFNRVYGAAHLDFGRGVKAVVGFNAIDVKTRGDSFGASMRRDEEAVSPYVGATWTFTPNLTLYGSYSDIFEPQAELDETLQPLGAAKGESWEGGLKGEWLDGRLYTSVALFKAEQDNYPELAGMTPGGISVYRGIATRSKGIEIEAVGRLPGGFKVQGGFTTLEIEGDDGADVRTYVPRQTLVLGVTWDVPAVEGLQLGGVVKWQDDIHLDTALGVIRQDSYALLNLVASYRLTEAVKATVRVNNVTDEKRLTSLYWEQAFYGAPRNVSVSLSYTF

SEQ ID NO: 9248 - protein, 891 aa, Opitutus terrae
MTPLFCVSPAHCRRAIRHPLALSIALLLSAGVHAQEAAPPGTAAAQPATAQPTSTLDAVQVRGVRSSVESAISTKQAHKEISDSIVAEDIGKLPDNSVAAALQRVTGVQVARAGGEVGQVLVRGLPNVITTLDGRNVFTTVGRDMELADVPAELLRSVDVYKTTGAQFQEGGIAGVVDVHLRRPFDFDDDSTIAGSVSALRGDQAEKTVPNGSLTMSQRWETGVGRMGVMGSVAYQRRPYQESNTLYGTYDLKPNPLEPAQQLYVPYSAGGLMARGDRKRKSANLSFQWAPSDNSEIYVDTLYIGYDNRPQVNYWLPFPGLANAENTESVSVRPGSTVLDGLVARDLQTLSSTQAHKNASDTYQAALGGRWSGERVKLSTELAYTYSNAKNRAFTLDMDTRARLLHMRSGGGAADTWITQRDGSPYDITAPGNWVLRQYYDSWNRQRGEEWAWRGDATFELDAGPLTSLEVGARASRRTATNHSGDTGARDNITGAPILLSDVPGLASVTPGNMLDGARAFTSDRWASANQDVLLQQSARLRTLMGQSPEAPLENPALFFDDREDNYAVYAQLNYGFSLGPVPVDGRIGARATRLDSSLEGSQSLDGVLSPVSIDRRIDKVLPNYSANFTLHENLILRLAGSTTITRPEFADLNPQLALYQSTESLPARGNGGNPQLRPVESRNADLSLEWYFRPGSLLSLAGFHRDIEGYIQNYAADEVIDGITYSISRPRNTGQGSLKGVEVGYTQFYDFLPGWLSGFGTQLNYTYISAEADSPEGISQPLTNVSKNAYNAILMYEYARFSARVAYNWRGDYAVSFNSSGDQPEQINQGREKWLDVAFNYELSERLTVFAEATNLLGTTTDNYFGQRGAFPREVASPERTYSLGLRFRL

SEQ ID NO: 9249 - protein, 696 aa, Opitutus terrae
MPALPLRPLLYTLALPTLLASAIAQAQDTPAARTLDRVTVVAERASTATKTDTALTETPQAISVVTQQLFTDRGAHNLQEVLRYSAGVTADAWGLDTRNDATSVRGLDPVQYQDGLRRSYGFSPLARPETYGLERVEVLRGPSSVLYGAGATGGIINAMSKRPAFGALNGEVGVQLGSFDRRQLQGDIGGALNDAGTLAGRFVGLVRESNMQTDVLKDDRVYLAPSISWRGERSTLTLLASYQHDKTGSSQQFLPLAATLLAPPGRRLDPSTFIGDPGFDRIDSRVYSLTALFDHSFNDTLSLRSAVRYIDGRTTLQQMYVDSYSNPADPFIDAERRVVNRTAYGTRPDVQIFSADNALQFDFATGAFQHLLLAGVDYSQYKEQLQRLDATGTPIDVYTPVSVAPIVRGWDRQPDQTSTQLGVYVQDQIRWADRVSLVLGARRDHARSKTEGQPSQTDNATTYRAGLIGELGAGVSPYLSYSESFLPVSGQDLFGNAFKPMRGRQSEAGIKWQPARNLLLTLAAYRITETNRQTNDPDNVLNVVQTGQIRSKGVELEGQFQFANDLTVTAAVARNEAEVSRSNFALEVGQRLNDTPQDLASAWVSKGFQLDDAARLRLGLGVRHVGNTVSLGNGGRIITPSYTLADALLEVQVTDWTMALNITNLTGKRYYAPCRTFGDCFAGYPRVVTGTISYRF

SEQ ID NO: 9250 - protein, 234 aa, Opitutus terrae
MLMIIKKSGGRWQLSLLASVVISAFFLNTAYAWQQEYIVDTQPGLSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSTLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 9251 - protein, 198 aa, Opitutus terrae
MKSSKFSPVVALALPLALFGAPSLAGSLEDPVVEPVPMAPAPVVVSGRDWTGGYVGAQIGYGDVGTNASGVDGDGLIGGLIAGYDYDFGSYVLGAGIDYDIADIDLGPASLEDVLRLKLRAGFEAGPSLIYATGGYARAGTDNLGSDDGWFAGAGVEYPLSQNLSLAGEVLYHEFDDFDGSGVDVDATTVQARLAYRF

SEQ ID NO: 9252 - protein, 104 aa, Opitutus terrae
MQLNVIKDIKTNSKFTPYIGGGLGFAFSQYNVMNGVHKGSASGTTFAGQGKAGISYELSKDTSFYLGYRIVWINGGNTIDVWSDNPKTGGHLQQSVDAGIRIRL

SEQ ID NO: 9253 - protein, 438 aa, Opitutus terrae
MKTNKTLLSTAVALSLLGTTGMANAAGFQLAEYSATGLGRAYAGEAAMADNASAQWRNPAMLTYLEGTQVSVGAIYVNPNIDIEGDVNFHGSTSSASSDDFAHDAIIPNFYLSHQYNEKFAIGLAFGTNYGMETDLGKGFGASHFGNEASVTTMEANLNAAYKVNESISVGGGIRYIIGEGSFGAAAPKNNVVGLNPETNQPISVPQGTALKYMEGDDTAWGWQVGTAWQINENNRIGFAYKSEVELKLEGHAEGLGFGFGTSERDNGYMYLNLPATAELASFHQVTDQLALHASVNWTDWSSFEKLEARLNTAGTHMVKVENWEDNYRFAVGATYQLDPKLALRTGIAYDTSAVSDKNRTITIPETDRTWLSIGATYDWTKDFSLDAGFTYIFAKDAPIVESRGYKSDDTAEQVGGQFVGETTGNVWLIGVQANYRF

SEQ ID NO: 9254 - protein, 391 aa, Opitutus terrae
MNTKRLITVSIWALIAASTAHAADVGIPRQSVLAASPVITAPTFTWTGFYAGIQAGGFSSKTDLSIVGKDKTVPLSKDLSPKLSGFEGGFYAGSNINLGDDFIFGVDTDLTLSGQKHTKTIIIGVDDNAAVENAVARSGRSTRSASGNTSTTTQSSVSAVSSSVIESALTLAKPAAANTGTHAHGHSGRQGGDAHSTYHGAGNGAYPHSMGAHSHVANPHASNPHGTQNMAGRTTQSTKVAEKNASGIYGIEQVKKEAYEHGLSQYGNVETLSHTLKQNWAGATRVRVGFSVDRVMPYFAGGIAYAQLHDTISISIKKNDESVVTSKNLTDEKKTMIGYTLGGGVDFAMTDNVLLRAEYRYSDFGKKKFAKEKLEINYKTNDFRVGVAYKF

SEQ ID NO: 9255 - protein, 404 aa, Opitutus terrae
MKTYPFCSSSSVLITALLCPLVVQAAENESQQTEHMWSQGWYLGGQFGLATTNVSNAGLDELYEQAGIDASSTKVDDSGASYGLFLGYKFNQYFSVEAGYLDLGERSVEFSGQTTDLDAYYDLAEHVYPETGDGWSLSVLGTYPLSERFSVTGKLGYFAWELDAVTSSIADEASQVGSDSHSGSGVWLGAELGYQINHDMQAYVSYQHMPLDADEVGVFALGLRYWFGSDSRDAAPVLPAAVVPTLAKIGSDGDSDSDGVFNAQDQCLDTPSTHAVDSRGCTLFAPRVVEMKLTVLYENDSDKIDLSNTDKIQKLADFIEQYDIKQITVFGHTSAVGSQAYNQKLSERRAASVAEMLAADFNIATGIIKAVGKGESEPISHIPEQNRRIEVYLNEELNLPVLKQ

SEQ ID NO: 9256 - protein, 787 aa, Opitutus terrae
MNGYLRVKTSYFLALNALTFLSFNSLVGAKEQHHTLQKVTTTEQKFNPSAPLSWQSEEMRNSTSSRTVISNKELKKTGNLNIENALQNVPGIQIRDATGTGVLPKISVRGFGGGGNGHSNTNMILVNGIPIYGAPYSNIELAIFPVTFQSVDRIDVIKGGTSVQYGPNTFGGVVNIITKEIPKEWENQAAERITFWGRSSNGNFVDPKEKGKPLAQTLGNQMLFNTYGRTAGMLGKHVGISAQGNWINGQGFRQNSPTKVQNYLLDAVYKINATNTFKAYYQYYQYNSYHPGTLSAQDYAYNRFINERPDNQDGGRAKRFGIVYQNYFGDPDRKVGGDFKFTYFTHDMSRDFGFSNQYQSVYMSSQNKILPFKGKGKISATNPNCGLYSYSDTNSPCWQFFDNIRRSVVNAFEPKLNLIVNTGKVKQTFNMGMRFLTEDLYRRSTTRKNPSMPNNGSGFDAGTSLNNFNNYTAVYASDEINFNNGMLTITPGLRYTFLNYEKKDAPPFKAGQTGKTIKDRYNQWNPAVNVGYKPIKELLFYFNYQRSYIPPQFSNIGSFVGTSTDYFQIFNVMEGGSRYYFNNQVSFNANYFVIFANNYFTGRYGDNKEPVNARSQGVELELYYTPIRGLNFHAAYTFIDANITSHTMVTNPANPKGPKKDIFGKKLPFVSPHQFILDASYTYAKTTIGLSSFFYSRTYSDVLNTVPFIQYAPTIKNGAITTKTAGMTPWYWVWNLQISTTFWERKKQSVNASLQINNIFNMKYWFSGIGTSLTGKKPRLLGASQRM

SEQ ID NO: 9257 - protein, 376 aa, Cupriavidus taiwanensis
MKKSAILVAVGALFAGSAYAQSSVTLYGIVDTSIHYITNANSAGNSLTQMESGAVSNSRWGLKGSEDLGGGNKALFVLESGFNSATGRMSSSGTLFNRQSYVGLSNKDLGTLTLGRQYNFGFTMGGNFDPLGVGNYDGNSWMFYGLTGLRESNMVKYENKINGLYVGLGYGFGEVAGSLSQNQFLGAAVSYEFGPAMIGGLYQQHKDTAGNKQTVWSIGGNYTIGPAKLFLGYLDSSDATGCVNSSSNCVGGSAFGLNIYGNATTGAGLTPGATKRRDHVGMGGVTYQVTPALALTGAFYYDSISNAALTAGNDGKRYTAVLLAEYALSKRTQVYGTVDYNKVKDAAIPQLQGGTNDGTGAKTNQTSVGVGIRHIF

SEQ ID NO: 9258 - protein, 939 aa, Cupriavidus taiwanensis
MSKNITNPTAIDRRKVLGLSIGSAIALLSSAEVYSACIALGNTATVTGTTGCVTWSGGNLTLTNAGTLISTGAAPVTATSAAGTLLNNGLLSGTSAAGVENTANALIVQNNSTIISNTIGLNNNGTIVSLNNNAGGTISGSVAGVKNNSFIMSLSNNNIISGGLGINNGGTLGSLANSGTLTGTTTGVYNSGLITNLSNSGSLSGTSYGIQSDNGSQILSLQNTSTGIIEGGTGVLVGNLTPSGTINVNTLTNAGQISGTTNVGVGTSSNGTIGSLNNTGTLVGSLGGVGNAGTIGSLVNSGTISSSGYAVYNAGSGTFGPITNSGMIAGTIYNGATRSMTINGSNDATFGTLTGASGGTGSADIGMLYSTSADLFFASGNLLLNDNIQAGSKTVNNTGATLQVNNILSITGNYVQRASAALVVGVGDVAVSNGVSADTGYGRLIVSGAATIDNGSTVALKSLNTYRFAPGQRYVVITAAQNGTNYNANSLNYLTSAYEGVTSGSVVDSGNTSSLVVSLGAKATDSGTGTPGVPTNPGTGTPGVPTNPGTGTPGGGETPVTPGFATTGNAISSLSGLKQYTGIAPGLLDLYNASLAIDSTRDANKVGEQLSPVQNSSASNVASVATFDAVGVVGQRVDSVRLAHTQGMSGVATGDDPTDWAAWGQVFGGHANQGMVDSVSGYKANYSGLVLGVDRAMGDAWRVGGALTYSYTSVHGEDNLSGNKTGVDSYGLIGYASYTGDPWYVNLSASVTQQRYDTSRKVNMTGYSDSAWGKFNGQQYVTKAEFGYPLAVADTTTLTPLANLSYSYQTLDSYKESSGNGSALSVESSHNNAFRSGLGAKLEKSFQTGIGDIVPYVQAVWTHQYDSKQSTTNASYAADTIGETSFTTFGASPVEDTADLSLGTTVLNSDTLSVTARYTAQFGEQYQGQTVSLQVRKLF

SEQ ID NO: 9259 - protein, 915 aa, Cupriavidus taiwanensis
MPVAAIAGTISGTVSDGTGTRALQSTQLTIVELGRIAEAGRDGSYRFPDVAPGTYTIEARYVGADPVRTTVVVPATGDVDADIRIGSNIDASIIVVGQVANQASALSRQRAADGVESVLTRDAIGQFPDQNVAESLRRLPGINILNDQGEGRFVSVRGLDPELNAASVNGARLPAPESDVRSVALDVVPSELIESIEVKKSLTPDMDADTIGASIEINTTSAFDRKKDLYSVKLEGSYNDYSGEVTPKGSVDFSTRLTDSFGVSGGFSYYKRKFETDNIEASDWTTSEDGIVYAETMEYRDYDVTRKRIGATLNFDWMPSDTTKLYARGIYNQFDDQEYRRRLTFVLDEEPASGDADSAFFTDEDGRIEVRRDLKDRFERQRIKSIVLGGTTETGPWKLTYSGSWSESTEKEAGSIDPIRWRARFDGDGVDVNFNYADPRVPLFEVTSGADLFNDPSEYSFNRVEQTVLSDSRDREYALKGDISRAFVTDSGTFTVQTGMKARWRKKSYDFTMAYYGDGDLELGDVLGDQTYRLANLGPLPAKGAASDYFYANPGAFELDPITSAYESAAPDYSATEDILASYLLGRWDSDTVRIIGGVRVEQTRNALRGNLTQYELDDVGEATGVVTTPNVFTKNYTNWLPSLTARFEPSRGLVLRAAGYKSLVRPKLSQLAPRFLLDEDFAAEFGNPDLKPYRAWNLDASAEWYFSGNGALTAGFFWKSIKDYTAEIRDFTDGTYNGVAYSEARYFVNGDTAKVKGVELSYSQVFSFLPAPFDGLLTNLNYTYTDATGRITSYDDDDNAYSRKIALPNASKHTFNAVLGYEKGPVSLRAAGTYRSKYLDELGDGPDSDRFVDNHFQLDLSAKYKLLPGVRLFADWVNVNNAKYYAYQNYGGARRLLQYEEYNWTVKFGVSASF

SEQ ID NO: 9260 - protein, 434 aa, Cupriavidus taiwanensis
MKTLRTLPALLCAGFLGLSAQAAEDSRSGPLAGFGERLQRHGVKTHAQFWSLSLKNLDTGPRQHSFGNSGDLFLGADLDLATLAGLDGASLHIEETLFILDRGTGQPTGPSWQGAVGSYFGGAPLHNDIGANQLSLLTWQQQWLGGRLDSHLGRTNARRYFLIYNCETVVTCNDPIIDASTGILPPPYGAWGGYLKYRATPTLYLHAGAFESNPVDYLKKRHGLDFGTDDASGTSLLLGIGEKREESLDPYRSHYELNAYLNTANQVDPLTGASDHGSAGGFFKFQQLFWRADGGRLDSPRALGLFGSLSVSADDKQPFRHFAELGLTYHAPFDRTRDKLNLKASYLRLNDHQLEFQRQARIAAGGDAKLGQRDVYALETNAHIALTPHIALEPSVQYIFNPDNYYNPGARELSGDGFVVGLQLMVDMGSLLGL

SEQ ID NO: 9261 - protein, 779 aa, Cupriavidus taiwanensis
MKKYLLVLVSLCCVLSAAFAENPDYPELKKSDANIIGHVLDKKTKEHLPYITVALKGTTIGTVTDATGHYFLKNLPEGSFVLEVSSVGYKTLTRNVTLKRGKTLEEDFEIEEDAIALDGVVVSANRSETTRRLAPTLVNVVDLKLFETTNSSTLSQGLNFQPGVRVETNCQNCGFQQVRINGLDGPYTQILIDSRPVFSALSGVYGLEQIPASMIERVEVMRGGGSALFGSSAIAGTINIITKEPLRNSGQLSHTITSVGGSSSFDNNTSLNASLVTDDHRAGLYIFGQNRHRSGYDYDGDGFTELPELKNQTVGFRSYLKTSTYSKLTFEYHHMQEFRRGGDMLDRPPHEAHIAEQLQHSIDGGSLKYDYFSPNEKNRLSIFASAANTDRDSYYGPGNDPLKAYGKTTDLIAMGGAQYVHTFDKCLFMPSDLTAGLEYNRDRLKDNMWGYDRHTDQTVNIYSAFLQNEWKNERWSILVGGRLDKHNMVDNIIFSPRANLRFNPTQNINLRLSYSSGFRAPQAFDEDMHIENVGGTVAMIERTKNLKEEKSQSFSASADIYHRFGAFQTNFLIEGFYTKLTDVFVLGEPYNRGDGVLVKLRSNGPGAKVVGVTLEGKLAYLSLLQVQAGLTLQRSRYDEPHKWHDDVPAKRTIFRTPNVYGYFTATYIPIKPLSIALSGTYTGSMFVQRMDITAENAAMGDMPERKAEAVKTPKFLDLGVKLAYDFKLYKTVDLQLSGGVQNILEAYQKDFDRGANRDSGYIYGPALPRSFFAGVKISY

SEQ ID NO: 9262 - protein, 793 aa, Cupriavidus taiwanensis
MRLAALKLALVASAAAVAFPSWAQSVASPAPQADSANAGDIVVTARRREERLQDVSVSISAFSSEALERSTVQTVSDVKTIAPGFTFSSEGGKDNVALTLRGIGQLPLGEVTPGVVIYLNDTPLPSVGSNVPTYDIGSIQVLKGPQGTLFGRNTLGGAVVIGSQKPSYAFEGYVEGTYGRFDYRELEGAVNIPIIEDKVAFRAAGQIRRQDPRTIAFDGGPGFDNIHQDAYRFSLLVEPFEGLKSTTIYEYFKGDELAGGLYLLRENFPFAALGLGVVEPQVQAALQAQKANRRGSFDGGINGGAAYRKTRAITNDTSFSFGDLTLRNIFGYRKNYSYQLINTGGLPQLQIPTGLPSPAPSAVPFTLFTASSVLDRQYLTNETQLLGDFGSFNFIVGAFYNNDKPDGPSGSQFTAFSVGGVPAPAVTAHVRNKNWAVYGQIGYEFTDKLKLNLGARYSWDKVSACGGTIGTTYVDESTCLSTAALNLADGVGTVSNKGEEPSWTIGLDYKATPDWLLYIVSRRGYRGVNVNTPLFETPFTTGGTNPACVGTGGVCADLRPFQKTGEETITDVEIGSKYDYHVGSARGRLNLAAYYSKYKNALQFLNTQTTVPNGTPDSPTNGSLAANVADLRIWGVELEASISPVRSLTVGFNAAYTNVKVESLTVPAGLPSTIVLGEGQINKYSPSFSGTASVSWTLPIRPADGDVVVNADLFMTDDFGGQNGEKLPGYQLANARLDWRGIGGTGLDLGIYVKNLFNEKYVSASSVLLPSFPTSSVYAGDPRTWGVTAKYTF

SEQ ID NO: 9263 - protein, 666 aa, Cupriavidus taiwanensis
MLRRNWKTLLVSPALLGMALAVSPAATAAETPSQAGVSQNETASFEIAQAKQDQLLDKLENYSNEGQSNSNDQVTSVSELRDVAPTEWAYEALRSLVERYGCIVGYPDRTFRGNRATSRWEFAAGLNACLNTMERLIQENVAVLREDIEKLKRLMQEFEAELAALGARVDNLEGRVAFLEDHQFSTTTKLVGEVIFAVTGAGGSRSSDENQTVFQDRIRLSFNTSFSGEDLLVTRLSASTGTGTDRFTISKPDLRVINPNTGQPIGISLQENTLVNATATQTHQIGPRRDEQNNDVVIDWVGYYAPIQLLDNFKLDTYVAAWGGKWYDFVPTLNPFFEDFDGGKGSLSTFSQRNPIYRIGGGAGAGASLQLDWLKNVLGPTSISFGYLAGTPNSPCQNGRGDGTGCSDRLTTNPATGKPYAESDGGNGLFNGNYGALAQINTNIFDSVNIGFTYVHAYHKPDSPIFGEGINEGPGIVGTSIANGARSQLNNAFALGTVGEPGIPTPTFNGSGENALDGGEVNPFDWGGKVTNSYGISGTWRPYDWVNFSAFGSFHNVRYLGRGKAAELWTGGGGLAFPDLFKEGNLLGIFAGVQPYQGDSDRPTTAGYYLLPTQNPVTVEVFYRYQVTDNISLTPGVIWISKPEQFVNKEGSDGEVIGTLRGTFSF

SEQ ID NO: 9264 - protein, 962 aa, Cupriavidus taiwanensis
MPRSTWFKALLLLVALWAPLSQAETGWQPIQETIRKSDKDNRQYQAIRLDNGMVVLLVSDPQAVKSLSALVVPVGSLEDPEAYQGLAHYLEHMSLMGSKKYPQADSLAEYLKMHGGSHNASTAPYRTAFYLEVENDALPGAVDRLADAIAEPLLDKKYAERERNAVNAELTMARTRDGMRMAQVSAETINPAHPGSKFSGGNLETLSDKPGNPVQQALKDFHEKYYSANLMKAVIYSNKPLPELAKMAADTFGRVPNKESKKPEITVPVVTDAQKGIIIHYVPALPRKVLRVEFRIDNNSAKFRSKTDELITYLIGNRSPGTLSDWLQKQGLVEGISANSDPIVNGNSGVLAISASLTDKGLANRDQVVAAIFSYLNLLREKGIDKQYFDELANVLDIDFRYPSITRDMDYVEWLADTMIRVPVEHTLDAVNIADRYDAKAVKERLAMMTPQNARIWYISPKEPHNKTAYFVDAPYQVDKISAQTFADWQKKAADIALSLPELNPYIPDDFSLIKSEKKYDHPELIVDESNLRVVYAPSRYFASEPKADVSLILRNPKAMDSARNQVMFALNDYLAGLALDQLSNQASVGGISFSTNANNGLMVNANGYTQRLPQLFQALLEGYFSYTATEDQLEQAKSWYNQMMDSAEKGKAFEQAIMPAQMLSQVPYFSRDERRKILPSITLKEVLAYRDALKSGARPEFMVIGNMTEAQATTLARDVQKQLGADGSEWCRNKDVVVDKKQSVIFEKAGNSTDSALAAVFVPTGYDEYTSSAYSSLLGQIVQPWFYNQLRTEEQLGYAVFAFPMSVGRQWGMGFLLQSNDKQPSFLWERYKAFFPTAEAKLRAMKPDEFAQIQQAVITQMLQAPQTLGEEASKLSKDFDRGNMRFDSRDKIVAQIKLLTPQKLADFFHQAVVEPQGMAILSQISGSQNGKAEYVHPEGWKVWENVSALQQTMPLMSEKNE

SEQ ID NO: 9265 - protein, 843 aa, Cupriavidus taiwanensis
MRTKWTVLLWMLMISGLLAAQNTANTSFQVKGILLDSLTQEGEPYATIKIVKKEAPAKALKMLVTDMKGQFQEKVPGTGNFVMTITSVGRTPIVKDFSVKAGEKLVDFGTLYIVDASNELGQVEIVAQKPLVKADIDKIEYNVQDDPDAQSNSVLEMLRKVPLVTVDGEDNIQVNGSSSFKVYVNGKPNNMMSNNPTEVLKSMPANSIKHIEVITNPGPKYDAEGVGGILNIVTVGSGLEGYTATFSANVSNRGAGGGAFGTIKSGKLTVGARYNYNYNDQPRNYSSGSQHVTPEAVTENSSNLDYDGSNKGHGSFQSGSMEASYEIDTLRLVTMSFGLWGGGNKSNGSTDYIATFPENINAAPIYSYSAFNRSKSSWYSIDGGIDYQRLFKVKDRMLTFSYKINTRPQTSDSYTEYEIDNGYNPDWADYLNRLKNQHNDGEQNTTEHTFQADYTTPIGKLHTLEAGAKYILRNNSSEDDRFDADDTGKYEYNKDQSSHYKHLNDIIAAYLGYGLKVKRLSGRLGLRYEHTIQDVKYLVGRGEDFTKNFDDVVPSASIGYKLTDMSNLRLGYNMRIYRPGIWSLNPYLNDTDPSYISQGNPKLDSEKSHAFNLSYSNFTQKFNINISARYSFTNNSIENVTRLMPDTEIEGLKNPTGKDVLYSTYANIGKTRYASVNGYVNWNATPRTRIYMNMSGNYSYLEGSEGMRNDGWSLFAYGGAQQTLPHDWRISLNVFGQTPWIMLQGKGSSFFDYGLSVNKSFLDKRLTLSAFASNFFKKYMDQSSTTEGSGFIRESNYKYSRQRFGISVSYRIGELKASVKKAARTISNDDVKSGGSGSGGGGE

SEQ ID NO: 9266 - protein, 757 aa, Cupriavidus taiwanensis
MPNKFKLSSLALSIALSCHASNSWAEEQPSASSDNVEKIVVTGTFSGKSVAKEEASFAVSSFSEDDIKKLAPKSTADLFKAIPGVWAESSSGVAGANVFVRGFPGASDAPFLTVQLEGAPIFPPPTLSFLENSSMFRLDETVEFMEALRGGTNPVISNGQPGLTTNFLLKEGAEDTEGLVKYSTSDYGLQRLDAVVSGEIAEDLYIMVGGYIKSSPGVRDAGFNAEEGNQFTINITKELDNGKINFYTRQTDDHGTWYLPTPLDVEGVDNEFTQIGTLNRQAEIAYGPDGTTETIDFGQGRGWNGSVSGGSIDLEFNNGWVLVDRFSFTSGDADTYGLVPNGAAVKLSTVADNGSTAFGAVTGTEYSGDTDVQQIGRWVVKKEIEAFTNDFALTKTFDKGSVTAGLYNSTFSSKDWWSIGNQSYHVVAQGGENLTGIDCNDNADSCGWNYDLNGIGEGRTTALYLASSYEISDSVTIDAGLRRENHEIEYTVDEGLDGVITQAVSYDESSTAWTAGINWMFSEKQGIFFRASEGSKMPFFDDFRENYASYQNGDDLIKDVEQFELGYKHSSENFELYATGFFNEVNSTFAVSPEQAAVAFTNEAYGVEIDFNYFTDNGFSINLNATLQETEVTAHDDPAVIGKEAQRLPGYQVRVTPSYDIEFENGMYATLYGTLTAVDDRFSEQYNEKALILESYQKIDLGVIFNLTDEVKMQLAVNNLTDEEGLTEGDPRGVSGVLDNGRYILGRTIDFNVSYSF

SEQ ID NO: 9267 - protein, 810 aa, Cupriavidus taiwanensis
MKGTKSFLYWTQLGLTLLLFVDKLSFATAQEAQEGFENSLPPSSLKVKGKLPTEIEENSSFLLSPTKEFGPMDVLDTPRTVFIIDKPLIQATGMGLQPFLDPLSMSFLVPSAYSSVNYGLGIAPFSRGYPATPYINGIEMNIQNGAFQGIPMNWNMIDSFDFIEGPAQAVFGATQTSSGVCNYLTKQPYFDSFRSSAQFTTGMYEKYMWMVDMGGPIRPDLAYRVSYQGMENGNYYQYVHNDQQNIYFTLGFHPSDTYQADLIADLGTYDYTPLFMWMNRPTEALITNNLYLGGSVPSSSINVGTVNNPAFSLYAGPLEPISRRILLQNPEGEGRAILGLLQYVQKFQPSENLAILDNTLVWYNRESLLQPPVYYSLNSAGDYEIDHRTECLLHFHFDRNTFPFSLKGLLDGGIEWRIQRNLDYVASSFLGANSWDMVFSQPTSWNMNFSSFFRQNLANPHAKYGGLWPIPGAPPGFFFNPLNGSAGSTDSFFYSIAPFIQQTFSFNDHLALGLGLRDTNYFVQAETPPGTPPMLFKAFKTTQSDPLFSISPSYKPLEWLSIYLTYVLEYTTDAAVLGGYSPLFNSQSFHQEDELYEAGFKCNLIKNKLFIEGDGFSQILWLDNVGLKPTKTTVNGFELNMSYSPFKTLLLRIGYAYQYGTENWSAVSHGPFETQTYSTDYAQIFSLPLDNNGFFPPGLYPFIGWPKEVIDGMINYSPSQGLGFTLGLSWFSSQFLGYNYSTSIPPEFVIRGRITYSLPHCQLALYFYNLTGEKYWLPFGVGIQSARIFDYANIVPGMPFWIQATLSYFF

SEQ ID NO: 9268 - protein, 962 aa, Cupriavidus taiwanensis
MALKLSAKGLLALSIASILSTSAIAQRKIEEVVVTAEKTQATVSDTSISITAFTAENLDELGIQSADEMINYIPATTRDTYDIRIRGVGRNFRALGGDPGVATYYNGVYSPDFGIASSESGLYDLQRVEVLRGPQGTLYGRNSIGGAVNYITKKPTFDFEGEVRAQLGDYGTEEFYGVLSGPLIADKLAGRLVASQRDRDAWMEDVAGNDIDSTHDKNIAIALTWLPTDDIEINARVNDRISDRSVGGQVFINEGSGATRGTRSINEGVLGLREVAAGTVGAWSYTNPITGEEKWALNRRAGIDASEFPYNPNPAFNQNQLAGQTSGSKSDPNNLVAVNNEGGDCRVFPSTLNSCNAERFDHASGHVEAKWDISEQTSLRFIYGHTEFDYSYNQDIDYSNADFTKYRQTVLETVKSDSYEMQLDWAVGDSWTATTGIYYFDERRSQDYSLSDTTERYTQRFDFDDNVLSPGAAAFWAGLGVGVGNDGSFFGAYPNTPPTFDEVADHTSVLSKWAGDPRGDSFVQANSIENESSAIYTQGTYEFNEEFSLTVGVRWAEDKKTAVEKRRLRFEEDPQNIGADGNPSFLNYTLGALPGLTGQAGYDDTTGRTALAMLNVLYGRATWTADGIAPVCALDDAACATPLLLGGIPLAQTSATSGDDSWDDVNYRVNLDWTPTDDILMYFSVTTGYRAGGYSLGVTDARIATGPSGIVTEIDDPFSYGKETVISYEVGYKGLHLDGTLQLNGSIYRYEYDDYQDRLNVFDPVRGRSVNIVQNAPGATNTGLEVETLWYPTDELSIGANYSYTETEYSDEYLVVYQNDPDLPGSLFGNATTSPELYQRDANGSELKRIPKHKATVWGGYEWQTEMGAVTLRATYSYTGEMQSNGVEDELDLIPSRYQVDTSLAWRSVDEKWRARLFVDNVTDERNIREINTGNEGTNFRQTGTLLYPKYWGLDVAYKFGG

SEQ ID NO: 9269 - protein, 420 aa, Acinetobacter calcoaceticus
MELLHHFKPCNLAIATLFGLLTSSSLWATDTAQQSEDEWKFTLKNAYINRDFDNDALKDTGSWSQAASLFYKSKMHDTPLIIADKPITIGADASVQYAVRLSSDKHVADTVLPFNKETQSQASDFLKYGATLKLGYDKTLLSVGELWLDLPVTAVDASRQLLASYWGTNLKSQLSDQLYAEIGRVEKVSPRNEEDFKKFSFTANGMTKESDGLNYIDLRYQFTPSLKGEYYFGNLEDLYNKHYVGLEHNWKQPNFALTSKFKYFNAKDDGNTFDIDAQNIGVLETLKVKNHTFGLGYQQIIGESAYPLPDGFLPETYFINWNATGFFKEDERFYHVMYGYDFKDYVPGLNAMVKYVYGHDFKTANGEKNHETESNVILNYAFQQPLLKGFALQYIRIDYNVKHGNDFGEDRLFVNYTKKF

SEQ ID NO: 9270 - protein, 342 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTDSGWGNKQSFIGLKGGFGTVRAGNLNSILKSTGDNVNAWESGSTKDTGIENVLQVSKIGAREHRYASVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLADASNSHNSQTEVAATVAYRFGNVTPRVSYAHGFKGTVAKADGDNRYDQVVVGAEYDFSKRTSALVSAGWLQEGKGANKAVSTASTVGLRHKF

SEQ ID NO: 9271 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGADSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9272 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNEQSFIGLKGGFGTVRAGNLNSILKSTGDNVNAWESGKATKDVLQVSKIGAPEHRYVSVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9273 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKAVSTASTVGLRHKF

SEQ ID NO: 9274 - protein, 338 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAREHRYASVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9275 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHLYASVRYDSPEFAGFSGSVQYAPKDNSGKNGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9276 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTDSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKAGGDNRYDQVVVGAEYDFSKRTSALVSAGWLQEGKGAGKTVSTASTVGLRHKF

SEQ ID NO: 9277 - protein, 338 aa, Neisseria lactamica
MKKSLIALTLAALPVAAMADVTLYGTIKAGVETYRTVKHADGKVTEVKTGSEIADFGSKIGFKGQEDFGNGLKAIWQLEQNASIAGDKQGWGTKQSFIGLKGGFGTIRAGNLNSILKSTGNNVNAWESGKATEDVLQVSKISAPEHRYASVRYDSPEFAGFSGSVQYAPKDNSGKNGESYHVGLNYQNSGFFAQYAGLFQRHGEGTSAEKVGQSVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKAVSTASTVGLRHKF

SEQ ID NO: 9278 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKGNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9279 - protein, 338 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGKNGESYHVGLNYQNSGFFAQYAGLFQRHGEGTSAEKVGQPVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKAVSTASTVGLRHKF

SEQ ID NO: 9280 - protein, 337 aa, Neisseria lactamica
MKKSLIALTLAALPVAAMADVTLYGTIKAGVETYRTVKHADGKVTEVKTGSEIADFGSKIGFKGQEDLGNGLKAIWQLEQDASIAGDKQGWGTKQSFIGLKGGFGTIRAGNLNSILKSTGDNVNAWESGKATEDVLQVSKISDPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9281 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKDTVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9282 - protein, 337 aa, Neisseria lactamica
MKKSLIALTLAALPVAAMADVTLYGTIKAGVETYRTVKHTDGKVTEVKTGSEIADFGSKIGFKGQEDFGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9283 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDGGWGNKQSFIGLKGGFGTVRAGNLNSILKSTGDNVNAWESGKATDDVLQVSKIGAPEHRYASVRYDSPEFAGFSGSVQYAPKDNSGANGESYHVGVNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGANKTVSTASTVGLRHKF

SEQ ID NO: 9284 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9285 - protein, 338 aa, Neisseria lactamica
MKKSLIALTLAALPVAAMADVTLYGTIKAGVETYRTVKHADGKVTEVKTGSEIADFGSKIGFKGQEDFGNGLKAIWQLEQNASIAGDKQGWGTKQSFIGLKGGFGTIRAGNLNSILKSTGDNVNAWESGKATEDVLQVSKIGAREHRYVSVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9286 - protein, 338 aa, Neisseria lactamica
MKKSLIALTLAALPVAAMADVTLYGTIKAGVETYRTVKHADGKVTEVKTGSEIADFGSKIGFKGQEDFGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGKNGESYHVGLNYQNSGFFAQYAGLFQRHGEGTSAEKVGQPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9287 - protein, 342 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGADSGWGNKQSFIGLKGGFGTVRAGNLNSILKSTGDNVNAWESGSTKDTGIENVLQVSKIGAREHRYVSVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9288 - protein, 338 aa, Neisseria lactamica
MKKSLIALTLAALPVAAMADVTLYGTIKAGVETYRTVGHTEGKVTEVKTGSEIADFGSKIGFKGQEDLGNGLKAIWQLEQSASIAGTDKGWGNKQSFIGLKGGFGTVRAGNLNSILKSTGDNVNAWESGKATEDVLQVSKIGAREHRYASVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9289 - protein, 337 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9290 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9291 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9292 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTESGWGNKQSFIGLKGGFGTVRAGNLNSILKSTGDNVNAWESGKATEDVLQVSKIGAPEHRYASVRYDSPEFAGFSGSVQYAPKDNSGKNGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9293 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNEQSFIGLKGGFGTVRAGNLNSILKSTGDNVNAWESGKATEDVLQVSKISAPEHHYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9294 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNEQSFIGLKGGFGTVRAGNLNSILKSTGDNVNAWESGKATKDVLQVSKIGAPEHRYVSVRYDSPEFAGFSGSVQYAPKDNSGANGESYHVGLNYQNSGFFAQYAGLFQRHGEGTEATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9295 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNEQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9296 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNKQSFIGLKGGFGTVRAGNLNSILKSTGDNVNAWESGKATEDVLQVSKIGAPEHRYASVRYDSPEFAGFSGSVQYAPKDNSGKNGESYHVGLNYQNSGFFAQYAGLFQRHGEGTEATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9297 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9298 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGKNGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9299 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9300 - protein, 337 aa, Neisseria lactamica
MKKSLIALTLAALPVAAMADVTLYGTIKAGVETYRTVKHADGKVTEVKTGSEIADFGSKIGFEGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9301 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATDDVLQVSKIGAPEHRYASVRYDSPEFAGFSGSVQYAPKDNSGKNGESYHVGVNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9302 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9303 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGANGESYHVGLNYQNSGFFAQYAGLFQRHSEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9304 - protein, 338 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTSAEKVGQPVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKTVSTASTVGLRHKF

SEQ ID NO: 9305 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNKQSFIGLKGGFGTVRAGNLNSILKSTGDNVNAWESGKATKDVLQVSKIGAPEHHYVSVRYDSPEFAGFSGSVQYAPKDNSGANGESYHVGLNYQNSGFFAQYAGLFQRHGEGTEATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9306 - protein, 337 aa, Neisseria lactamica
MKKSLIALTLAALPVAAMADVTLYGTIKAGVETYRTVKHTDGKVTEVKTGSEIADFGSKIGFKGQEDFGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKDTVGEPVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKTVSTASTVGLRHKF

SEQ ID NO: 9307 - protein, 337 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9308 - protein, 338 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVNKIGAREHRYASVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9309 - protein, 337 aa, Neisseria lactamica
MKKSLIALTLAALPVAAMADVTLYGTIKAGVETYRTVKHAEGKGNEVKTGSEIADFGSKIGFRGQEDFGNGLKAIWQLEQNASIAGTDKGWGNKQSFIGLKGGFGTVRAGNLNSILKDTGGNVNAWESGSATEDVLQVSKIGAPEHRYASVRYDSPEFAGFSGSVQYAPKDNSGANGESYHVGLNYQNSGFFAQYAGLFQRHGEGTKATAGEPVEKLQVHRLVGGYDNDALYASVAVQQQDAKLTDASNSHNSQTEVAATVAYRFGNVTPRVSYAHGFKGTVAAADGDNRYDQVVVGAEYDFSKRTSALVSAGWLQEGKGANKAVSTASTVGLRHKF

SEQ ID NO: 9310 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTESGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9311 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIASTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9312 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9313 - protein, 337 aa, Neisseria lactamica
MKKSLIALTLAALPVAAMADVTLYGTIKAGVETYRTVKHTDGKVTEVKTGSEIADFGSKIGFEGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9314 - protein, 338 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGKNGESYHVGLNYQNSGFFAQYAGLFQRHGEGTSAEKVGQPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9315 - protein, 337 aa, Neisseria lactamica
MKKSLIALTLAALPVAAMADVTLYGTIKAGVETYRTVKHTDGKATEVKTGSEIADFGSKIGFQGQEDLGNGLKAIWQLEQSASIAGTNSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKDTVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9316 - protein, 338 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVNKIGARGHRYASVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9317 - protein, 230 aa, Neisseria lactamica
MKKSLYSVLALSTGMLLAGNAFAAVSGNIGGTSNYLWRGATQTNDAVAIQGGIDYSHDSGFYAGTWASNVDFGDDTSYELDLYAGYGGSITEDISYDFGYLYYAYPDAPGSIDFGELHAAVTWKWLELGYSHVINAGDDVAADPLDNKDLSYLAATVSVPLTEKLSLSVHYGYSSGDVVQSWFGEDNYADYNVTLSADTSMGTVSFMVSDTDLTDDDAKLVLGYSYSFDL

SEQ ID NO: 9318 - protein, 337 aa, Neisseria lactamica
MKKSLIALTLAALPVAAMADVTLYGTIKAGVETYRTVKHADGKVTEVKTGSEIADFGSKIGFKGQEDLGNGLKAIWQLEQNASIAGDKQGWGTKQSFIGLKGGFGTVRAGNLNSILKSTGDNVNAWESGKATEDVLQVNKIGAREHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9319 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTESGWGNKQSFIGLKGGFGTVRAGNLNSILKSTGDNVNAWESGKATDDVLQVSKISAPEHRYASVRYDSPEFAGFSGSVQYAPKDNSGKNGESYHVGVNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9320 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTDSGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9321 - protein, 338 aa, Neisseria lactamica
MKKSLIALTLAALPVAAMADVTLYGTIKAGVETYRTVKHADGKVTEVKTGSEIADFGSKIGFKGQEDFGNGLKAIWQLEQNASIAGDKQGWGTKQSFIGLKGGFGTIRAGNLNSILKSTGDNVNAWESGKATEDVLQVSKISAPEHRYASVRYDSPEFAGFSGSVQYAPKDNSGKNGESYHVGLNYQNSGFFAQYAGLFQRHGEGTSAEKVGQPVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKAVSTASTVGLRHKF

SEQ ID NO: 9322 - protein, 338 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGIDRGWGNKQSFIGLKGGFGTVRAGNLNSILKSTGDNVNAWESGKATEDVLQVNKIGAREHRYVSVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9323 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKISAPEHRYASVRYDSPEFAGFSGSVQYAPKDNSGVNGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9324 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNEQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9325 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTNSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASSSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9326 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKGNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9327 - protein, 327 aa, Neisseria lactamica
MKKSLIALTLAALPVAAMADVTLYGTIKAGVETYRFVAHNGAQASGVETATEIADLGSKIGFKGQEDLGNGLKAIWQLEQKAYVSGTNTGWGNRQSFIGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVATTVAYRFGNVTPRVSYAHGFKGSVYEANHDNTYDQVVVGAEYDFSKRTSALVSAGWLQEGKGAEKFVSTAGGVGLRHKF

SEQ ID NO: 9328 - protein, 337 aa, Neisseria lactamica
MKKSLIALTLAALPVAAMADVTLYGTIKAGVETYRTVKHTDGKVTEVKTGSEIADFGSKIGFKGQEDFGNGLKAIWQLEQNASIAGTDSGWGNKQSFIGLKGGFGTVRAGNLNSILKSTGDNVNAWESGKATEDVLQVSKIGAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLAAAPNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9329 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQNASIAGTDGGWGNKQSFIGLKGGFGTVRAGNLNSILKSTGDNVNAWESGKATEDVLQVSKIGAPEHRYASVRYDSPEFAGFSGSVQYAPKDNSGKNGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9330 - protein, 337 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTDGGWGNKQSFIGLKGGFGTVRAGNLNSILKSTGDNVNAWESGKATEDVLQVSKISAPEHRYASVRYDSPEFAGFSGSVQYAPKDNSGANGESYHVGLNYQNSGFFAQYAGLFQRHGEGTKATVGEPVEKLQVHRLVGGYDNDALYASVAVQQQDAKLTDASNSHNSQTEVAATVAYRFGNVTPRVSYAHGFKGTVAKADGDNRYDQVIVGAEYDFSKRTSALVSAGWLQEGKGANKAVSTASTVGLRHKF

SEQ ID NO: 9331 - protein, 338 aa, Neisseria lactamica
MKKSLIALTLAALPVAAMADVTLYGTIKAGVETYRTVKHTDGKVTEVKTGSEIADFGSKIGFKGQEDLGNGLKAIWQLEQSASIAGTDKGWGNKQSFIGLKGGFGTVRAGNLNSILKSTGDNVNAWESGEATKDVLQVSKIGAREHRYASVRYDSPEFAGFSGSVQYAPKDNSGKNGESYHVGLNYQNSGFFAQYAGLFQRHGEGTKADKVGEPVEKLQVHRLVGGYDNDALYASVAVQQQDAKLTDASNSHNSQTEVAATVAYRFGNVTPRVSYAHGFKGTVAKADGDNRYDQVVVGAEYDFSKRTSALVSAGWLQEGKGAGKTVSTASTVGLRHKF

SEQ ID NO: 9332 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSLPSLFVEKLQVHRLVGGYDNNALYASVAAQQQDAKLYGTWHANSHNSQTEVAATAAYRFGNLTPRVSYAHGFKGTVHSADYDNTYDQVVVGAEYDFSKRTSALVSAGWLQVGKGADKIVSTASAVVLRHKF

SEQ ID NO: 9333 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWHANSHNSQTEVAATAAYRFGNLTPRVSYAHGFKGSVHSADYDNTYDQVVVGAEYDFSKRTSALVSAGWLQVGKGADKIVSTASAVVLRHKF

SEQ ID NO: 9334 - protein, 329 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEGYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 9335 - protein, 331 aa, Neisseria gonorrhoeae
MADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSTPSLFVEKLQVHRLVGGYDNNALYVSVAAQQQDAKLYGAMSGNSHNSQTEVAATAAYRFGNVTPRVSYAHGFKGAVDSADHDNTYDQVVVGAEYDFSKRTSALVSAGWLQEGKGADKIVSTASAVVLRHKF

SEQ ID NO: 9336 - protein, 329 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNNGFFAQYAGLFQRYGEGTKKIEEYTYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 9337 - protein, 331 aa, Neisseria gonorrhoeae
TADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDDNVNAWESGKFTGNVLEISGMAKREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGATRVNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9338 - protein, 331 aa, Neisseria gonorrhoeae
TADVTLYGAIKAGVQTYRSVEHREGKVVGVETGSEISDFGSKIGFKGQEDLGNGLKAVWQLEQGASVAGANSGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKIESYQYNIPSLFVEKLQVHRLVGGYDNNALYVSVAAQQQDAKLYQNQLMRDNSHNSQTEVAATAAYRFGNVTPRVSYAHGFKGTVDSADRDNTYDQVVVGAEYDFSKRTSALVSAGWLQEGKGADKIVSTASAVVLRHKF

SEQ ID NO: 9339 - protein, 331 aa, Neisseria gonorrhoeae
TADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGATRVNSHNSQTEVAATAAYRFGNLTPRVSYAHGFKGTVDSANHDNTYDQVVVGAEYDFSKRTSALVSAGWLQEGKGADKIVSTASAVVLRHKF

SEQ ID NO: 9340 - protein, 332 aa, Neisseria gonorrhoeae
TADVTLYGAIKAGVQTYRSVEHTKGKVSSVETGSEIADFGSKIGFKGQEDLGNGLKAVWQLEQGASVAGTNTGWGNKQSFVGLKGGFGTIRAGSLNSPLKNTGANVNAWESGKYTSEFLEISKMAQREHRYLSVRYDSPEFAGFSGSVQYAPKDNSGSNGESYHVGLNYRNSGFFAQYAGLFQRYGEGTKKIEYEHQVYYSIPSLFVEKLQVHRLVGGYDNNALYVSVAAQQQDAKLYGATRANSHNSQTEVAATAAYRFGNVTPRVSYAHGFKGTVNSADHDNTYDQVVVGAEYDFSKRTSALVSAGWLQEGKGADKIVSTASAVVLRHKF

SEQ ID NO: 9341 - protein, 329 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNNGFFAQYAGLFQRYGEGTKKIEGYTYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 9342 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQAGKGADKIVSTASVVVLRHKF

SEQ ID NO: 9343 - protein, 331 aa, Neisseria gonorrhoeae
MADVTLYGAIKAGVQTYRSVKHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNMLEISGMAQREHRYLSVRYDSPEFAGFSGSVQYAPKDNSGSNGESYHVGLNYQNSGFFAQYAGLFQRYGEGTKKIEYDGQAYSTPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9344 - protein, 310 aa, Neisseria gonorrhoeae
MADVTLYGTIKAGVETSRSVAHHGAQADRVKTATEIADLGSKIGFKGQEDLGNGLKAIWQLEQKAYVSGTDTGWGNRQSFIGLKGGFGKVRVGRLNSVLKDTGGFNPWEGKSYYLGLSNIAQPEERRVSVRYDSPEFAGFSGSVQYVPNDNSGKNHSESYYAGFNYKNSGFFVQYAGFYKRHNYTTEKHQVHRLVGGYDHDALYASVAVQQQDAKLTWRNDNSHNSQTEVATTVAYRFGNVTPRVSYAHGFKGSVYDADNDNTYDQVVVGAEYDFSKRTSALVSAGWLQRGKGTEKFVATVGGVGLRHKF

SEQ ID NO: 9345 - protein, 331 aa, Neisseria gonorrhoeae
TADVTLYGAIKAGVQTYRSVEHREGKVVGVETGSEISDFGSKIGFKGQEDLGNGLKAVWQLEQGASVAGANSGWGNKQSFVGLKGGFGTIRAGSLNSPLKNTDANVNAWESGKFTGNVLEISGMAQREHRYLSVRYDSPEFAGFSGSVQYAPKDNSGSNGESYHVGLNYRNNGFFAQYAGLFQRYGEGTKKIESYQYNIPSLFVEKLQVHRLVGGYDNNALYVSVAAQQQDAKLYQNQLVRDNSHNSQTEVAATAAYRFGNVTPRVSYAHGFKGTVDSADHDNTYDQVVVGAEYDFSKRTSALVSAGWLQKGKGADKIVSTASAVVLRHKF

SEQ ID NO: 9346 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAGFSGSVQYAPKDNSGSNGESYHVGLNYRNGGFFAQYAGLFQRYGESTKKIEYDNQFYSVPSLFVEKLQVHRLVGGYDNNALYASVAAQQQDAKLYGTWHANSHNSQTEVAATAAYRFGNLTPRVSYAHGFKGSVHSADYDNTYDQVVVGAEYDFSKRTSALVSAGWLQEGKGADKIVSTASAVVLRHKF

SEQ ID NO: 9347 - protein, 331 aa, Neisseria gonorrhoeae
MADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQAYSTPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9348 - protein, 331 aa, Neisseria gonorrhoeae
MADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQTYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 9349 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYRTWHANSHNSQTEVAATAAYRFGNLTPRVSYAHGFKGSVHSADYDNTYDQVVVGAEYDFSKRTSALVSAGWLQVGKGADKIVSTASAVVLRHKF

SEQ ID NO: 9350 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVSGYDNNALYASVAAQQQDAKLYGTWHANSHNSQTEVAATAAYRFGNLTPRVSYAHGFKGSVHSADYDNTYDQVVVGAEYDFSKRTSALVSAGWLQVGKGADKIVSTASAVVLRHKF

SEQ ID NO: 9351 - protein, 243 aa, Neisseria gonorrhoeae
MADVGNREFSQVVDTVRVVVGLDGMLDNGWSWDTSVNFGRNDSVDRLANLINMGSVNTGITEGTFNPLDQASWSQENMTEYLYTGINSGGSEMFIVSADLSGEIMELPAGYLGFATGLEHRTEKAWFIPDSLTSQGMANDPKVEPTGGEYDVNEAYIEFAIPLLSGLPFAEQVDLSAAMRYFDYSTFGSDSTWKLGLTWRVTDDFMLRSVASTAFRAPSVDELYSGKSPSFDQVQHPVGQDQA

SEQ ID NO: 9352 - protein, 331 aa, Neisseria gonorrhoeae
MADVTLYGAIKAGVQTYRSVEHTGSKVSRVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQTYSIPSLFVEKLQVHRLVAGYDNNALYASVAAQQQDAKLYGATRVNSHNSQTEVAATAAYRFGNLTPRVSYAHGFKGTVDSANHDNTYDQVVVGAEYDFSKRTSALVSAGWLQEGKGADKIVSTASAVVLRHKF

SEQ ID NO: 9353 - protein, 331 aa, Neisseria gonorrhoeae
TADVTLYGAIKAGVQTYRSVEHTNGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKIVSTASAVVLRHKF

SEQ ID NO: 9354 - protein, 331 aa, Neisseria gonorrhoeae
TADVTLYGAIKAGVQTYRSVEHTNGKVSKVETGSEIADFGSKIGFKGQEDLGNGLKAVWQLEQGASVAGTNTGWGNKQSFVGLKGGFGTIRAGSLNSPLKNTDANVNAWESGKFTDNVLEISGMAQREHRYLSVRYDSPEFAGFSGSVQYAPKDNSGSNGESYHVGLNYRNSGFFAQYAGLFQRYGEGTKKIEYEHQVYSIPSLFVEKLQVHRLVGGYDNNALYVSVAAQQQDAKLYGARRDNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9355 - protein, 329 aa, Neisseria gonorrhoeae
TADVTLYGTIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEGYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSVGWLQEGKGADKIVSTASAVVLRHKF

SEQ ID NO: 9356 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSFPSLYVEKLQVHRLVGGYDNNALYASVAAQQQDAKLYGTWRANSHNSQTEVAATAAYRFGNLTPRVSYAHGFKGSVYSADYDNTYDQVVVGAEYDFSKRTSALVSVGWLQAGKGADKIVSTASAVVLRHKF

SEQ ID NO: 9357 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNAKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSFPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQAGKGADKIVSTASAVVLRHKF

SEQ ID NO: 9358 - protein, 329 aa, Neisseria gonorrhoeae
TADVTLYGTIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEDYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGANKIVSTASAVVLRHKF

SEQ ID NO: 9359 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSFPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQAGKGADKIVSTASAVVLRHKF

SEQ ID NO: 9360 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQAGKGADKIVSTASAVVLRHKF

SEQ ID NO: 9361 - protein, 331 aa, Neisseria gonorrhoeae
TADVTLYGAIKAGVQTYRSVEHREGKVVGVGTGSEISDFGSKIGFKGQEDLGNGLKAVWQLEQGASVAGTNSGWGNKQSFVGLKGGFGTIRVGSLNSPLKNTGSKVNAWESGKFTGNVLEISGMAEREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEYDFSKRTSALVSAGWLQKGKGADKIVSTASAVVLRHKF

SEQ ID NO: 9362 - protein, 330 aa, Neisseria gonorrhoeae
TADVTLYGTIKAGVQTYRSVEHIKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNNGFFAQYAGLFQRYGEGTKKIEGYTYYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 9363 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWDSGKFTGDVLEISGMAKREHRYLSVRYDSPEFAGFSGSVQYAPKDNSGSNGESYHVGLNYRNGGFFAQYAGLFQRYGEGTKKIEYDNQFYSFPSLYVEKLQVHRLVGGYDNNALYASVAAQQQDAKLYGTWRANSHNSQTEVAATAAYRFGNLTPRVSYAHGFKGSVYSADYDNTYDQVVVGAEYDFSKRTSALVSVGWLQAGKGADKIVSTASAVVLRHKF

SEQ ID NO: 9364 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTNDNVNAWESGKFTGDVLEISGMAKREHRYLSVRYDSPEFAGFSGSVQYAPKDNSGSNGESYHVGLNYRNGGFFAQYAGLFQRYGEGTKKIEYDDQSYSVPSLFVEKLQVHRLVGGYDNNALYASVAAQQQDAKLYGTWHANSHNSQTEVAATAAYRFGNLTPRVSYAHGFKGSVHSADYDNTYDQVVVGAEYDFSKRTSALVSAGWLQAGKGADKIVSTASAVVLRHKF

SEQ ID NO: 9365 - protein, 329 aa, Neisseria gonorrhoeae
TADVTLYGTIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEGYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 9366 - protein, 329 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEDYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 9367 - protein, 331 aa, Neisseria gonorrhoeae
TADVTLYGAIKAGVQTYRSVEHREGKVVGVETGSEISDFGSKIGFKGQEDLGNGLKAVWQLEQGASVAGTNTGWGNKQSFVGLKGGFGTIRVGSLNSPLKNTGANVNAWESGKYTGEFLEISKMAGREHRYLSARYDSPEFAGFSGSVQYAPKDNSGSNGESYHVGLNYRNGGFFAQYAGLFQRYGEGTKKIEYDSQSYSVPSLFVEKLQVHRLVGGYDNNALYASVAAQQQDAKLYGTWRANSHNSQTEVAATAAYRFGNLTPRVSYAHGFKGSVHSTDYDNTYDQVVVGAEYDFSKRTSALVSAGWLQEGKGAEKIVSTASAVVLRHKF

SEQ ID NO: 9368 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRVGSLNSPLKNTGANVNAWESGKYTGEFLEISKMARREHRYLSARYDSPEFAGFSGSVQYAPKDNSGSNGESYHVGLNYRNGGFFAQYAGLFQRYGEGTKKIEYDSQSYSVPSLFVEKLQVHRLVGGYDNNALYASVAAQQQDAKLYGTWRANSHNSQTEVAATAAYRFGNLTPRVSYAHGFKGSVHSTDHDNTYDQVVVGAEYDFSKRTSALVSAGWLQEGKGAEKIVSTASAVVLRHKF

SEQ ID NO: 9369 - protein, 331 aa, Neisseria gonorrhoeae
TADVTLYGAIKAGVQTYRSVKHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKTEYDDQTYSMPSLFVEKLQVHRLVGGYDNNALYVSVAAQQQDAKLYGATRVNSHNSQTEVAATAAYRFGNLTPRVSYAHGFKGTVDSANRDNTYDQVVVGAEYDFSKRTSALVSAGWLQEGKGADKIVSTASAVVLRHKF

SEQ ID NO: 9370 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTNDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEYDFSKRTSALVSAGWLQEGKGADKIVSTASAVVLRHKF

SEQ ID NO: 9371 - protein, 332 aa, Neisseria gonorrhoeae
TADVTLYGAIKAGVQTYRSVEHTNGKVSKVETGSEIADFGSKIGFKGQEDLGNGLKAVWQLEQGASVAGTNTGWGNKQSFVGLKGGFGTIRAGSLNSPLKNTDANVNAWESGKFTDNVLEISGMAQREHRYLSVRYDSPEFAGFSGSVQYAPKDNSGSNGESYHVGLNYRNSGFFAQYAGLFQRYGEGTKKIEYEEHQVYSIPSLFVEKLQVHRLVGGYDNNALYVSVAAQQQDAKLYGARRDNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9372 - protein, 331 aa, Neisseria gonorrhoeae
TADVTLYGAIKAGVQTYRSVEHTDGKVSKVETGSEIADFGSKIGFKGQEDLGNGLKTVWQLEQGASVAGTNTGWGNKQSFVGLKGGFGTIRAGSLNSPLKNTGANVNAWESGKFTGNVLEISRMAQREHRYLSVRYDSPEFAGFSGSVQYAPKDNSGSNGESYHVGLNYQNSGFFAQYAGLFQRYGEGTKKIEYDDQTYSIPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9373 - protein, 331 aa, Neisseria gonorrhoeae
MADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIKYDDQTYSIPSLFVEKLQVHRLVGGYDNNALYVSVAAQQQDAKLYGAMSGNSHNSQTEVAATAAYRFGNVTPRVSYAHGFKGTVDNANHDNTYDQVVVGAEYDFSKRTSALVSAGWLQEGKGADKIVSTASAVVLRHKF

SEQ ID NO: 9374 - protein, 331 aa, Neisseria gonorrhoeae
MADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSTPSLFVEKLQVHRLVGGYDNNALYVSVAAQQQDAKLYGAMSGNSHNSQTEVAATAAYRFGNVTPRVSYAHGFKGTVDSADYDNTYDQVVVGAEYDFSKRTSALVSAGWLQEGKGADKIVSTASAVVLRHKF

SEQ ID NO: 9375 - protein, 331 aa, Neisseria gonorrhoeae
TADVTLYGAIKAGVQTYRSVGHWEGKVVSVETGSEISDFGSKIGFKGQEDLGNGLKAVWQLEQGASVAGTNTGWGNKQSFIGLKGGFGTIRVGSLNSPLKNTGANVNAWESGKYTGKFLEISKMAEREHRYLSARYDSPEFAGFSGSVQYAPKDNSGSNGESYHVGLNYRNGGFFAQYAGLFQRYGEGTKKIEYDNQFYSIPSLLVEKLQVHRLVGGYDNNALYASVAAQQQDAKLYGTWRANSHNSRTEVAATAAYRFGNLAPRVSYAHGFKGSVHSADYDNTYDQVVVGAEYDFSKRTSALVSAGWLQEGKGADKIVSTASAVVLRHKF

SEQ ID NO: 9376 - protein, 373 aa, Neisseria gonorrhoeae
TAAPFVSDQAEAKGFVEDATLTETLKNYYFNRDNKNGGRDQKDWTQGFLGNFTSGYTQGTVGVGIDAYGYLALKLDGGDGTSGTGNMSRSDTVKANGYARDVNDSQGKAGASIKFRVSKTELKFGDMQPSTSPVFAVGGSRILPQTATGFQLQSSEVKDLDLEAGHFYSGSSQDKNARDGGLYATYAGVEANNIDYFGGKYSITDNLTASLYGAKLEDIWNQYYANVNLTTPFGGDTSLNTDFNIYRTTDTGSAEAGDISNTTFSLATALSFLKAHTFTLAFQKVNGDTPFDYIGVGKNNRGGDSIFLANSIQYSDFNGAGEKSVQARYDLKMAEYGVPGLSFMVRYVKGWDIDGTNTPAGSAYAGLYGEDGK

SEQ ID NO: 9377 - protein, 331 aa, Neisseria gonorrhoeae
TADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDDNVNAWESGKFTGNVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9378 - protein, 331 aa, Neisseria gonorrhoeae
TADVTLYGAIKAGVQTYRSVGHREGKVVSVETGSEISDFGSKIGFKGQEDLGNGLKAVWQLEQGASVAGTNSGWGNKQSFVGLKGGFGTIRAGSLNSPLKNTGANVNAWESGKYTSEFLEISKMAQREHRYLSVRYDSPEFAGFSGSVQYAPKDNSGSNGESYHVGLNYRNGGFFAQYAGLFQRYGEGTKKIEYDSQSYSIPSLFVEKLQVHRLVGGYDNNALYASVAAQQQDAKLYGTWRANSHNSQTEVAATAAYRFGNLTPRVSYAHGFKGSVHSTDYDNTYDQVVVGAEYDFSKRTSALVSAGWLQEGKGAEKIVSTASAVVLRHKF

SEQ ID NO: 9379 - protein, 333 aa, Neisseria gonorrhoeae
TADVTLYGTIKAGVQTYRSVEHTEEHTDGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEGYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGANKIVSTASAVVLRHKF

SEQ ID NO: 9380 - protein, 331 aa, Neisseria gonorrhoeae
TADVTLYGAIKAGVQTYRSVEHTDGKVSKVKTGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSIPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9381 - protein, 310 aa, Neisseria gonorrhoeae
MADVTLYGTIKAGVETSRSVAYHGAQADRVKTTTEIADLGSKIGFKGQEDLGNGLKAIWQLEQKAYVSGTKEGWGSRQSFIGLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFGNVTPRVSYAHGFKGSVYDADNDNTYDQVVVGAEYDFSKRTSALVSAGWLQRGKGTEKFVATVGGVGLRHKF

SEQ ID NO: 9382 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSTPSLSVEKLQVHRLVGGYDNNALYASVAAQQQDAKLYGTWRANSHNSQTEVAATAAYRFGNLTPRVSYAHGFKGTVHSADYDNTYDQVVVGAEYDFSKRTSALVSAGWLQEGKGADKIVSTASAVVLRHKF

SEQ ID NO: 9383 - protein, 331 aa, Neisseria gonorrhoeae
TADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKNNVNAWESGKFTGDVLEISGMAKREHRYLSVRYDSPEFAAFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYRTWHANSHNSQTEVAATAAYRFGNLTPRVSYAHGFKGSVHSADYDNTYDQVVVGAEYDFSKRTSALVSAGWLQVGKGADKIVSTASAVVLRHKF

SEQ ID NO: 9384 - protein, 331 aa, Neisseria gonorrhoeae
MADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQTYSTPSLFVEKLQVHRLVGGYDNNALYVSVAAQQQDAKLYGAMSGNSHNSQTEVAATAAYRFGNVTPRVSYAHGFKGTVDSADHDNTYDQVVVGAEYDFSKRTSALVSAGWLQEGKGADKIVSTASAVVLRHKF

SEQ ID NO: 9385 - protein, 331 aa, Neisseria gonorrhoeae
TADVTLYGAIKAGVQTYRSVEHTEGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDDQVYSIPSLFVEKLQVHRLVGGYDNNALYVSVAAQQQDAKLYGATRVNSHNSQTEVAATAAYRFGNLTPRVSYAHGFKGTVDSANHDNTYDQVVVGAEYDFSKRTSALVSAGWLQEGKGADKIVSTASAVVLRHKF

SEQ ID NO: 9386 - protein, 321 aa, Vibrio cholerae MZO-3
MKKLAAIISATLLFASSAAVAEVYVGGKVGKSWLDDACLAGQSCEDDDQVVGAFLGYQANKWLSLEAGYDYLGKFTAAGLNDEKVQAVTLAPKLSIPLTEGIALYGKVGGAYVDYGSKDDYSYLGAAGLEFNTNHNVTMRLEYQNLTDINNDIVRARAETATLGIAYKFGGSEEPAPVVEQRPAEPAPVAAPVEKVAVTKTFTFQHLDSSTFATASAELKPATVQKLDKIVGYLNQYPQAKVEVVGHTDSTGSEAYNQKLSERRAQAVAKALEAQGIDASRISAKGLGESSPIASNATAEGREKNRRVELVIPEFQYQVTE

SEQ ID NO: 9387 - protein, 687 aa, Vibrio cholerae MZO-3
MAALCPARVSVAENKKFKLHTLSAVMMGLFTGSFAYAETQNTSNQEQEMPVLVVIGEKTQRSIYETSASVEVFDQDTIERTPGATEIDDLLQLIPNLVDSGQSNNMPTIRGIDGSGPSVGGLASFAGTSPRLNMSIDGRSLTYSEIAFGPRSLWDMQQVEIYLGPQSYIQGRNTSAGAIVMKSNDPTHHFESAVKAGIGESDYSQTAGMISAPIIQDELAFRLSFDQQKRDSFVDLAAFEPAGDPKKIEMNSVRGKLLYEPSALDGFKTTLTLSHMDSRGPQTENINVAGNEAFRPVYETASFTTAWDIIWHLNDLFTFENNLVYADFSYDRYTNPNSRGDFNTDGKEFHIEPLLRYIALDGSVNALIGARYYQSSQDDMYIDAASAYPMDGRTKAKSVFAEVTYALTPSINVNLAGRFEREQVKRNVSHPRYKLDYDETSSVFLPKIDVAYTPVQGQTYGIKAAKGYNAGGAGLAFNSMQFTGFRPYEFEQESIWNYEFYTRHRFSHSVEVLTNLFYNDFDSMQMTQSTSSGDVFIANLDEASTYGAEIGSRWYATSSLELFANLGLLKTEFKETTGNTKELPRAPKMSANVGLLYDFGQGFEFSSNAAYTGSYFSESGNSEKFAIDSYWVANAQLAYVFEHGRATLYATNLLDSDKTTLYLSTNNTLDQLKQQPRMIGASVQLNF

SEQ ID NO: 9388 - protein, 729 aa, Desulfotignum balticum
MLTGCLIVPVTTFSAEKEGESVFSTLTITDNAQAETNHPGSSAETYTRPGAYSSRTLNENLQSLDASLRSMAGTYTQIDALQGAVNVNIRGMSGLGRVNTMVDGVTQTYYGMAPTTYHFGQNNGAGVLIDPNFLAGVDVTRGSSAGSQGVNALAGSANMRTLGIDDVIKAGRQTGVLSRFSVGDNGLGRTGMVTVAGKADPFDNGGLIGALVGISGSRTYATFDNGGGRSSSEFIGEDVKYMRQEPRSQLYKLNFDPNPYHHIEFAGRNYQNVFTRRDITSDDYYLRYNFAPLTELIDFNLLASTSRAEQDYKPESLYNFNNASTENKSNALDMSNTSRFRYADIDVAFLFGGKLMDTEYTRRFEQDNDTDRNAFVPSGKQKISSLYTGLTLNKSIYQLDLNLNYTRSKVSGIKPACDANEKCFPQGEATIDLDDKALNPSATLSAQVTPWLQPFVGWSRSSRAPNVQEVFFANEGGASMNPFLKPEKADTWQAGVNIVKEGLLTERDSFHMKALAYESRIKDYINSESFFLCYDGSRCKDIDNSASGFNANIYINTPSPVTSRGYEIEAGYDVGYAYVNVTWSKQQTDQPTSIASTSYSFAYDDMSDLPDYYATLDLGARFFDEKLVVGSLFKFTGKSKRLSTEGISIDSNTVPKESMPDIPTIVDLYSSYQVTDNVLLRLGVQNVTNRDYSEALNRMNQSLDNAVEGASLNTTARGRTWIAGGEIRF

SEQ ID NO: 9389 - protein, 678 aa, Desulfotignum balticum
MNKLLTLTPLAVAIGSSLVVPSAVASEETNSTPSATETIQVYGHQYEGYAEHMPQSGTKTDVEWLDVPQAVSVVTKTEMQDRGAVRLVDALDGVAGVNNTLGEGSRDQFMIRGFDSLNDMYRDGMRDDGTLQSYRSLANVERVEIVKGPAGALYGRGSAGGIINLVTKRANGENFTHVKGSVGSNSQYVGQVDSSMAFSDKVNGRINLEYRQADSYVDHVDSNDFFIAPTIRVLPADGHTIDIDVEYAHQELVPYRGVPSKNGKPVDLPVSTYFGGTNDYQESDSLRVAVDYEWRLSDQWVWNNRAAFNHIELEQKGTRQGKVTGNEVSQTVNNFGYDPRTTTTLQSELIWETNDNQLMLGADFNQIDIDLTLASDKTLPPQNIYNPVVGPTPDPGFKPFRDNTTITTGVYVQDVYTWGDLSVIGNVRYDSMDLEQQKAGAGKEKLDDDKVSYRAGLVYRINYDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKKPNDVSDHLFSLWSTYQLDDNWRLGGGVKYVGDRYAGNDEAVALGDYTTVDLMAAYTTGRHKIQANAYNILDEKYILGATNGTSGLNQIGYGAPAEFMLSYGYQF

SEQ ID NO: 9390 - protein, 241 aa, Desulfotignum balticum
MKFMKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSSDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 9391 - protein, 420 aa, Desulfotignum balticum
MKRVLVTSLFLLASAITFAGGYRVGLQGQRALAMGHTGVAYVNSAELAFFNPAGLVYLENKINASAGGFGVFSSVAWQNESTGQFANTDSPMGTPFYLYGSYTLNENLSLGLAVYTPYGSTVEWPTDWAGSHLVNNIELAAVFIQPLVSFKISDKFSVGGGPIFVTGNVNFNRNANRFLTDLEGNRSNVTIDDSGVTNWGYSVSAMFRASDNLTFGANYRSEIILESEDGTATFANFPNDSGQPIVVGGTGIPSNGTQGFNASLPLPAELTVGGSYSKDKWVVNFDYTRTFWSVYEDLDIVFADGSESINPRNYQDSSIYKFGFGYAASEKFMLRAGYYFDESPVQSGYFAPETPRNDSNGFSAGLSYAISNSFAIDASFLYVRFKEVNESYDYVDDGSSFGGTYKSSAFVPGIGLTYKL

SEQ ID NO: 9392 - protein, 186 aa, Rhizobium meliloti
MGTSKYIPAFLFVFTQLVGVGAASADTPQWLLTFKENVAETWQQPQHYDLYIPAITWHARFAYDKEKIEHYNERPWGGGFGQSRWDEKGNWHGLYAMAFKDSWNKWEPIAGYGWESTWRPLADENFHVGLGFTAGVTVRDNWNYIPIPVLLPLASVGYGPATFQMTYIPGTYNNGNVYFAWMRFQF

SEQ ID NO: 9393 - protein, 804 aa, Stenotrophomonas maltophilia
MKTPSPRRLRAAPLTPIAAALATLFAPAPLLAQELALGAVEVVAVAPLPGLDLPREQVPSNVQTVTSAALRAKQSVALPDFLGDRLPGVNINEIQGNPFQPDVNYRGFAASPLLGTPQGLSVYLDGVRVNEPFGDTVNWDLIPQMALDTVTLLPGSNPLYGLNTLGGALALRTKNGFDHPGGEAQVLWGSFQRRSLEVEHGGSHGDTGYYVAANLFKEEGWRDRSPSEVRQFFGKLTQRIDSGEIDLTLLRADTDLTGNGLAPESMLDQRRRAVFTHPDNTRNDMTMVALSGRYWLDDRNTLSASIYHRETRTRTLNGDANDDFEEGPNDGDCDPADFASGSPEEAQCAAANGAGGFNAETGANNRTRNIQRARGVALQWSHTADTHQLAVGVSHDRSKNRFSQTSQLGLLDASRGVVPTDDVELENSLDGETRTSSIYLTDTYALTPALHLTASARYNHTRVINHDRLDPTPPNLDGDFTYRKLNPALGLTWQASEQLTVYGGYSQGNRAPSPIELGCADPENPCTLPNALAADPFLKQVVTRTLELGVRGTVPGLLGDSLRWNAGLYRSVNHDDILFVGTSTSAGYFTNFGRTRRQGAELGLAGKHRGLDWALNYNYVDASFQSSACILAENNSSRGQSAECTADGQDDEILVKKGDTLPGIPRHSLKLMLSWQATEALRVGADFVAFSSQYARGNENNRHRSGDATDAFGETRTFEGSGKIAGYGVLNLNADYKLGGGWTLFGRVNNVFDRKYATGGALAENPFDAGGAFQTNSGDWARETFYAPGAPRAGWIGLRYRWGA

SEQ ID NO: 9394 - protein, 729 aa, Stenotrophomonas maltophilia
MNRCLRPNLLSLALCAALPLHASEADASPDAAATGAERSPTELAAVRVQAGKPKADTSRVNAFGGGSWKETPASVNVLERDYLDRRQVRSLSELASNDASLGDAYAPVGYYQNIAIRGFALDAATGYRFNGLSIAGEQRLALENVQSVEILKGEAGLAAGVMAPGGIINYIGKRPAEVRTVTLGTDSEGSRYAAVDVGHWITPRFGLRLNAAWDASNSYVEHADGRRNFYSLAADWLIGERGKLEVDANYQTSSQRSVSGYQLLGARELPHGVDREFLLGYQPWQRPVDIASTNITALHTYDFNDAWQSRVSVGHSRSVIDDNVAFAYGCYYATQCADGSVPGNYFAPNGDYDVYDYRSPDDTRRNQQARAELRGRFETGSVGHQLTLGADYFRRTVDKRPSVNEYVGTSNIHDAQVPVFEPSPKMPGPSARRLDSRQTAFFALDRMSFGDDWQWLAGGRFVRLDERAYDKRGTPQRHSRLSRFLPQTAVVWKATDQLNAYASYVRGISLGQEAPFWTSNADTFLPSVQSRQLEVGVKYVPVEALTLGAAVFRISQPYQYAKPDSSDVGYTFVEEGTQTHTGLELTANGQLTDALQIVASASVLQARARDTGTPAYEGHQLVNVPKVRASVHVAYALPFVQGLDVTGGWRYAGANVARADGGVRAPDYSVFDAGLRFQHRLHERAVTWNLSVDNVFNRFYWRDTGSSGGDYYLFPGAPRQARLSVTFAL

SEQ ID NO: 9395 - protein, 675 aa, Stenotrophomonas maltophilia
MSNYLKPLKLAVIAALAVNTQVVLAEVTPYALGEINVITTKQPENTRLYDSTITQEDMRLFNRETVGTALNMLPGISMTQGGQRNEQLVQLRGFDLRQVPVFVDGIPVYVTYDGYVDLGRFNTFDLSKIQLSKGFSSVLYGPNTLGGAINLVSRKPTKEFEGSITAGIKTDRNLKFNGYATDVNMGGNYETWYWQANTSYVDNERSRMSSDYKPNAYEDGGDRERAYNRDGKINLKIGLTPSEGNEYSLNYINQQGTKGSPVYAGRDSDRRANYWDWPKWDKESLYFISRTTFGNSAYLKVRAFYDKFRNVLESYDDARYATMTRPSSFTSIYNDDTYGASAELGFDIAKSNTLKFAAHYKHDKHEEHNKGNPVQTFKDRTISFGIEDTHHFNEKLSLVTGISYDKRDTIKAEGLNNSNQIYDFPNGDAHAWNPQAGLFYKPTEDSDIHFTVARKSRFATMKDRFSGRFGRAVPNPGLDTERATHYELGAGAFVLPELKLQGAVFFIDTKDMIQSVSLPNSACSAGGGECFQFRNIGKVESHGIELSATWFATNNIELGGNYTFINRDNLSNDQRLTDVPRQKLFAYGKWKVNSALQVLASVEAASSRYSRQNATVTDWLSAKGYATGNIKAMYAVNTDWFAEAGINNILDKNYAYTEGFYMEGRNIFVNVTRKF

SEQ ID NO: 9396 - protein, 710 aa, Stenotrophomonas maltophilia
MPAHLPLKRSPLALYTSLFCLGLMSQTAVAADASIERIIVTGSRSAESIEEVPSSVTLIDNKTLAQDMLITSELQNMLAFRVPGMAPSTGTSSNAGQTLRGRKALVMIDGVPQSTPLRNGSLGIRSIDPSAIERIEVIKGATSIYGNGASGGIINYITKTPSSDAKASVELGASSKFSAVKFEDSAGYRYHASVDGTLDKFSYVVSAAEEETGLEYDAEGDIIGLIYGLSETKSQNLFTKLAYEFDSEKQVQLTYNYYEAQQNADLMDVTGSVNSGEKTYAIKSSEPKPGVPQGPRGNHNLMLKYTDQEIFNQTQLTLDAYYQKIENMFFYSAALANPSEGYDGGQSLIRSEKRGLRVNLNSYADWDNVSASFIYGIDALNDVSSQPLNDGRIWVPEMDMSNLAGYLQTKLTIHDDWIVKAGVRHDRVDIAIDDYKTLKVCRSADTCSVPFDVKGGELNFTSTTYNLGLRYQLADAFSPFASFSQGADISDLGRLLRTATVNDISLIQTEASIVDNYEVGFSGHYDKLSYELAAYRSTSELGTSNAYDAATGVYMPVRAPQKIWGYEAQLAYQWLDNLATDISYSWVEGKDTEKDIYLDGQVISAPKFTASINWQPIDDANIAINYLYVGDRKRFETVDGQYVGAQGPVNHYNLVNLSSSYQLDNWQFSLGVENLLNEDYYSARSQAFTYAGYNTKGLGTTINLGVKTRF

SEQ ID NO: 9397 - protein, 212 aa, Stenotrophomonas maltophilia
MRMLTTTLMASAMALVAFQAAHAADVVDEIPAAPAAEYTEPAVRNWSGAYVGGTIDWHHGEADATGNNKSVGTGGGLYGGYNVQDGQMVYGGEADINYTGNDSHSSGRRVQQGLNGSVRARVGVDVNPVLVYGTAGVALGNAELKTPAGSDDKTLVGWTAGVGAETFVTDNITARAEYRYTDYGSKDFRTGGTTISSGYDEHAVKLGMGVKF

SEQ ID NO: 9398 - protein, 741 aa, Stenotrophomonas maltophilia
MHGLFRPHFAGRWNAAAFAWCLVCVPVAPAAEVPHLAELERPATEAGLLTQQPLPEPPSKAPAPGSTPAEPVSNFVLEDVNVTANRRTQSDLSTPLAITVIPKEEIDRRRARATTIADLLNTVPNFSQSFTGGRFISQPRLRGGLGGRGSQSGLLILVDGIRRNNTNGTEDYLLDFPVDQIERIEVIRGAASVLYGTEAVDGVINLITRRGVTEQTARLSANFDFGSSETFRTGIGLSGKAGNLRYLTRFSSQNVGDYLDATGKTQVRNRFDSQNYLARLTYEFDNKSELEFEFLASRTQNLLLPIVSDSGAVFDFSFPYRNRDQYAFTYRNANLLGSEFQARLYYTGFERNFRNNIFLEAGPGALIPTSLQDQRPILTSLGGIAQFVSTLGAAKLTWGLDAYNESYSNNDTELTGGVADSTPQRPSGSQRSIAPFAQAAVPIAAGLNLTAGLRWDNYRQAAQATALNPVCPLPFLPPGVPCPFPLPPDSFPGNVRETSELIPAAGLTWEFAPGYALRASYGRAIRNPNFFELYGGPQSVGVTLGNPGLTTERSETYDIGIRVRQGRLRADIGYFLSNFDNKIVAQALPEFGGLVLLPANIRRVQGYGYEAEASWEIVDGLTVFGSYGTVTAYDQDTGTRIGSAQGYQLVPASASIGLRFQERSGFYAQAILRNVPSYFATAPAGQGNGFTVLDFDLGVPLSGATRLGIGVTNLTDALYREPFTTFNAPGAQIFASLATEF

SEQ ID NO: 9399 - protein, 577 aa, Stenotrophomonas maltophilia
MYRTTGVGLLLSLLSTTASAADLSPIARLNYPVPPIFSWTGAYAGLFTGYGSLDSNTKFICTAPGRQAGAPECPILPSRRASDASFIGGGEVGYNWQTPSGLVAGAAADYQFTRLWGYGRQEGDFKTVDGSVFFDSVAHSGQRLDDLATFRGKIGFSVDQTFIYVTGGLAVGHVRIDNNLNLSIKPDAAPAAAFDGRGGAVRLGYVAGMGIEHAFSERLSAKVEGLYYNLGSRAVVPDQTSGGELPGYRAGTRIATDGFLARVGLNYRFSAGRPNLPLDGPIGPPIWGFEGGARYFYSSGSPRETLGDSFVPGQSNSRLIYKDAQAHAGESFARLEHNPSGLFAKGFLGSGGVTGGRLSDEDFPPSYKPYSKTLHSIKDGDVSYGVIDFGYDVLRRDGFKIGGFLGYQYFSELYNGYGCRQVATHPSCTIPEPNNKKSLGENMQWNAMRVGVIGEARFGRVRLSLEGAYLPVVALDGVDRHWNRPDINPGPEGGRGDGYFLEGIVSYDLTPSVSIGVGGRYWRMQTDKAQTTGFPFAPPSPMKFETARYGGFAQLSYRLADFGFGGGAIESVLARNN

SEQ ID NO: 9400 - protein, 985 aa, Stenotrophomonas maltophilia
MKLNSNKLRDAVCVALAASAASVAGTGTALAQQATNLDRIEVTGSRIRTVDVETAQPVLTLNRADIEKQGFSSVADILQNISAVGSPPISRAQPLSSGEAVGGTYISLRDLGATRTLVLLNGKRLGITTGGLQDISTVPVSAIERIEVLKDGASSIYGSDAIAGVINIITRTNFEGATGSVYYGQYSEGDGATRTMDFTMGVKGERGSLTIGAEYAKEDKVRAADRPYGAFPRSANHPDFGWTTVGEFGGFVSRPADGLPGVTYPAASAGNPNREVRVILREGGNPNNKADYVAQNVNSLVTKDKTNTNLQTDLRTPQERRAVFVDGIYDLTDNVRLRTNMLYSYRDSNRQIAGYPYQALAFTSPMSATSAFNPLGTEISNWWRRTLEVPRNTRAELTTFRFSGGLEGSFEFADRLFDWDVGYLYNNNKLVQTSTGDLNLTALRAAVGPSFINSSGVAQCGTAASPIPLNQCVPYNPFLRAGIPSNGANGALTGNDALQKLLFPAAHSTAETTTKVVTANLAGSLFTLPAGDLGFAVGIEHRKETGSFSPDALVQSGNTSGLANFPTGGGYKVDEVYAEFNIPILADLPGARELSLNAATRHSDYDTFGTTLNSKFGFKWKPVDSVLIRGTWAEGFRAPTIADLYSGGSQSFDFYTDPCDSVYGAARTNAAVRARCAAALPAGVNVANFRQQQQGFTPTTAASSQTPLAFVSGSNDQLTPETSTSKTLGVVWSPGFIQNFNMSLDWWEIRVENTIIADTANLILNDCYLNDIASRCSAFTRDPVTGIVNNLNRTGINAGYREVEGFDLDVSYRLPTDRFGNFSAQWTSTYTSRDDLVTTKNPVTHPNPRTGVGWAGGAFRVRSNLNLGWEMGDFGASWTVRYFSGMKESCLSAVTFPEECNLPNYASPNNQGVAVGSATNQRGATVFNDVQLRWSAPWNATVAVGANNVFGRVGPTMYSQPNANVSYYGGFDIGRFLYMKYTQRF

SEQ ID NO: 9401 - protein, 236 aa, Stenotrophomonas maltophilia
MERTVLGGSGSIPRGASLAMPAILLAALLSAGPAAAADLGRPTQPAIPAAVPAPVFSWTGFYIGGNAGYGWGSGQDELGVAGVDPKGWFGGGQAGYNYQFSNNIVAGIEADIQGGDIGASASGPLGGQLGVLGLSSTLDSFGTVRGRLGYAFGPILPYVTGGFAWGNNSIDYLGASQSQTHTGWTAGAGIEYALTDHWTAKTEYLYTDLGSKFYDTLGASAGVTAQTARIGINYKF

SEQ ID NO: 9402 - protein, 728 aa, Stenotrophomonas maltophilia
MRSIPTVVSAFVAVSVAPISTDAIAQEIALEEGRRPKALRVAPTDRAPIGTFELGELSTVLSEISVSGSGRESGGLPTPSQSVVTARDVYTFNKNTLDDALTVVPGVSAANSGGSRNERLIFVRGFDRFQVPLSIDGIRVYLPADNRLDFGRFLTPDLAEIQVQKGYVTVLNGPGGMGGAINLVTRKPVRAAEAEFRTGVEVGNRGIPTAFTGFGLIGTRQENYYLQASGTIRDSNGWFLSQGFRPVPIGNGPPIEDGGRRDFSAVDDYRVNLKAALTPNATDEYSLSYTKQSGAKGAPYSVFEPVSGITPMPLPRGTAFQRDWRWPYWDIDSLYFLSRTAIGDKSYLLGRAYHNSFNNLLSAFDNASLSSQRLPRSFDSFYDDTAYGGSIEFGTELIPLNTLKFAAHYRRDTHTERQFPAPGLPSSVIEPRQTSQEDTYSVAVENTFHATDQLDLVAGLSYDRNALRRAQDYNASTRALFSYPLGSTDAVNWQTAAIYRTSETGRVHASVSSRTRFPNLFERFSTRFGDAVPNPDLRPERATNYEVGWSELFLGSLRLSPAVFYSDIEDAIQSVSIGNNQIQNQNVGTGRTYGYEVASELTLSPELFVGANYTFLIRELNDPLRPALKPTGTPRHQAFVWATWQATPALSFTPSVEAASGRFSTDRLENNFFKTGGYVLVNLQAQYALDAHATAAIGVRNLFDHNYSLAYGFPEAGRTVFANVRMTF

SEQ ID NO: 9403 - protein, 683 aa, Stenotrophomonas maltophilia
MRPTLPYSLLALFVAGTTQAANRVELDQVLIQDQQQSELETAADRLREIPGASNLVDMDKVGQGRVASNQDVLAYQPGVFAQSAGNDGIKLSIRGSGINRAPGAHGSGVYTMFDGLPLTGPGGTPYELFEPLWLSRAEVLRGANGFDQGSLALGGAINYVTHTGYDAAPLQVRYEAGSRGYQRRHISSGQVLGNLDYYIALTDAEYDGYQHHSSGSAKGMAANVGYRFNPNLETRFYLRYRETENDLAGRLTKDQIKHHPRAANPAYLARDDSRPQPGSTWVGNKTTFFLDDDSRLEAGLVYHDYPMDLREGPMRLKVAYSDVSGTLNYLRRDTLFGHESKTTIGWRTTKHLPNSGASQFARPSGDNFGARTRDFSYQGSDTVLHAGNDLELVPDLWLTTGLAMIYTRRESDVTYPTTGGKVSQHDWDYAPRLGLRYDIHPDLQVYGNLSRSVEPPHPWSLVWSAPVANQPMKMQNQTATTLELGARGDSVLGHWDLAWYYAQVRHELLNVEVVQGLPFKEFNASPTVHQGIEAGLDSLLWEQPGTGKLSLRQAYTFSDFHYRDDDKFGDNRLPGIPMHYYQAELRYDWPSGFYAGVNTQMASKVQVDYANSYHADAYALLGARLGWDSPKQDWQTWLDLRNLTNKRYAATVTPGYNDAGQDIARSTPGEGFGVYTGVSYSFR

SEQ ID NO: 9404 - protein, 812 aa, Stenotrophomonas maltophilia
MNHPLFKSSTLSKAVLLGLAMSLTPTISAQESATQETADVERIEVTGSLGSLPGQGVEAVFGFGKSILETPRSASTISDEMLERFAVTDIDDLVAFSPGTFTQSFFGVAGSLDVRGTPGETYFRGVKRLDNPGNYPTPIGASSRIDIVRGPASPIYGPAKIGGYLNFNPKSARASGGQYLEENEGAFSYTLGSWDKSVMTAEIGGPATLGGKEAGFYLYGEVENSGSYYENSGTDQTVLQGSFNIDVTDNLRFEFGGMYHDYDGNQVAGWNRLTQDLIDNGTYITGTAKNIDTDGSGAISHEEYGAVNLAGNGFFYAVPSLFTDADATDLMQLENVGTTTLGRNQVLVAADDVLQNTVQTLYFDAIYYSDNGWEIKNQFFYEDYENLNENAYGFSQFHNSSVVENKLIFSTEYETNSLLAQFQVSPSIRHTNFLHGDDFTYEYFNRRDLTMESTALDRREMATRINDNYDNYDKGNYTDYGIAAMTDLTWDWGLNIVLGLRYDTIDIETTSRGDLLLEKGDILSTSETVDGTSWNTSISYKTEFGLIPYVTLAEQATLVAGQGAEIGYGQLIDDEGNSYNGAFDTSELTEFGVKGSFLDDSLYFALSVYEQERSDFNAQAIVTNATTQNKGTEFELRWVVNDQLVVGAGYTKMKVYNLTAYNDGNGGSLFGFLGAEDLTSLTDPSLVFGGNPVGLTLIPEGASKESARKAGIPENIYTLNATYDFLNGYAASASIVRADETYSSFSQSVKLPSYTLVNAGVTYTTDTWSASLNIKNLTDEEYYRANFPDLFGAQIVLPELPRHYQASVSYKF

SEQ ID NO: 9405 - protein, 1058 aa, Stenotrophomonas maltophilia
MKLHANVCSQWEWTKLRQLLVIVLLGLGIVSTYGQTKTVSGIVKSESGGEPLVGATVKVKETNTGGITDIDGRYTIQANLGQTLIVSYIGYRTKEVKVERTIRIDILLQEDNEMLDEVVVVGYGTMKRSDLTGSVVSVTGDELKKSVVTSLDQALQGRAAGVQVTQNSGTPGGGISVSIRGINSLNGNEPLYVIDGVAISGNNTSNSSVLSSINPADIVSMEVLKDASATAIYGSRASNGVVLITTRQGEEGKTKVSYEGYYALQQLPKKLETLTLPEYAVYQNLRAATIGFGAREEFKDPSLLSRGTDWQNEIFRTAPMHNHQINISGGSKSMKYSLSGGYMQQDGIVFGSDFERFSFRVNMDNDINKWLTTGLRASVARTQQTNNVDGSGAIYNALNQLPEVPARNPDGSFGMQTENMYGTYFSNPLSDLIQNENYSRNTQVYVNAFADIKLWKGLVFRTEYAANFNYSNDYKFTPSYDYEHFKQQSSASRGAGNGSNWTLKTYFTYNNTFGKHGLSAMLGHEAQENKYESLSGSRTNFLFNSVHELDAGDATTAKANSSRGSSAIESYFGRLNYNYNDRYLLTATLRADGSSSFAKESRWGWFPSVALAWKVNNEAFLKDVEAINSLKLRLGWGVVGNQWAGSYAYGVTMASAASIWGTGFYAGNYPNRELKWEETNSFNVGLDLALFNNRIEFIADAYYKKTDNLLMQASLPTYVSGLIRAPWVNAGAMTNKGVEFTLNTHNIQTRDFTWTSGLTFSINHNEVTKLYSESSAISGINGSETLTYTMVGEPVGQFYGYKVIGMFKEEGDFYKKGADGNFLLDETGNRIQVAIPKDQTIGKSGIWVGDYIYEDRDNNGVIDEKDRTFLGNPAPKFTFGFNNYLSYKGFDLNIFLNGSVGNKAINLIRRTFTDPMRNSNLLKEATGIAQIAMHDPEVGDEVLSNVYVANADAAKVQRITTSSANDNNRISDRFVEDASYLRIKNISLGYTFPQKWLRRLQIDHLRLYVNIQNLCTITGYKGYDPEIGALNYNVLLRGVDDARYPSQRIYTFGLNFNF

SEQ ID NO: 9406 - protein, 908 aa, Stenotrophomonas maltophilia
MSASHKALRPRPLVLALSSLMLVSLPAFAQESAPTTLQEVKVTGSRIPRASVEGPSPVTVISREQIDAQGYRNAFDALSALTENTGNVQGEDFGNTFTPAANTINLRGLGPNRTLVLVNGRRQADYPLAYEGSVNVVNLANIPSALIERIEVLAAGASAVYGSDAIAGVVNIILKDRFEGVDVNVRAGGTQQGGGDNQRAQVVGGSSGERWDALFGFEFDVRKAIHARQRDFMDSLDDDPAGKAPQATAIAYRRNAATGRNIDPGVTGCDGASDIYGGSVFRAFNPRQGWYCGSNEAAASYWTVQTQKRNLNGYGLLTFHVNETTDLFADVAVGSARIYNNTRAPTWTSARNYFYNQTTGNLESWYRRFAPEEIGGLPRNANRFLENSWSFNVGARGQIGDSGWDYEAVYSRSRYENSTRRPVLLAGINEYLLGPKLGVRNGVEVYAPDPARLFQPLTPNEYEGLSDYQESRNAAWLQTFSASVNGRLFALPGGDAALAAVVEAGSQGYRNRPDPRLGSGEFWNTSAGIGAGGERDRYAAGVELQLPLLQSLTTTLAGRYDQYRAGGEHIGKATWSFGVEFRPIESLLIRGSAATSFRAPDMNYVFATETRGYNPGMTDYWRCRTAGQSYDNCDYNGLSIDYSNRANAQLQPESAKSYGFGVVWSPLSGLDFSADYYDIRIDNEVTSLDTSRILRDEADCRLGRTLGGEARDIGSPLCQDALSRVIRNPSNATVQPDQVTRVLINPINAASESVRGLDLKGNWRFDAGRYGRFTTRLAYTVVLEHKYRQFSDDPERDIRNSLDDYQWRSKANGSITWNQGDWTTTLYGNRFGSLPKTDGSGRIAPYMTYNASVFRQFGENLSVGVIVNNLRDSRPPADKNGGGWPFYPVGNYDPYGRQYWVQLDYRFR

SEQ ID NO: 9407 - protein, 123 aa, Stenotrophomonas maltophilia
MMDIVFIEQLSVITTIGVYDWEQTIEQKLVFDIEMAWDNRKAAKSDDVADCLSYADIAETVVSHVEGARFALVERVAEEVAELLLARFNSPWVRIKLSKPGAVARAANVGVIIERGNNLKENN

SEQ ID NO: 9408 - protein, 491 aa, Stenotrophomonas maltophilia
MTGRSWAPHGAISLVCLTALFAPRMAEAADLPVKAQATENVKVCAAYGPGFYYIPGTDTCLRVGGWARMDTYMNVAAIFSQGSAFGGPGYSPFAFPFRDAHDADYFTQGRGVAEIDARTQTDYGTLRSYFRGGAEWDSQSGPGKGPGPALYIERAFIQFGGLTFGYTQSFFDTGIGYSIATLFAGSNTWNTTAAYTAEFGNGFSASLAVEDAANRTTGVQATGVSITGVTSPSDFPFVSGGTGAPLLYSNYQAGQQTPDFVANLRAEGAWGMVQLAGALHQVEAMPPAYLGSAFIGSSSTGQWGYALGAYTEIRLPFIAAGDSLYLQANYSEGALNYAGLAAGNQNRLQAIGYIPLNSVGLMSGAYYPLADAVMGPDGSYEMVGAWAIQGQFRHFWVPQVRSAVFGGYVSVDVPTNVVGAASFAMWQAGVNTFWSPVRNLDIGAEVVYTAVDGSRPLGITNAVSASGGVIPTLVGGSANAVSGAVRIQRNF

SEQ ID NO: 9409 - protein, 952 aa, Stenotrophomonas maltophilia
MSLKTNPLRNAIVIALAASCTTPAFAQSAGDTPTNLDRIEITGSRIRQASVETAQPVVALSRAEIEKKGYINVADILQDVTAAGAPSLSRSSSLSSSRDFGGTYVSLRNLGPERSLVLIDGRRMGVSAGGYSDLASIPSAIVERVEVLTDGASALYGSDAIAGVVNIITRKNFDGGEASVYVGQYGEGDGQKRSYSATFGKTFDRGWFSVGAERTKEDEILGSEREFSRYPGGPRHPDDVKALNQTTQWGSVTVDGKSLTVGPGGDPSQKGNFHTPDPADGANTKTNMSLLSGMERTSVFANGGFSITDDLRIVADALYSKRESTKHLAGYPYSVSTAQARNGSRAALSKDSAFNHWGQDVLFSHRTEEMPRATENNLDTKRASIGLEGSFETGSRYWDWNVSYMYNRNEGERIGTGSMYQPHVDLAVGPSFMDGTVARCGSPGAVIAGCVPWNPAAPMGYAGPGSLSNQDVQDYLFTRFVDKMKSTTKVASANISGSVFSLPAGDVMAAMGFEHRSEEASYTPDLMVQKGQIAGTTGQPTRGDYSLNEVYLELQVPLLADMPFARELSLDLAGRYTDYNTFGSTTNSKFGLKWKPIDSLLVRATYGTGFRAPTVDDLYSGGAKSRDSFTDPCDTSFGIAASSATVAARCQALKVPANFRQQTASEGNVANRPGQQGIADFDSGSNANLKPETAKTWTVGLVYSPEFVPGLDVSLDWWKIRIDNAIVGESATDILNQCYVQGVDSACGRFTRSTSAKTLGQVTALDRSLVNAGYRETAGYDFSLRYRLPETSFGRFAATWNTTYTDYLEQRNDSAATTPVEQKTGWQGNFRVRSTFNLDWQYGDLGIGWTARYYSGMKEACSYDLGGGPDCNMAGFVSPYTDAQPSRKVGSNTFHDLQVRYSLPWDGTVSLGVNNVFDHQGPIMYSQPNSSFTYYGGFDIGRFMYMKYQQRF

SEQ ID NO: 9410 - protein, 1081 aa, Stenotrophomonas maltophilia
MTHPLRMSKLTLGLVAALAAAPAFAQSTSAGVGGQVMSAAGQPVAGAEVTITHTESGTVSRATTDASGRYNARGLRVGGPYTITITKSGEGTKTEEGVFLNLNQVNTINANLGGDLAATNLDAVNVVATAGGLDLFSATKMGTGTNVTRETMDALPSANRNIQDYIRLDPRISQVSKADGAISAGGQNTRYNAIRIDGISASDPFGLGSNNLPTERQPVSMDAIQEINIDLANYDTTIAGGTGAVINAVTKSGTNEFHGTVYGSYRDKDMVRSRLEGDRTDFNGFKDEKTYGMTLGGPIVKDKLFFFTNYEKYERSGGGVSLGDSPYNKAGGISDADIARVQKRMSDLGYPVGGIGALDNKTEIEEYAVKLDWNINENHRAALRYNKMKQDVVRFPQVNNSAISLSDFWYTQPTEYETWMGELFSDWSENFSTEFKVSHKDYSSNRVAASHLPQIRVRFGNNSLYLGTEQNTHTNLVESKELSAFGAGTWYIGDHTVKFGFDYTDNDLMNFYGRNLYGAYEFADLAAFEAGTPSAYQVRVPRAGGSVDDIPAKFHLKNTGLFIQDTWAINYNLSLMFGVRVDMPDFSTQRLYNPRIEQLYGFNNTQLVDKKLIQPRVGFNYTFDSDRPTQLRGGVGLFGGAAPNVWLAGAYQNTGLNYSEYNLTRNPGGFSFDADNPFIPNPSLASARQNVDLIAPGTRLPSVWKANLAFDHELPWYGIVASAELLVTKVKDGLYFDRLDVMTPNAKRSVGQDGRALYWNDYGMNGANAGPNGMQAGQKNGRACAATDLTCPGDRVNRPGDIGDVILLRNTDKGRGSQATFSLAKPLTENWGWSLGYTYTQSKEVSPLTSSQNTSNWNNTLSLNANDNVAYNSRYAIKDRITGTLEWKHNFFGDNATRVGLFYEGRSGRPYSYVYYNDVNGDGAGTNDLFYVPKGPGDVLFTGGADMEKKFFDWLAQNPELEAYRGSTVPANAHRAKWVNSFDVRISQEFPGFAKTHKGEIALDIMNVGNLLNKKWGLIDDYGFYATRRVANYSGIDPATGKYLYNFTGRTDNSSIQENNNDKGNTAVSRWSMQLTVKYKF

SEQ ID NO: 9411 - protein, 712 aa, Stenotrophomonas maltophilia
MPLPHPRLPLSLLSLGLALHSPHGLAQDSVTLAPVEVSDTYGNDNYQVTEAAAGGFQPAPVLDTPASVSVFNQQLIEDRQVRKLSEVLQSDASVGESYAPIGYYENFNVRGFELNAASSYRINGQTIAGEQNVALENKQQVELLKGLSGLHSGVSAPGGLINYVTKRAEDVRSVTVSTNEQGERYLATDLGGWFGSERQFGLRANLAHEDIRSYVDHADGKRDFASLAFDWLINPDATLQLDAEYQHREQRSVPGYQLLGGSEVPHGIDPDDRLAYQHWAKPVQNDSLNLGGRFQYRFNDTWSGTLSASRSKVVIDDYSSFAWGSEDGWQSHFSPEGDYDIYDFRSPDDTRRTDEAQAMLDGHFDALGVSHELTVGASAQRRTLDQRPYYNQLVGSGNIYTGAPAVAPSDLPVGASERRLDSRQYGLFVNDRITFSEQWQAVLGAREVRLDEKTWDENGRAGRHTRQYQLLPNAALIYKPRQDTTVYASYSKGLSAGGTAPWYASNAAEILAPTLSHQLELGIKRDWQGMSFSAALFQIRQAYQYARPEGDGSFTYVQQGQQKNIGLELGASGWVTSNLQIQASAAAIRARVKNSGTDAYEDHQAINVPRLRAALQADYSLPVPGLALLGGARYSASKYASQAGNVQVGGYTVFDVGSRYRTRIGGYDTVLRLTVDNVFDKRYWRDVGDYLGDNYLFQGAPRTARVSASVSF

SEQ ID NO: 9412 - protein, 449 aa, Stenotrophomonas maltophilia
MQTASTIARLTLLAVGVAGALAAADANAAAFQLKENSAKGLGRAFAGSGSAEGDASIIAVNPAGMRQLEGTMVQGDLSAISFKAEFKGQGRNAAGRPQTGGDGGDAGMIAPVPAAYFHMPIGEKAHFGVSLTAPFGFKTEYDNGWVGRYSGLKTDLKAIDLGFAASYDVNPYVSFGASVFVEHLTIELSNAVDYGSILAGAGAPGFAPGSSDGTLKIEGDNNAVGWTVGGLFSIDENTHIGLSYRSKVEHKITGGDATFSGADRARSLLTNSPRTRGWFMDTSGKATVTMPASATLSVTHKVNDRWTVMGDVTRTAWSTAFDSVTVDYASPQPDSVLEFGYRDTTFVSLGADYKLSDTVTLRGGVALDQTPTTDAHRDVRVPDTSRKWLSLGVGWTPSANTEYNFGYTHLFTSDPNVNVPATTANQGNSLSGKYKVRGDVLAASFQYKF

SEQ ID NO: 9413 - protein, 685 aa, Stenotrophomonas maltophilia
MPLSSLAETKVVSATKTSQSLADTPASVYVITAKEINRSGARSVADVLALAPGLHVAKFSNYDWGITARGSNQPLSNTLLVMVDGRSVFNPMFSGVDWDLIPVSLANIAQIEIVLGPVGTIWGGNAVTGVVNIITKDPEEADKATLTAQVGNFDYQEYQMRHAAPLGEYAYVSGYLEFVEHKPWTSEEARVQPHQDYAVYTERFGARLDYQYLANTISAQVGGIRSKEDYQWGTLNPYFLFPDKADIDFYDTKMTMEEYFAGVQHIYDHHSGNRWHNEAWLTYSANDSTDRNARFTRLDLDSHIVVQDWFGSQLTIGGNVRLIDEEFGTYSPQEHFSMPYLRIAQQADFFSQSYGVYVNWNLEVTEKTDLILGSRWQYNNLTKEVDAQPQVRASYELADNQRIWAGWGKAIVTPSRLELTTALQSNNYIEGILSDGKNYYDYFYSFIYQGSEDLRVENVETYELGYRIWSDEVWQFSAGTYYSKHHNIRAYAGVASSQIVLPGNSSPGTVGTVIEQYVSQLVDPLWSETVGGELAFKWAPIDAVQLNMNYSYKRIIGHCEGAICGSNQAVKRELENQPNHFVNAQLMWDITPQWWASSTLQYISESQMHSDYTSDERYQWPEVFSVGIALSWQHSKAYPRLTAVVENLGADQSTEFPQAFSPYQNGVQYWLTLAWSPSMEQGSAL

SEQ ID NO: 9414 - protein, 793 aa, Stenotrophomonas maltophilia
MNTPLSTLATAIVAALLASPALAQNAPAATANTLDTVIVTGTRVSDRTVAESQSPIDIISAESLQATGTSELATALARALPSLNFPRPALSDGTSAIRPAQLRGLSPDQVLVLVNGKRRHTSSLLNLNGTIGRGAAAVDLNTIPVAAIARVEVLRDGASAQYGSDAIAGVVNIVLKGAEKGGSLQAGFGQYSAGDGSNYELSGDTGVAYGGDRGWLHVAAQLNQQDPTDRARAYAGAPSASQPAVGQKAFKIGDPDVNAQAVSANTEFNFSDSITGYAFATASNRDITAFAFYRAPGSTTQNILSIYPQGFLPEIQTYAKDRSLVAGVRGSTASGWDWDASYNYGYNKIDFHTRNTLNVSLGPTSPTSFYDGALETTQNIVNLDVKRGFDWGLAYPVTVAFGAEYRNEKWNQSPGEVGSYFQSGTLAGGAQGFGGFAPSVSGQYSRDSYALYADIEADFTDKFSAGLAGRYEDYSDFGSQASGKLSARYAFTDKVALRGTVSSGFRAPSLAQQYFQSTSTTFLAGNPNPFEIRTFPADSTVARALGAEPLDAETSLSYSLGLVLQPTDALYVTVDAYQIDVDDRIVLSSNLTGTGVRSLLESQGIFGINGGRYFTNAVDTRTRGVDVVGSYRWQLAASSIDLTAGYNYSETEVRSVAANPAALSANGLSLERIDRTERGRIEEGFPRDKFLINGSWNLEHWTLALGATRYGEYTTRPAAAINDQTFGAKWVVDASASYKIDRWTLTLGADNLLDEYPDENNFANSTSGQFPYSNLSPFGFNGAYVYGRINYRW

SEQ ID NO: 9415 - protein, 1016 aa, Stenotrophomonas maltophilia
MKAVIISFFITLSTLTSHAQQRDIVLTGTVTDHQNGPLPGATIRIKGTQFGTVTDTDGHYLLRGKWKENDLILFSFIGMKEIRVKYTGQKVQDAAMQEDPKALDEVVIVARQNINELDIRAKSGVVQRVDVERLNSKPMIDMSLALQGAVPGLIITNTGDLGSKPEIRIRGNSSFRKGDMANEPLYVMDGKVISSDAFMTLNPADIQEIKVLKDAVACALYGIKAANGVIEITSQRGNPDGRLTTSYSFNIGITTRGRRGVKMMDSEEKLELERRLQNISTPGYRYSEDYYRKYYATAPNLDELIAEGQQVLDSLKNIHTDWFDELIHRSIYQRHNLSIKGGTDKTSYYISTNYAKQGGRVPGNDTQRFTARMSLDQKLGNWGYFSLSTDAGYSATDTPNGSTHSPTDLIYQLNPYETKTGKLISYSEKSSEYTLNDLMSQYHSKSTDKRGGVSGSFNLRPLEGLEIDAVTGIDFLLNEALTLVPSTSIAEREMGIAIAERGKLTKEKNTTTNISSNIRITYNKTFAGRHDLTIGGNMDYYLTQTDNMSATGYGVGTQMSLNAINHSITGARKPTASSLLDKTAQLGFGIVMGYSFDSTYDLFATYKADASSVLPPDKRWNAAWAVGLGWTLSRYSFLKNNKVITLLNLKGSHGRMANLSGVSASATIGTFSYSTNYYGNARLLQLLGFYNTDLKPEQTSTTDFSLSIEFFKRLTLGLNLYRRETSDALLDVPIPLSNGFNTMKRNIGVLRNEGYELTAALKVLDTPDWRVSLRGSLAYNRNKVISLYYTDRLYTSETALTPDYEVGKAYNMLYGLKSLGINPITGLPVFQGADGSEISPTQNPARENFIVLGHSTPPYSGTFNLNFSYRNFDLDMDFYYVFGGIKPYNYSYVRSADSANKNAIQKQLENMWFHRGDEGKIYHSPFYISPANASLQQPNTETVGKSDYLKLAMLSLRYRVPHTFLEKNCHFIKYANIAFQASNLFMITPYKESDPETGSLAGAMQPVLTINLSLTF

SEQ ID NO: 9416 - protein, 776 aa, Stenotrophomonas maltophilia
MRRHLLAAAILFVVHNAQAADEPTLPTLQVQASQPSRIDSRVTVDNPQAQNRTLGGLLEHVSGVQSSAFGPNAGAPVIRSLSGNRVQILQDGQSILGMNAISGDINIPFDPLFVRSVTVNKSSDTVRYGGNAIGGSVEIDSGLISRSMEDKDQSMELVLRKGFNAADAQGFRMNFNNQRNISTNLQVSRQRISHYDIPGNSKASVCNTGLFPAGGGVNSALADACQKEARVQQIYNKASQPYIDQFMTENPDWADGDFSFYTNNPTSVWQRRTYVNPVNPAYVAGTPSYVQKQINNDVTPDYHHRLGNSYARNSQVAFGSTLFFDRGYVGVSIDAKDSEYGVPGFSMQNLSFGSNYADGLPVGVVIKQQRYALEALLRDPLPYVERAELRVSKLDNTSGERLGAKKANDYDFESTQAELLLSHQRVGPLSGQLGFSHQSRDVTGSGSLRYLPDVDTRSNAVFLKETLDFGWASFDAGVRHERVDHELQPSRFKTARNASNTKLQDRDYRLNSYSLGSYVELGPMFAAKVRYSSSQRAPEINELYASNAHYSVMTQEEGNQNLEPERAKNLELTGLFHLGGFELSATAYRMKYENYLYLGYSGLQTANRLPLKYWKQTDTTVKGFEIDVSQAVDLGRYGSLNVSAFADLVKNKADHPDSLRAHNDGEYLPNMPTNRYGANLQWQREGWKAQLSSTYYDTQKYLGRNVSEEVPLDAFNIVDLQVSRELPVRNSFIAGMEVFINGSNLLNEEARPHNSPLKYIAPLPGRGFQVGVTVKL

SEQ ID NO: 9417 - protein, 754 aa, Stenotrophomonas maltophilia
MMRNRTSILLALLGTSVLAAPALAQGAAAPAADAAEEAQGLSDIVVTARRRTEPLQATPLAVSALDSRRLEEARVSNITDLTNLTPSITLARNTTNPTSLFPWIRGFGTKSTDPAAEPPIAITIDGIYQAQLVGAFVNLFDVEAIEVLRGPQGTLLGKNAPAGGLSIRTRRPGEEFAAKGQIEYGSFKNLHASGWVDVPLVPGALFGTVSANYQHSNGYQKNIVTGQTLGGINTSSFRAGLLAKLGDSTTWYVTAQYDQDKGEDAGDRNISTTDPLVVPGLTYVVPPSASLTCTNAYSRALCANGTLPNNRRYTTQALPGPDRDSHNFSVASNLDVDTGPVALALVTGYRQFRELAFSDIDGTQLGIIDSRYDGNYRAFSQEFRVASSDGGGLDMGGRLRWLVGSYYFNYDYDRFNRSTTLGAPSTTYQEGETKSYALFAHAEFDILSNLNLSGGIRQTWDRKTHLSRAQRFFSGIDPEFSQRHAWDNISYDVTLNYNITPNNMIYVRRATGYRGGGFTGVPATALAVSTADPETVGAWEFGSKNDFFNHRLRINLSVFRNKFQDLQRVITVPVDVAPFFVQRLLNVASGITQGAEVELQARPVSGLTLRANLGYLDAKYTQFNANVTGNLANGNADLTFLRFPYTSKWTAQFGATYEADLGSSGKLVFSADYNYRSRYNVTDLNYAFGEQKGFGLLSGTITWRDADDRYSVSVFGRNLTDKFYIDGGDAVGGLTTYVSDGPPREWGVSVGFNF

SEQ ID NO: 9418 - protein, 792 aa, Stenotrophomonas maltophilia
MRTIARFPRVSLLALLIAPALDALAEAPQGDAAESRSSDARTLDQVQVIGQATSYAKTSVRAETLNRQTVMSSVNDALNEVPGVVVSEADATGSSVWGTQISMRGFVTNRDTQQIGTTIDGLPNGGSGYGGGSLANRYIDTLDLETVEVSQGTADISSRSNEALGGTLNFLTSDPLQDSRLRFVVGAGDNEARKYYVRYDTGLLGGHTRAWVSASSARVHDWIDGSGKTSNDHIAGKFITELDRWTLTGYLSYNDADEPEYTSVSPKGFATNPDRDNLVGTLTGIPYLDQNYRSGSRALRENTFGYLRAAFDGGNGFKASVAAYGHRMEGRGDWLPPYLAQVSDDGAGRPESEYIGGKTVYGGSNRGQIFFVNPDGSAAQRLASCTPRLGFTAGYDPNCYAGNVLGAQSYRHTHYDNNRKGVTADVEWRQTFGAVDNTIRGGLWVEKLDRSARRDWHRLLNVGQDIAFDHQPYWVQFEDKYKVDEQMYYVEDVARFGPFSARLGVKQFFVDQSRRRVIGANEHVKSDSKSDPLLSTGFTWAPGVEGMELFAGFSQNFAAIPSGVLGETDPQRFRNVEPETADNIEVGMRISRWPLTASVTLYNIKFDNRIVYLPAGFVSGIDYLGETDGVYENFGGVESNGLEAAFGYGWDNGWRLNAAYTYNRSKYLGSGDAARDTQLGIVDGAKVIGQPEQTLVLSADWQGENWNFGLSGRYLGTRYLDAANVNKLPSATVFNANIGFDLQGLSPRLKGMGANLVVSNLTDKRYLAGVDGRDNAFIGAPRTVGISFRVDL

SEQ ID NO: 9419 - protein, 822 aa, Stenotrophomonas maltophilia
MLSVPLWAAEDAEFDPSFLSRTPGSSVIDVRRFTHGNPVPSGNYYSDIYLNGEWKGNAELSFRDMSSSQEESVLCVTPELLSILDVSPEAVAREPDTGNGRCMPFSAVVPDAKIRFDLSLLRLNVEIPQAMLVSRPRGYISPSQWQTGVPAAFVSYDVNHWRYRTPDMENNQSYLGLRAGFNAGGWAFRHRGTESWSDGHAEGYRSIETNLQHDIAMLRAQLTLGDFTTTGELMDSNSLRGIRLASDDRMLPGSLRGYAPVVRGMAGSNARVTVRQNGNIIYETTVPAGPFSISDLYPSGYGGDLTVTVTESDGQTRSFIVPFASVAQLVRPGFSRWQVAAGRYRYGNRTFSDTVFQGTLQYGLTNDITLNTGMSTAPHYLSGLGGVAFNTPLGAVATDITLARTTFPGSDTTHRGYSLHAGYSARIPETSTNVTLAAYRYSSRDFWSLRDAILTRNRDVINDSSVRSATGYRPRNQLQLTVNQSLGEGWGNLYLTGATYHYWGHTGTFNEYQAGYNNVWKKMSYQIGFSQTRRSGDYHHDNRFFFSFSLPLSDTGRTLLSTTVNVSDKNSNSIQSSISGVSGDDNQLSYGVSLNTQENGPTGYAVNGSYRSPVATLQATAGNDSRHNRQISAGISGAIVAHPFGVTASNDLGDTFTVIHADGAGGAVINNAPGNRLDPWGNGIVPYVTPYEKNYISIDPTALAADVELSATEREIIPRANSTTMVTFTTKTGKAMLFDVKMPDGTPPPMAAEALTADGKSAGYIAQGGRLFVRDLDAEKGMLRIVWGSGQNDSCVIHYSASGENARGNAVPENHHVVCMRQ

SEQ ID NO: 9420 - protein, 764 aa, Stenotrophomonas maltophilia
MPKCSNTDRLAASVADILATTRPRRALASMTLLLAGAQSLPALAQDARTLDAVSVVGTGSTRTTASISADEIQAQVPGVAPQQLLASLPGVNVQTSDPFGLYEFGDSMTIRGFSANQIGVTLDGIPIETFDTREGGPITRYVSSENLLDVTVSAGSGDVTQPSYHALGGAIRYTSLPPKGGDSWSGNLTQTIGSDDLVRSFVRLDTPNWWEGGPSAYLSASRTQGGVWDMEPATQKSDHFEANIRQAWDAGSLTLGWIYNNRKDYDVQSYNSDGSVAWDLHERITGNPEVDAEHYSEWQNGRRDSLLSLHGDFLFNDAIGFTFTGYYENKHGYGIGGTPPSTAAGLYNDAIAGTPGRTDIAINDPQIVDATGTVTHVGAMTRREEIMGGDRYGLTTAVSWETEHNKFEVGAWYENYDFDQVRPLYNLDPATGALLKGALPIVIYYDNHFSTEVKQLYIKDTLRLLDDRLTMEFGAKGLDVKRDYNGIANLDDFNVGVRRDVTIKNSDWFQPQVGASFQLAEGVQVFANYAENFSSAPRLALTSGAFNPDIAPEESTNIDIGIRAESTQWSGYIAAYKIDYESRIIALTDPDPLVVAPTVYANVGDVQTYGAEISGMWKPAPGWRLGASLTWNNSEFQDNYFGPVSGNLVQVKGNEVPDAPKVMFSVNGGWEGTHLFANLDAKYTGKRYGDTLNTDRVDATLIVNGSVGYQGEDGGFLAGGRLQLSVYNLFDKDDAIGAVFPNESSGSYQLIAPRQLFASLTYTF

SEQ ID NO: 9421 - protein, 838 aa, Stenotrophomonas maltophilia
MYRRRSRAQLVGFTLGSLALGIASGRLQAAEAGPTEHVQVVGQAASIDNALKEQRSADSIKSVVHADGVAQLPDQNVAEAVQRLPGVSVERDQGEGRFVTVRGLAPDLNSVTINGTLVPAPESGRRAVALDVLPAELVQSLSVIKTLTPDMDANSLGGTIDVESLSAFDHKGLFYTGSSEASYDKNTRQTSPKFSGAASNRFSLGDGIDNVGVAAALSWQKRDFGSDNVETGGDWDGTRLQSFEQRDYDISRERAGGGLNFDYKPDDVSKYYLRTLYSRFKDDEVRTTNAFEFADAQRAGETGDAEGTRKLKARTETQEIQSYVFGGERMMGLWTLSGQAGYSESSEDSPGHIAGATFVGNDDFAGTGFYDRDKPRPIVGSSFYDTSNFTLDKVDWEKQYTKDTEKNVRLDLARDYDFKGYASQFKFGGKVSRRDKSNDLEVWKYEDFDDQGFSDQQLNLSQFQKGSIDYRLGNFGSGISPGAVKGLIGGLDAASAYDPAESRANDFKINEDINAGYFMNTLDVDKWRFIAGLRYEGTEMDAKGTGVRDGAFEPNDTKRRYHHWLPGLHARYQIDKSTQLRAAWTKTVVRPTFGQLAPGFVIDDDEATFGNPNLKPLESSNLDLGIEHFMGRAGTVSAFVFYKDIQNFVYNTDLAGTGQWANFSEANTFANGDKAKLYGLELAYSQKLDWLPSPWDGLLLGANATLSRSDASINGFDQSTGTNRKRDIDLPSQSKTVGNVMLGWENDTLSLRLSANYKSAYLYELAAIGDKDHDQYVDAQTFVDFSARYSLTKNLKVSFEAQNLTDQPYFVYSGHRAYNGQYEEYGPTYKVGLTFTHF

SEQ ID NO: 9422 - protein, 678 aa, Stenotrophomonas maltophilia
MLPALAAWAQDVPGAARGDGAAALHAPVQAGPALTLGTVEVREGPGGALPARSVSTSVDIVGGEVLQDARVDHSWELLGRAPGVQVTPFRQGTDAGRFSFRGFNGEGRVNAVKLLIDGIPSNDNAGGMPFLDAVFPLDIEALEVVRGTNDPRYGLHNIAGNVNVITRTGGNEGRATLTAGSFGTRDLQVVKGIESGPWSQNYGVFWRTGDGWRDHAEGTQRALSGKWFYTDPGGGWRAGLTARYFRNAADESGYLTREQAAAQPRWSPPWSASDRSTRETGQLGLHWEAELAERLSWTARAYANHYENQRWVRFSQAGVQQERDNDEDQRGLSGVLTWRPAVAWAHAFTLEGGVDAQWQDNAAQRWRTAGHVHTSQFRDWDFDVHTQGAYVQAVVQPVASLRIVPALRVDRLGGDFSDRLTGQRYGMHDYGTIRQPKLGVAWTAREGVTLYANAGRTFQVGTGIDAYRTQARDLGPSINDGWETGVRWQPAPGWEARVATWQQRASGEVARVLGVDGLPDPGGLGNVGRTRRKGWDAQLNARLGARWTGWVAYSHQVARITVPDPSAPDTAGREVENVPRYLASAGVQVRATEVLRLSATVTAQGDYYLDRTNTQGRAGRYALLDLGATWQLSPVADVSVQVRNATNRRYVYAWYDSGSSGYSPGDGRSVAVSLGWRF

SEQ ID NO: 9423 - protein, 613 aa, Stenotrophomonas maltophilia
MKLQSRMLSLAVLAALPALAQAADDTTALDQILVTATRTPIALQYSIAPAQVIDRAQIESSQATSLQELLRGRAGINLTNAGGLGKQSSLFLRGTNSGHTVVLVDGVRINSADLGLAMYQDLPLAQIERVEIVRGPQSSLYGADAIGGVIQIFTRRNQGDFAPHFQLGGGSNGLREASGGIGGGTERGWFGADIAYQHSDGIDACRGSATLFAGCFADEPDRDGYRNLSKSLRGGYSFNDQWNVEGSALRADGKNHYDGYYNYSETRQQVLAGKVRYTPSERLAFTANVGRSDNESDNFGAPGVFGSAQTHRDSASLQGDITLAEGQLLSTGVDWSEDNLDGSSAGYLVDSRRNTGVFVQYQGRFGRHQLQVSARNDDNQQFGNHATGSVGWAMELEHGLRVNASYGTAFKAPTFSDLYDPWSGVPTLNPEKSKSANLGVSQHGKGWHWGLDVYETRIDDLITYDASTMKMQQVEKARIRGAELTGGVLLAGFDINAQLSYTDPRNRTHGSTQFDNWLPRRAQQTARLDIDRRFGDFRAGLTVQGAGKRYDDAANAVKVGGYGTLDLRAEYALTPEWSLLARAANVFDRRYETVAWFNQPGREYQLSVRYQPK

SEQ ID NO: 9424 - protein, 879 aa, Stenotrophomonas maltophilia
MPKHTLLVAALAVALAAPLSAAAETSADASGEASTLAAVRVTGSNIKRADTEASNPVQVIGRQQLEQTGKATVADVLRSISANTGNASNETTNNGWASGSAGIGLRGLSQKNTLVLLNGRRLANYGFPAGGLSDTFVDLNALPLVAVERIEVLKDGASAVYGSDAVAGVVNIITRQNFEGAEIGGSFGGADQGGLHEQNLKFVGGLGDLDTDGYNILFSLQGYNRERLDQDERNLTKSGIYTDKPGGRWNGWSAKGARYLVNGVSVPMLDASGNCPAGTTRVASAPIDGLAGDTCGFNQAPFTTLIPSTKRYQAYANGTFRLNDNVEAFGEVLYSQIKSTAWFGSSPFFTLESGRFALNADSGLAEPVTSLLPASNPYNPYGRAIPIEYTFFDLGGTLKTNRSTAYRGVFGLRGTTAKWDWEVAAFGARSSERESVSGGFANRWALADALATGSYNLLNPAATPQSVRDSINIATLRPAESKLQGIDAKISGSLGHTWAGEIGFAAGAEWRREKLDSNNPWQIDAGLQVRPAIAEVHGKRQVSAAYAEVNVPLASTLELSAAARADHYDDFGDAFSPKIGLRWQPLDFLLVRASASKGFRAPSLSENSNSTSIAYGSVVDPRDPDVPGSRQNPTFFTVGNNELKPERTKSLNFGVVLSPWANTNLSVDYYRIQLDNLVGTNNTQTLVNDNVAGAVQRDERGKLQAVYNRYQNLSELKTSGIDVELRQRIPTAAFGDFTVSSAYTHVRDYRRPTVVGGPLVDYAGSNLGATLPKDKATTTLDWKYGDFNAAVTWYYTSSYRQEASTAAKAVQQQVGSYSQYDLYLAYTGIDKLTVYAKVQNLADKTPPYDASFPGIRAPYDFSQYDLRGRYFTLGFDYRF

SEQ ID NO: 9425 - protein, 86 aa, Stenotrophomonas maltophilia
MFYSEKASGALEGAVGATKVHMSDSFGWAGQVGVDIDLNERMFLNFDVKYIDIDTTARLSIAGAGVQRVKLELDPFVFGVGVGMKF

SEQ ID NO: 9426 - protein, 417 aa, Stenotrophomonas maltophilia
MMHTTCTLARSALAVSLALGLGLPAWAEEGGFLEDAKAGLTLRNYYFNRDFRDAGAAKSKVEEWAQGFIFKFSSGYTPGLIGVGLDGIAMFGVKLDSGRGTSGSELLPVHDDRRAADDYGRAGLAAKLRICATELKVGELLPDIPLLRYDDGRLLPQTFRGAMLDSREIEGLSLQAGQYREVSLRNSSDMQDLSAWAAPGVTSDGFNYVGAEYRFNQQRTQIGAWHSQLEDIYQQSYFNLLHSQRLGEWTLAANLGYFIDRDDGQARIGDIQSRTGYALLSASHSGHTLYLGLQKVSGDSPWMSVYGSSGRTLGNDMFNGNFSNADERSWQVRYDYNFAAMGVPGLLAMVRYGHGENATTAAGSNGKEWERDTEVNYTFQSGALKNLNIRLNNATNRRSFNSDFDQTRLIVSYPLTL

SEQ ID NO: 9427 - protein, 646 aa, Stenotrophomonas maltophilia
MPSGETLYLDEIVVTGTRNPRKVSDTPVRTEVVSWEEIRNTHSRTVKDALQNVPGLLLRQIHGKAGYEVWMQGLNADRVLVLIDGLPLTATTGSSVDVTQLDTLDIERIEVVKGAVSAQYGSSAMGGVINIITRPISEGAGGEFTVDGGTYGDQNPSGESLDFSRRNGQASLSVGGETMRWRLTASQRETDGIDPEPETWARPGDAVERTNIANRLEWLPADGHRIYAQLGYFREDAESHYLLANPGNPLNAGKNEIVERLRGDVIGQHTPVDGPAWHWSLLHENLENITDKYIPTGRFDLRDSTHTLSRASGWTQFEPFATHQLQLGVDLNHNSLEQYKDGNTELTEDGDITRNGKEIWFQNTWFAGDDWEWVVGMRYQNDSDFGSHTAPKINARYDLFNTTSTNVYLRGGWGMGYRVPNLKERHYVFDHSQLGYIVNGNPTLEPEESDSYQLGLGITFTNKAWLEVNGFYNDVNQLIQTELDTEATASRNDGVQIFRYANVERARTQGAELTAGWQIQPGWKISAGYTYLDTKDLDTDERLTRRPRHQGQLSIDGTVPLPGMSWLARVRSQSDEVVDAETDATSPAFTTLDLKLNQDIGQHLRLFTGINNVTDAQRNFNDASDFGPVSGRFIYVGLTLGFGNNL

SEQ ID NO: 9428 - protein, 723 aa, Stenotrophomonas maltophilia
MPAACGISSRHAIVTLSLRTTLGLYGLAACAAVPALAQTTTETPTQPTAEQHPLPEVIVQEKAQEIGYQPKRATTATRSDASLRDLPQAVAVVPAQVLLDQQVRNIDEALYYVSGITQANTLGGTQDALIKRGFGFNRDGSILRDGVRTVLARNLTYTTDRVEVLKGPSSILYGSMDPGGVVNMVTKKPQLEFAGQAALSASSYGGGGASVDLTGPIGSKGLAYRLIADTSHVDYWRNFGVNKQTVIAPSLAWYGRDTYVRMSYEHTEYEQPFDRGTVIDSRTGKPVAIDPRRRLDEAYNRTIGDSDFFTVQGQHTLNSQWKLNATYSYNRNRYDDYQARPVSLNPVTGVLTRRPDGTRGALSQQHVAQLNLQGNLQWGGVHHEILSGLDIEDSDIYRRDLIRGSNSTGFNVYNPVYGLLPYSTTISAADSDQRDKIRQQAFFFQDNIRLSEQWMVQAGGRWLHYDQEAGKGRPFVVGSASDGWQLVPRVGLVWQPDSNWSFYGSYSESFKPQSSVGTVIGALPPEEAKSWELGAKLELARGLSATAALYDIRKRNVAVRIPVNGDLATRAAGGARSRGLEVDVAGQIGRQWQLIGSYAYTDARVSDDPQLQGKRLANVARQSASVFAAYTFERSSYGQWRAGAGVRHVGKRAGDAANTFDNDAYNVADAFVSYETRWDNRPVRLQLNIKNLFDKNYVVSSGSNIYVSLGERRQAVLRAVMDF

SEQ ID NO: 9429 - protein, 407 aa, Stenotrophomonas maltophilia
MKWNQEVGGVQSVRGGGYQPPRRLGVRPIGIALAAIGMGMGGAAWAGLNLYGVLDVGLNYRSVAGVDPSTGRAAGALALASGNELTSRWGLIGEEDIGEGYKVAFKLESGFAADTGVANASVPFPQDTGSLFDRGATIGVVAPWGTVRLGRNWSSFFDGISAGDATGYMNFGSLANATFQNSSNFKPGEGFPGIASGTNSAVNGGLMYTWVNKSIKYMLPDQFYGFSGGVTYGLGGTPGSFSNKSTFTANLNWTDGKLGLASGYFDGKDPTGQTSNPWLRAYTIGVTYTWGTLKTGVNFAKFKNPTTGADQNYYYVGAAYQATPAWRLTADWLHLQDKQVSEAGADLYKIGAGYSFSKRTTLYVDVAYSNNKPKGMLGAGSNTSILASPATIGHNQLAVGAGIRTLF

SEQ ID NO: 9430 - protein, 367 aa, Stenotrophomonas maltophilia
MSRRQKMQTDHPFLLRSQKAAAALCFIAAAQSSHAQSALTLFGGVDLGVRMVNNSAGTTKGMNSGNNYTSRWGLRAQEDLGGGHKASLWLESTINADTGSSNPQFFDRRSTVALSGDWGEVRMGRDYTPVFRGYGIAEVFDFAGLASMTTIYNGSASTVLSRAFKGKTSSNGRTNGSLQYFTPDSLGGFHLSAMLSRSGDGNVSGDHDYKGLRVGYSRGPWQTAAFAGSTEIRISGGNYRIRGGSAAYRLGTGKLTAGVVNMRYLDARQTNYTLGLIWPLGIHQVKATWHHIDQAGRNAAGASIDRNDADLMAIGYVHNLSKRTALYGTLAFIRNRGQASFSITGESMGARPGGNARGLELGLRHMF

SEQ ID NO: 9431 - protein, 707 aa, Stenotrophomonas maltophilia
MSKHSAAQRHKIVGNKEKAGLQVIGAFSSLFLGLCSLSVGSVNAAAVDEKVQETADSKRNDNWQDSESLLVTGEKIKRSIFDTGSSVQVFDSERIASMPNALQVPDLLRMTANVMDVGIGNDLPTVRGIDGSGPNTGANAFLSGTRPRLNLSLDGRSLTYNEQAYGPQSLWDLDRVEVFLGPQSYIQGRNAIAGAIVMASKDPTFDWESAFKGGAGNQHSSQLSAMVSGPLVEDQLAFRVSVDRQRRRSDVDLPAYEPVGDPREVEATTARAKLLFNPAGMRELTTKLTFNHFGSTSPQNESLNPLVHPTSLRHDPRRAVFKSNTNSGVWDLAWEQSDSLTLENRVIYTDFNINRPTAYALPYADIGGKEVHVEPVARFGGPGSRLHGLAGLRYFHAKQDEFVNIFGGSTFKDKTDTNSVFAELTYAITPQVDLTAASRLEREHRQRTGGSKAVRIDFDETYDVFLPKLDLAWKPTDTQTYGAKVARGYNAGGAGITIGTPVVNYTYGSEYVWNYELYTRHHLKDANVILTSNIFYNDYKDMQLPYSLGPNSSVIRNADKVETYGAEMGATWQPRWDFELFTNVGLLKTKIKKFSGSGVDGHELARAPAYTANMGAKYQLMAGLELSGNVAFSDSYYSQYDNDSRGRIGSYWSANTQLAYTFAYGRATLYAQNLFDSERRVMVSGNDVYTATQQRPRMIGAALELTF

SEQ ID NO: 9432 - protein, 962 aa, Stenotrophomonas maltophilia
MALPGRPYCVKSAHLQRFVGGYRCGTCSRRVFCKSRRLGERNPMKRHLLVNAVCAALALPSLAIAQSQDDVTQLDKVTVTGSLIPRSQIETATSVFSITAQDIQRRGFKDVYDVLRSQPMATGSVQDGQFTGGFTPGAQSLSLLGLDPGFTLVLIDGRPMADYPLLYNGQSNFVDLASVPVGMVERIDVAPGNQSSIYGSSAIAGVVNIILKKRMDGMQMNYRMGTYDGGGGNNQRFQLTGGNAIGGANIVWGLQLNNQDPIYGFQRRNFDSTNDNPDPTLRYGSQVALHSIPGPPDSYIDPGADNCAALGALFNHSVTLDNRSKRGNYCGSRSALGYSSILNKERSASGYANLSYAFNDNAELYATLLLNRTKVEVNGGSRSWLTSADTGGLFYNQNTQQLETYKRIFAPEETGNLDFNNDRQTADSYNIALGMKGGLGGSNWTYDAYYARSEYRIESRQQWPLADRIEDFFRQQFLGPQLSEQYGYPIYSPNDANFYRALTPAQYRSFNDEIHTKSRTWTQNLNLQLTNTELFTLPAGAVGVAGVLQAGNQYWNNPTDPRVIAGDFYQLTGTQGSGKRDNWAVALEMHVPILSTLTANLSGRYDDYKNQGGGSDSRLTYKVGLEFRPVDALLLRGNYATAFKAPDMAYTFAGDSGFYESVNDYYRCAIEEPNKPIADCSYSDTTIAGRRGGNPELKSITAKSWGYGLVWSPSAHLSASADYYHINITNEVSDINYDQLLQIESACRLGNLDIASPTCVDALSRIDRTGPDATVPNRLNSIRVNPINISTEQVSGVLAKASYDWSTASWGTFLVDAQYNLTLKHESQQFPKDPVIDLLSNPFYSQEFHSIANASLTWKKNAWTTTLFGQRYGRTPNSAAQRSDAGYATKDAGKVAAWTTFNATLDYAISDDISLTATVNNLANTRPPRDRTDTYYPYYNIFNYTGYGRAYMLELNWRFGAH

SEQ ID NO: 9433 - protein, 207 aa, Stenotrophomonas maltophilia
MAQGTLYIVSAPSGAGKSSLIQALLKTQPLYDTQVSVSHTTRQPRPGEVHGEHYFFVNHDEFKEMISRDAFLEHAEVFGNYYGTSREAIEQVLATGVDVFLDIDWQGAQQIRQKMPHARSIFILPPSKIELDRRLRGRGQDSEEVIAKRMAQAVAEMSHYAEYDYLIVNDDFDTALTDLKTIIRAERLRMSRQKQRHDALISKLLAD

SEQ ID NO: 9434 - protein, 1047 aa, Stenotrophomonas maltophilia
MGMKHSTRTHGHDALSLAIALALTAAIVPAGAAAQQAASAGAQDATTLDSVQVTGYRYAIEKSLEQKRDANAVVEVITAEDVGKFPDKNVADALQRVPGVIITRSGGEGKNVSVRGLASDLTLTQLNGNYVATSETNDEASRSFNYTLLPSNMLSAAELYKTPEARIDEGGIGGTVILRTRRPLDMKANSGFASIEGTSSDTSSGVDPQASAMYSWHSKDERFGLLIGATRQVRTNRSMEVSTEDWQWYSDRVDANGGVIHDYVWNAAGRTRNPAVDVYGNALPDASQFWGRSGIYNQNGGHYSGFFMPTSVNFAVRDERRERTGGQLTFQFKPLDNVTMTANYFRFELQGNYTQNMLKVPEWNLARVAGDGNWEGGRMLNGFTMDPSGTIVTGAQYQMQPGRNYICSEDQAAAAGLRPGGWGPDDCTIPTPQLTGTYSKEKALSQTADLTIDWDISPLWKASFAGGRTWSEGGPSMNFRMSAKPRRQVDGQWQAGNTATSWDLTGTPSVNFSPDLQQQLMAGIAEVDTGSTDSSWKRTEVKQNHFQADVTKMFEAGWLDSIQFGAKYSDGKVHRNTGNTYWVCQGADPGDYSKRYQAGCDSTAGIAQPGFFLSQPMDNIAGGFNANVFPGINYPAYIDYLNNRYGGVQNRTEEDFVYDVQEKVYSGYLQANFRTERLRGNVGVRVARTKQHASSSDSVERFNDYFADNAAGSPLACTDPSAAALLGSNSGYGCESGFVRLPDDLARAKTYEQSSLDKTYTDILPSFNIAWDITDSLVLRGAASKVIARPSYTNIAYPGGLSYYSDEYSNDRRVAGGATNPGWYGSGSNKELEPFKATQYDLSLEWYFKPGAVAGVGLFRKDVKNFTVPVVRDQQMNVGGQNVTVQKYETQANGRDGVSQGVEIYGQYTLDFGLGFQANYTYNDTNMASVEINGEQIGSSPLVGSAKNQANFTMFYENEKFLARASYNRRGVVVGGLNNGFSSYSEPYDQLDLNAAYNIREDLALTASVLNVTKSEQRVHLGNDTRARLLSNTYSGRQYYIGLTWKF

SEQ ID NO: 9435 - protein, 175 aa, Stenotrophomonas maltophilia
MKHLILTTALVAAFSANAHAQDSRFTLSEGYAYQQFDEFNAHSLNSRLGYNLTDFIRVEANAVSGLSGSSGIDCPVGADCSSVEPRARFRYGYGVSVAGEFPVSEHLSMFARVGYDIANFKATAGPSGNDSGLALGAGADFFFNDAHGVRLEYSRTNFDDRDDASSWGISYVRRF

SEQ ID NO: 9436 - protein, 814 aa, Stenotrophomonas maltophilia
MERTDLLPQALGLCAAVAAVAPVWAESIQAATQEMTPIVITGVAPEAPLIFTTDPKIPRQPVPASDGTDYLKTIPGFSAIRNGGSNGDPVLRGMFGSRLNILANGSSMPGACPARMDAPTSYISPENFDELTVIKGPQTVLWGPGASAGTVKFDRDTPRFDEPGVRFDGSLLGGSWGRNDQAADLTAGNARSYARITANHSHSQDYQDGNGDTVPSRWDKWNADVAVGFTPDADTLFELSAGTGDGESRYAGRGMDGVQFKRESFGLRFERDNLGPVLRQVEAQLYYNYADHVMDNFTLRDPDPTSAMPMGMASDVDRATWGGRVAGTFELAESLSLQGGVDFQRSRHRARSGTQMSPYRDQPWTKDAEFANTGVFGELTWRVAEATRVIGGARLDRASAKDFRQSARGMTPMPNPTAGKRRTDTLPSGFLRYEHDLQSLPATWYAGIGHVQRFPDYWELFSPGSGPDGSVNAFAGIEPEKTTQLDIGAQYRTDKVDAWISGYAGYVQDYILFDYLPGGMMGERTQARNIDARIAGGELGVSYRATPAWKVGATLAYAWGQNRSDGRPLPQMPPLEARLSATYDDGTWSAGALWRLVAAQHRYAAGSGNVVGKDFGPSAGFGVFSLNAGYAVNQQVKLAVGVDNLFDKAYSEHLNLAGDAGFGFSANTRFNAAGGPRRPARVGGRQRGLRAPLGVAAGAAAGGRGAGMPPGARRAHRLRQTAPARAGAPPAAAGRPAAGHPGRTAAGIAARRLPALPAYRPQRVRYAGPPWRALPVVHCLREHCASFLFARCAAARRGRRLPARTGRAAACLRA

SEQ ID NO: 9437 - protein, 213 aa, Stenotrophomonas maltophilia
MVRLLLAVPFLALSAMSVASESKQVEKFGYEHINLDVGAGTTNEEWLDNSNATTLGLGGNYMFTDNWILNADYSAQFFHPDNFTLRIDRLLFGVGYRYGINDQFDVYGIYGLGAVKAKAKDDNTDQTLSSDDEFIQGVTLGANYLFSEKLMATAEVHVNRSDIVDENNYKIAFNYQWHRVIGTGLYYQFRDTDYQSRESDHINEVGINFKFVY

SEQ ID NO: 9438 - protein, 382 aa, Stenotrophomonas maltophilia
MRRIVVPAGIGAIFAIAAPSAFAQSSVTLYGLVDTAIRYQTNAAPDGKDLIGMTVGPETHSRWGLRGSEDLGGGLAAIFRLENGFELGDGKLHVTNTLFSRQAYVGLSSDRYGALTFGNQYAPVYDTMGDIFDPMTVGDYWQDSWAYNGIGNFLTVQNSVKYKFAYRGFSVDAIYGFGNHAGAMGLDSTYGVELTYAQGPASVNAGYQQTSVSSLNGSAVNGAKVSFLHLSGAYQITPTVRLLAGWLHGQDKTGTTDFNMQQSGAPTLNGSSPNRIDDTFYVGANWQATAPLLITVAGYYGHARNAERLDGTLGSGINYSATVLAEYSLSKHTEVYGTVDFARGNGAFAADYPGATNRLTGKVDQIGRTNNVGAAIGLRQMF

SEQ ID NO: 9439 - protein, 708 aa, Stenotrophomonas maltophilia
MKPSPLATGITFALALASLPAFAATTDDGRTTVKDLDTVTVSAQLDQARNALSPDIGSSQYQITADDIQKQPLGASAPLSQVLLQAPGVVQDSYGGVHVRGDHANLQYRINGVLLPESISGFGQTLDARTIKSIRLMDGALPAQFGERTAAVVDITTRSGAELGNGGSAGLTAGSFGKVNPNASWWGNQGRWSWFLTGNYDQNEVGLENPTNSRRPLHDDTHQGKAFADLTYLVNENTRLSVFAGFANNRFQIPVNSGQTPQFGYLDTTTFDSSQLDETQRETTRFGMLVLQGTLGSTAYQLSAGQRYSDVAFNPDVIGDLVFSGVASQVQRSNRANTLQADFSTPLGNDHTLRYGLYGNYENAQASNDSWVFPVGADGQQSSTTPQLIPDRSAFHASTLALYVQDEWKIGDDWTVNYGLRGDRYKAFGHTEGQLSPRVGVVWNASDSTTVHAGYSRYFTPPASELIASSDIALYDGTSNQQSNAGNSTALAERSDYYDIGVSQQLGEHLTLGLDAYDRRVSRLQDEGQFGAAYIYSTFNYRRGHIRGLEFSADYSNGPFSAYVNAALNKAIGTDVITGQYNLDPEALAYVADHWIHLDHDQKLTSSGGFSYAFAGHNRIGANYVFGSGLRSDVEGVPNGGELPSYLQVNLSAGHDFNANSGHPLHVQLAVINALDRSYQLRDGGGVGVFAPQWGPRRGAYLSLQQDF

SEQ ID NO: 9440 - protein, 843 aa, Stenotrophomonas maltophilia
MTIQRFSAKKLALSLAVTTALSTPYSVAVAAEPDSQAQENIEVISVTGTRRSLRSIAESSVPVDIITSRDMASTGQLEISQVLANQVPSFNYPSATMGDGTDHAKPAVLRGLAPDHTLVLINGKRRHSGALLNLAGVVGRGSTAVDLNMIPTSAIKRVEVLRDGAAAQYGSDAIAGVINIILKDAAQGGSVSVTYGQYDTQMAGVPQLESVYADANGNLAFNTGDDRKMSDGATRTISANSGFSLADNGFVNVSIEYRDNDSTQRSGFDPREQYSRLDDGSLDPREFTIDRYNHRFGKAELEDYALFYNMGYDFDNGLNLYSFGSYSKREGNSGGFYRRAVDKNNILDVYPNGFLPQIETDVEDYSLALGLQGETGDWTWDVSTNYGRNGFALGVVNSLNTSLGATSQTEFDNGALVYDQFIVNGDASTAFDLGLPDDVFFTIGAEYRHESYKIEQGEEASYITALDSNGNPIAAGGAQVLSGFGPQSVTDESRHNVALFVEFDTYLTEKWNVVLASRYEDYSDFGDTFTSKIATRYSITDNLSLRGAASTGFRAPSLAQSSYRQISTILENNQAFEVGLFPSDSPAAQALGAKKLDAEDSVNLTAGFVYTQGNFSLTVDAYRIDIDDRIVLSENLAGAAVAQILANAGELNTESVRYFTNAIDSRTQGVDIVATYLLELDNLGDVRLNAAVNFNDTKVTHIDDNPEELNSLGDDYVVFARREVGRFEEGTPDSKLNLSAVWSFNEWQTTLRATRYGEVADISTSSDRDEYLDAKWITDLEVAYSPNDEWKFAVGANNLFDQYPQATVDNIGYSNFGQIFPYTPYVPYSLDGRFLYGNITYRF

SEQ ID NO: 9441 - protein, 928 aa, Stenotrophomonas maltophilia
MERELMNCKSNKLRDAVVLALVVGVGGTGTAIAQEAGTTNLDKIEVTGSRIKSADIETSQPVLTLTRQDIDKQGVTSVADVLQRVAANGAALNRTFNNGGDGSSGIALRNLGSARTLVLVNGRRWTTGLDGSVDLNTIPTAMVERIDILKDGASTIYGSDAIAGVVNIITRKNFDGAEAGVNVGQYSDGDGQRQAYDFTLGTTTDRATLMVGASYVKEDSVMAGDREISAGGPPFFSGQSGTGFPGSYVRNGSRRILINGVETPYVANVHGYNTAPDNYLLTPQERTSLFTQGSFNFTDNVTFRTEAMYNERKSEQLLAAMPVTGLTLSADSLYNPFDQNLTSVNRRFIETGGRSFNQNVKNWHFYGGLEGFFEFADRSFDWDVGYRYDKSDENVLTYGLFNLANLNNAYGPSELRNGVPVCVSGPGGDVIPGCVPVNPLGPRGSITQDALDYTSFTAHDSSMVESKGYTANISGELFTLPAGPLGFAAGYEYRKESGQFDPDAFIAAGLSTGNGARPTAGSYSLDEFYLELSVPVLADLPGAQLLDFSLATRYSDYSNFGDTVNNKFGFRWKPIQDLMIRGNYSEGFRAPSINNLFAGNSDSFETYADPCSSQSGQLSNPVVAQNCAAAGVPANFVQPGAGNGAKQTLEPFTWTSNDQLQPETSTSRTLGMVFSPSFAQGLNVSLDWWQIEIENAITRPESQFILDKCYGGSAGEQAEYCALVTRDPNYADGAYTVTNINMPLLNLASYKVEGWDLAVNYRLPETAIGQFTISWDSTYLSSWETKATADSELEQFQGRYLNQDPYWRIRSNLYVDWSLGDFGINWGLRYKSGMAEACPLSTALAQAYCSDPDRVTADGAEPRNHIGATTYHDIQVRYSTPWNATVSVGLNNAFDKGPPVAYSTSANRFDPQYDVPGRYMYMQYRQRF

SEQ ID NO: 9442 - protein, 1083 aa, Stenotrophomonas maltophilia
MLKPPNYFDFLIPGNGKIRSLFFVLFLINCFSPFYGHAQTKSVTGIVIDSKTKQTIPGASVVLKGAAAGTVTDKNGRYTIAVPNDEATLVFAFIGFRKQEVNVGGRRSVDVVLQEDDQQLNEVVVTALGITRESKSIGFSVQKVDGQVLQESHETNLLNTLSGRVAGVQITSASGNIGASSNIQIRGQNFVSGYNYNNSPLFVVDGVPVSNNNEQSTRAFTGRQDFNNPNLTANEGEVDYGNAAGEIDPNDIESITVLKGPNAAALYGARASNGVVLITTKSGKGTKGVGVSFNSQASFESPLKLPDYQYTYGQGRDGQYAYKDGLGGGINDNIMENWGPAMNGQLIAQFDSPVDPVTGNRIPTPFVAYPDQLKDFFQTGQTYTNNLSVAGSNDKLNFRFSYTNTEQRGIVENTDLSRNALSLNSGYAITPKLRVDVNMNYVNSGSDNRASYGAKNDDAIMRIFLYMPRNLNIESLRNYWKPGSSNQVQNSPIYNANGTRFNNPFFVANENLNGNNRDRVYGNVKLNYDIMPNLKLMLRTGRDFYNDKRTMRHAMSSAQYVNGYYQEDDVYFLETNHDVLLSFDKKFKDKFSFNASAGGNLLTQTSKRLGAIAGRLAIPNVYNLTNNATPILAGNVYQQKKINSIYATTQFGYKDALFLDLTGRNDWSSALPKQNNSYFYPSASLSLVATDMFNLQSNTLSFLKLRTSVSSVRRDLEPYQTAANFQISQGWNGETVAVHNNNYPNSDIRPEKVNSYEFGFDSRFLNNRVALDFTFYKSTTTDLIIPVTLNPSAGYDTKLMNVGKMTNQGIEVMLNATPLKSSNFSWDISLNFGLNRNKVLRLAEDIGISRIRQLERWASLELRTQNTKGDGSFGSLYGDYLIYRDGSLTLKNGLPQEENGDWGFIGNVNPDYTAGITNNFKYKKLSLSVLFGIQKGGVVHSRTYIDGINAGSLKESLVNRDENGAGNMVGEGIDIDTNNPNATPVTVRNYWRAYYNNDRIATFDASYVKLREVKLSYALPSSLMKKIAVKNGTLSFVGRNLILWSDVPNIDPEVSAYDGQFQGVEAMSLPSLRSLGLSLNLNF

SEQ ID NO: 9443 - protein, 3629 aa, Stenotrophomonas maltophilia
MNRIYRLVFNRALGVMQVASEVAQNPGGSAVCAGRVPRLRAHQLAVALAATLASGSAFAACNTVGSTVTCDPGSVSNYINANSGITVNVLAGATLRTPPVIGGGNAATLSGDNVTVNNSGTIDPSSLILASPGLVIGNGSANNSAIVVNNNSGGQIKGVVNIATLLGFGGQALVAQNVNGTTTINNAGLISTSLIGAGSVSDATTVVTYGGAAANVTNTGTIDGRTGLGASGGNTFLNAGAVSGSVHLGDSTGGNTFTAVSGSSVVAGGGSALAGVITGVTGVKVAAAGTVDAGTGSGAANNTLVLQNSAAGPGAGTGGAVTTLGWNRYLNFQKLTVNSGTWNLQGAWGGTGQTTLNDGLVNFNDTDSFGTGLFTANGGAIASSTAGLNLANAFSLGGNLSLAGTNAFGLGGVLSGTGGLTVNNTGIVTLGGANLFSGGVNLNAGGLVLGNAGALGSGNLTVGGSASLDTTAGFTLGNNLVINGAGSLNLLGSNALSLNGSISGAGNLIKAGPGTLTLNGANLLTGSFAVTGGALALGVGGSLSPTSAISLGAGTNLDLSVAASQTIGSLAGSGALNLGARSLTLGGLNTSTSFSGVIGGVGGALVKVGTGTQTLSGANTFTGGVALNGGGLLLGNAGALGTGALGVGGNVSLDGTGGALALANAVNLGAGGILNLSGNQALTFNGVVGGTGSLVKNGAATLTLNNANTFGGGLSLTAGGLVLGNGGALGTGALGVGGVATLDASTALSVGNGINLGAGGSLSVLGSNALTLGGVISGTGSLVKNGAATLTLGGANAFTGGLAINAGKVALASGGSLAATGAVNLVNAGTELDISLGGNQTIGALSGIAGSTVTLGGSTLTFGDATNQTFGGVIGGTGGLVKQGTGTQTLSGANTFSGGLNLAAGGLLLGNGSALGTGALTVSGNGSLDATAALNLGNAINLGAVLTLPGSQNLTLGGNITGSGSLTKNGASLLTLNGTNAFSGGLNLNAGSLLLGNSGALGTGALSVGGNASLDGSTALNLTNNVALGTGASLSLPGTQAVTLGGVVSGAGGLIKNGATTLTLNGANTFGGGLVLNGGGLMLGNAGALGTGLLAVGANATLDSSVALNLANAIDLDAGAQLSLTSNQNVALGGLVSGTGSLIKTGTGVLSLNNSNTFSGGLALNAGGLSVGANGALGTGALNIGGNVSLDASAPVSLANAVSLGANTLTLPGSSNLTLSGVVSGAGGLIKNGASTLTLSGANTFLGGATVNAGTLALGAGGSLAAAGAVNLAGTGAALDISAAGAGQTIGALNGVAGSQVTLGAQSLTFGGASNGAFAGVIDGSGGLIKIGTGVQTLSGANTFSGGVALNAGGLVLGNAGALGTGALGIGGNVSLDSTVALNLGNAVNFGVGTQLTLGGSSDVALSGVVAGAGNLVKNGTGLLTLNNSNTFGGGLALNGGGLVVGANGALGTGALAVNASTTLDAGAAVSLGNAVNLGSGVALTLPGSNALTLSGVIGGNGSLVKSGAATLTLSGANTYTGGTTINAGTLALGVGGSLAAAGDVTLGAGAGFDISGAGGSQTIGALNGAGGSTLALGGNSLTFGTAGNAAFDGVISGGGGLVKVGAGVQTLSAANTFGGGVTLNAGGLLLGNDAALGSGALTVGGAATLDTTGLAALTNNIALNAGLTVLGTNALTLNGVISGTGSLTKDGVATLTLNGINTYTGGTNINTGTLALGAGASLAASGTVNLATGATLDLSAGSGTQVFGTLVGNGTVNLGANSIEVGGATNGTFSGSIAGTGGLTKVGAGIETLTGANTYTGGTFINAGTLAIGPGGSLAATGAVTLTAAGTGFDISTSGASQTIGSLAGVIGSTVSLGAQSLILGGNGNSVFDGAISGTGGLVKNGTGILTLGGANLFSGGLALNGGGLVVGNNAALGSGALTVGANATLDASIAANLANNIALASGANLDLLGSNALTLGGMVSGTGGLIKNGAATVTLTGANTYTGGTTINSGTLAIGAGGSLASTGAVDLAGTGTLDISAGNQSIGSLAGVAGSTVALGGSALTLGGTVDSAFNGAITGNGGLIKNGAGVQTLNGASTFSGGVTLNAGGLVVGNDAALGTGAVTVGGNGTLDSNTAVTLANNFVLNAGLTVLGSNNLTLNGNLSGTGALTKDGLATLTLNGTNTYTGGTFINAGTLALGAGASLHASGIVNLASGATFDLSAGSGTQQFGTLVGNGTVNLGANTLTIGGPANGTFSGSVGGTGGLIKEGTGTQTLTGNNTFTGGTTINAGTLAIGAGGSLASNGAVTLANAGTAFDISAGGAQSIGSLAGVAGSTVALGGSTLTLNGVGNTTFAGDITGTGGLVKNGAGVQTLIGANTFSGGVALNAGGLTLGNGGALGTGTLTVGGNAMLDGTTALTVGNNVQLTSGTLTLAGSNALALNGVISGAGGLLKDGAATVTLGGASSYAGDTTINSGVLAVGAGGTLSGASTVNLTGAGTLDISAGGNQSIGGLAGVTGSSVVLGGATLTTGGNNGSTAFAGVLSGSGGLVQSGTGTLTLSGDNVYTGGTTINGGSTLQLGNGGSTGSVLGDITNNGSLVYNLGSTATVGGVVSGSGGLTQAGSGTLVLTGNNTYTGGTTINAGGTLQVGNGGATGAIVGDITNNGALVSNVAGNTTLGGTISGSGGLTQAGAGTLVLTGNNTYTGGTTINAGGTLQVGNGGATGAITGNVANNGSLVFDVAGNTTVGGAISGSGGLTQAGGGVLTLVGNNTYTGGTTINTGGTLQVGNGGATGSIAGDITNNGSLISNVAGNTLLGGTISGTGGLTQAGSGTLVLTGTNTYTGGTTINTGGTLQLGNGGATGSIVGDVINNGTLVSNVAGNTTLGGTISGSGGLTQAGSGTLTVTGNNTYTGPTTINTGGTLQVGNGGATGSIGGSVTNNGSLVFNVGGNTTVGGAISGSGGLTQAGSGTLILGGNNTYTGGTTINTGGTLQVGNGGAGGSIAGNVSNNGSLVFNVGGNTTVGGTISGSGGLTQAGAGTITLTGNNTYTGGTTINAGGTVQVGNGGASGSVTGNITNNGGLIINTGGTTTLGGTISGGGSIVQAGPGGLNLGGNSGGFSGTGQVTGGGLNVTGNIGGQWTIGSGTTLSGTGTIGGTGGGVTVSSGGVLSPGNGPGNGSGAGNGTGTITVGGNLTLSPGSTLGIDLGATGSDTVQVGGSANVGGSSVQVNTISPSTSYQQGQQYTVVNAGGGVSGQFASAKTPSAFLTITPIYTANTANLQIDVAQTAAFTTAAKTRNQYNTAAALDSLPQSGSALGLYNTVLIYDAATARSAFDQLSGEVHAASRAVLLYDNYLEEGIRQRLGSELPTVRGERASAWLAGSGKVFKQDGDGNGDDIRSNRNALMAGVDWQLGEHVVLGAAAGNERLDTRLYDRSSRARLRGNTFGLYAQGQWNNGFAVGGSVSRGDYRTRTTREVPLLGQTLYSRQDSDVTIAQVEGSWTWSHGRTQLQPYVQFTKHWVDSDRAVEQGGSAALELEGGKDTLNVSTVGVRGRWDVGSGERFPAQLTVGLGWQHASGDTDVASRNRFAAGGNAFDVYSAVMARNALVSQLGVAVGLGRNSQLSMFVQGQHGDGRRDVGGQINLRVGF

SEQ ID NO: 9444 - protein, 1007 aa, Stenotrophomonas maltophilia
MKTNLRNNLKSILFLTLIVFCFNQSFAQETEITGTVTTTTGEPIPFANILIKGTSQGTSADFDGIYSISAASDQILVFSYVGFKTLEVPVGDQKVVDVQLQEDVATLDEIVVVGYGTQDKKDLTSAISVVKSDQIQKRQTTTVAESLQGLATGVNVRGGGQPGQEAKIEIRGLKNLQNANPLYVIDGLVTTANRDFNPNDIESIQILKDAAAAAIYGSRAANGVIIITTKKGKQGPLQVSVSSKWSVTEVPRYDLAGQEEFVRLNNMAYDNAGIPRQDLNLDVNTDWQEEVFRTGLIQDQNVSFSGGGENSSYFMSGNYFGNKGTVIGTKFDRVSFRVNSSGTKGIFSIGENLALSNSKNNEIGGPEALRGNPFIDVVRLFPTIPVYDEDNPGGYGYGKSGVANTFAANPVAISNLIDQSIQNFRIRGNVWAELNPFPFLKYRASFGYETSFDNFKYLRKEGSWTLNQPYEASFTNQNRAQSQTKLLENTLTFTHDFGKHGLTVLAGTTYQKDSYEQINGLKRNLLVNPNTGEYFDVLDLGDQAQVGGFRNEASLLSYLGRLEYNYDDRYLLNAVFRRDGSSRFSDANKWSNFPSLSLAWRLSNESFFNIESISDLKLRASYGELGSGNIGNYEYQGFINTFGAIVLGTGQNLTPSATQVRLANSELQWETLKQTNLGLDLALFKNKLQITADYFIAKTENVLFGFPILLSTGNDGGNPIANAATVENKGFELNIAYNKVINNDLSFNASLNFTKLNNKLVKLGNGLNESIQGNTITRAGGPVGMWYVLQTDGLFQSQDEINNYTNSEGEVIQPGAVPGDIRFVDFNDDGEITNEDKSIVASPWPDFEMGFNAGVTYKDFDFSMNWIGSFGATVYNGYRSIVDRFDDDSNYRAGVQPWTPENPNTDFPRIVKGTTLNSRADSDRWLEDGSFARLKYIGLGYSLPQNTLEKIGFSKVRLSLSAQNIITITGYEGLDPEFSNSNIFQRGVDLGSYPNVQTYSLGVEFGF

SEQ ID NO: 9445 - protein, 795 aa, Stenotrophomonas maltophilia
MTRKTSLIAAAVAVALGGSPFVAAAQQAGTAANTLDTVIVTGTRVADRTVAESQSPIDIITPEALQSTGTSELATALSRALPSLNFPRPALTDGTSGVRPAQLRGLSPDQVLVLVDGKRRHTSAMINVNGSIGRGSSAVDINAIPIAAIERVEVLRDGASAQYGSDAIAGVINIVLKGSGSGGSLAVDYGQYSAGDGNKYQLSGDTGVEFGNGRGRVHVAGQISQQDESNRAGPYRGSTPNTGNYPSIGQKTFIVGDPRVDATAASVNASFDFSDHVTGYASALLSNRDITSFAFYRSRNHLNQTALLAQTYPDGFVPEINQYSKDRSLVAGVKGNTDSGWTWDLSLNHGENTLDFHTRNSINYSLGATSPRSFYDGTLKYQQDIFNADLTKSLDWGLAYPVTLSFGGEYRKEKWDQKPGELNSYTGSGAQGFGGFTPTNEVHADRHNYAVYAGLEADLTEKFSAGITGRYEDYSDFGDRFSGKLSARYAFTDKVALRATASSGFRAPSLAQQGYQAVTSQFTNGVFVERGTFPTTSQAAQALGASPLKAETSTSYSLGLVLQPVDRLYITVDAYQIDIDDRIALSSSITTNAATSALLGTLGLPQVTAFSYFTNGLDTRTRGVDFVSSYTVPFSASSLELTAAYSYNDTEVRRVGGTPAVFGTLGLNQSLIGRDEIGRIEDSYPRDKAILSGTWRSDHWELGLAATRYGKFTVRNSATALRDQTYGDAWVVDASASYKPSSNWTLTVGADNLLDKYPDRTEDLQNSTFGMLPYSNYSPFGFNGAYVYGRVKYTW

SEQ ID NO: 9446 - protein, 689 aa, Stenotrophomonas maltophilia
MSVRKKLISSYFLAAVSSVGAHESAELSTVEVRAKAENLEGIAASGSEGVVSSQRLAAVPILRPGEALEMVPGLIVTQHAGDGKANQYFLRGFNLDHGTDFATYVGGVPVNMPTHAHGQGYTDLNFLIPELVDRISFRKGPYFAEEGDFSSAGAAHIDYFRQMDASLAQITLGQKGYVRNLLAGSPEVGRGNLLYGLELFHNDGPWEVAENYRKFNGVLRYSQGTRNDGFSLTGMAYRGQWTSTDQIAQRAIDRGQVGRFGTLDSTTGGETSRYSLAGEWARRWANAQTKANVWWLKSSLDLWSNFQYCLNDVAHSGTCDTGDQFKQGERRQSGGFALSHAMFDRWGAFEVENSIGLQSRIDRLNPVGLYATSARQTVGTVREDKVTQRSLTLWGQNETRWTEWFRSVQGLRADAYDFDVESSLAANSGKASDQMVTPKLALIFGPWQKTELYLNYGHGFHSNDARGTTIKVDPADGTTPVQRVKPLVRTKGYEVGARSEPVAGWQSTLALWQLDAASELLFVGDAGTTEPSRPSRRYGLEWTNLYVLSDWLAIDADLAWSHARFRDQDPTVGDYIPGAVATTANIGLTFDHLGPWFGALRLRYFGPRPLIEDNSVRSGSSALTNLRTGYKIDQRTQLTLDVYNLFDRKENDIEYWYDSQLRGEGTSASDRHIHPAEPRSLRLTISHRF

SEQ ID NO: 9447 - protein, 319 aa, Stenotrophomonas maltophilia
MAQRDYVRRSQPAPSRRKKSTSRKKQRNLPAVSPAMVAIAAAVLVTFIGGLYFITHHKKEESETLQSQKVTGNGLPPKPEERWRYIKELESRQPGVRAPTEPSAGGEVKTPEQLTPEQRQLLEQMQADMRQQPTQLVEVPWNEQTPEQRQQTLQRQRQAQQLAEQQRLAQQSRTTEQSWQQQTRTSQAAPVQAQPRQSKPASSQQPYQDLLQTPAHTTAQSKPQQAAPVARAADAPKPTAEKKDERRWMVQCGSFRGAEQAETVRAQLAFEGFDSKITTNNGWNRVVIGPVKGKENADSTLNRLKMAGHTNCIRLAAGG

SEQ ID NO: 9448 - protein, 368 aa, Stenotrophomonas maltophilia
MRLHTKLVAALAVASPLAYGQTSVTLYGRLDAGIEYMNHIDNGAGGNSSRWRGEGGDWGTSMLGLKGSEELGGGLKAIFNLETGLQVMDGTTSGGRLWSRRAFAGLSSQTWGTLQAGRNLFIDSDGVWEFDPFVQQAFSSASLVRGRNWQQTSNNVEYHSPNFWGFDVQAQYAFGNQPGAFNSGASGEFGRSDGIMLTYHSQLFDVRGIYDELRDSNGRFSNIFQSSREYFVGANVHFDAVKIQGAYTHYSAPDSPAGVADTADHYWLGATYNFQPRWAVTAGGYYVKVGDGTGDAAHDPSGHAMMYVLGTTYNLSKRTFVYGTVGYVRNSGNSNFSLQASPRDAANNTNPLVGESQTGAYVGMLHQF

SEQ ID NO: 9449 - protein, 870 aa, Stenotrophomonas maltophilia
MLLSIAKQANMQLVMRANVEYGEDNKRYKALKQQSSLDDLLSQVLRDSPFNYQILVDTHVILILPKTVVAPENSDALEVNRVWEHILVTGHGSENRNLLSSSTSVSYISSGTLQQLSNENTAELLQNVPGFWVEGSGGETNNNVAPRGLRGGEGFRFISLMEDGIPIVYDGVWPDFFLRQDLMTQGIETIRGGSSGIFTFNGPAAIVNFITAKGTEKQVNRLKLSQGLDHHFTRLDGLTSGAINEQWFYAFGGFYRQSDGVREPGYTADQGGQFKVNLTRKTKAAEMNFSYRFLDDKTSFFSPTPMTNANSPQGVTGIDASYGTLLSADFNNLTFKSPEGSFQRDIEDGQQSKLHRFNASIDWDVAEKILLKNKFSVADMENTMYALINLGNDTLLDAAERLKQKDITDFINQQQSQGATQPAYVYSHSQQIISNPADLNSNGLITTAYPLYSHYQQKQWLNHFSVNVDLDEVQVSLGHMFAYNDFGSLPLDKWQGEILTEVKDQPRRLDIVALDDRDNVVASFSEQGFTSYAGPGYLDGEGEAISNSIYGYLEWQPITPLLLDFGLRWEHLSLTSTAGTDSVYALADSNFDAVYKSGYTFTKNDDFNKLAWNLGGNYQLSPLSAIFFHLSSGFEMPKLINFGNEIGWGDYQDTIPEEAGFGDPVELTFAEGGVRLADNNWRITAALFETRFNPLPFTVFRGIYDRQQSIFIDTKTRGIEFDFTVNLTKQLTVAGLGVWQKAVLSGIPSDAIESAYNGNQITRTPEFQLRISPSYTIDKARFFLTYAYIGKRYSDIANNFSLAAYSVIDLGFTYQLTKQFSFALHGKNITNSVGLTEGNPRNALAHRNSTNFYARAIFGRSVIASVEVTF

SEQ ID NO: 9450 - protein, 426 aa, Stenotrophomonas maltophilia
MTSRNPLSMARDGASLTLGALLALPLAAHAAGFVEDAKGTLTLRNFFINRNFKGDNATRSKAEEWTQNLLLDLKSGYTEGPLGFGLDVLGLYSVKLDGGKGTGGTQLLPLDHDGKPADQFGRLAVAGKLKFSETELRAGEWALVLPILRSDDGRSLPQTFRGSMLTSKEIENLTLHAGHITGNSPRDDGSMEEMTLFGTSPYTSDRTSDDFDFGGLEYSFNGKRTLVGVWYARLKDIYKQRYIQLQHSQPLGGDWTLGANIGYFDGEDDGEALEGHLDNKALSGLFSLRTGAHTFYLGLQRISGDSKWLRVNGTSGGTLANDSYNSSYDNARERSWQLRYDYNFAALGMPGLTFMTRYISGKNIHVGAVDDGEEWGRESEVAYVVQSGAAKNLTLRWRNTTMRRDYGSDNQFNEQRLIIQYPLSLF

SEQ ID NO: 9451 - protein, 437 aa, Stenotrophomonas maltophilia
MRKTSLALAVAASTLGLSQVAVADFIGDSKANLTLRNFYFDHNTKNTANNEGEAKEWGQGFIFNYTSGFTEGTVGFGVDAVGLLGVKLDSGGRANKTGRDRTPGALFPLESDGSAVDEFSKGGLTGKVRVSKTEARIGTLTPRLPILVSNDGRLLPQLFEGGQITSNEIDNLTLTAGQIEHAVGRASSNSTGLSVAGGSEASNKFYFAGGDWKVNSDLTAQYYYANLEDYYKQHFAGLGHNLALGEGTLKTDLRYFRTTSDGKNGKEAGYSVGGYTRNGDGKIDNNTWSAAFTYSLGSHAVMLGHQRVSEDSNFVQLNQGGIEGSAGASVYLLTDRLVNSFTRAGERTTFGQYSYDFANLGAPGLKASVIYLKGTNIQVAGANEAKEWERDIALDYVFQEGALKGLGLGWRHGVLRGNAATDADQNRLIVSYTLPLL

SEQ ID NO: 9452 - protein, 170 aa, Stenotrophomonas maltophilia
MQGDGPPFGPFVKRGKGGSVAGVDVGYQWNRYFAAEIGWIHLPTVRYLVPSGLPVAGGRISEHSWLGYIALKLAFPICGNLYAYSKVGAAGLNIRTRINFTPVNDLTQNGDFWSPLFAVGLQYYLNWYWFFTLQYLHVNGYGRASAGAIQKLPSPHSDLFTFSVGYKLAI

SEQ ID NO: 9453 - protein, 488 aa, Stenotrophomonas maltophilia
MFLIISEIYLFLFRTHVKYKDEDKFKQTHNWGNILLNTRWNHVFTPQLFSNTTLAYNRYVFDIRQEETSSIQQPDGSTIINGSNNLFHSGISDLSISTDFDYHPLPAHNIKFGAKYIYHQFAPEVQTVNQHNSDNGYPQTNDNYSLNNSHIHAHDFSLYAEDDLILNEHWKINAGLHFSFFNVQKQTYLSLQSRLSISFQATSNIILKSSFSQMSQCTQLLSTASLAMPSDLWVPVTRHIRPMKSFQYAVGVYYTGIKNWEFSIEGYYKDMYNVLEYKDGESFLGSSHNWEDKVEMGKGRSFGVEFMAQKTAGLLTGWINYTLSKSDRQFSTDGINNGKHFPYQYDRRHTLNLTLNYQLTRRIDFNMSWTYASGCMATLPTEKTHTELPPTNVPPSWIMDNLNKGDMDHYSSRNNYRLPASHQLNIGFNFHKQTRHGERIWNISILNAYNAMNPNFVYISREAQTGKPILKKMTILPCIPSFSYTYKF

SEQ ID NO: 9454 - protein, 733 aa, Stenotrophomonas maltophilia
MTSPIQSSATPPRRPAASVAFAMMTCAAAPAAADDTDPRRAPHLSPIVVQGERDTGSRVDRSGSAKYATPLLDVPQTITVVPREVLDEQQVTSLREALSNVAGITFNAGEGGGGSGDMLLIRGFSAHANLQLDGLRDSAQNNRSDLFNIDAVEVIKGPNSVFGGAGTTGGSVNLISKAPQRKAFIEAGTVLGTSGYRRATLDANRPLPGSDGSSVFRLNAMAHVNDVPGRNDIRKRRWGVAPSLGFGLGTPTRVTLGYFHQYDHNLPDYGLPARNGQVLGGVARDAYFGWRNLDRERIESNTFTVKAEHDVSPQLKLQNLSRYAHLNRDTVVSASHANLDGMPPGRYKPAGPQGYGRDASTAMWMNQTNATGEFSTFGVGHTLVAGFEISRETYARSTYSHGLARHFPKNGYALAAPPGYWTGPARRENTARTDTALDVKALYAFDTISFGRYWDLDVGLRHDWIDGWARNTPAGKPTERGETSDRHLSTRAGLVFKPTDNGRLYAAYGTSFNPSAEFLVTTGSGVTAASGGLAPEKNESVELGAKWEGLAGLAVNGALFQTYKHHARERMSDGTYLLAGKQRVRGVELGAAGKITPKWDLFANYTYLASATLDSPSSPRRNGKALGNTPRHAFNLWTTYRLPAGWTIGYGSHFVGRRNVTSEGDGTLGAYWVHNLMASYDVNRRLRFQLNVDNLFDRAYVERVRQQPGNASRSSAVEFGDGRAAMLSAVYTF

SEQ ID NO: 9455 - protein, 170 aa, Stenotrophomonas maltophilia
MTGGVMSQKFVVGAGLLVCSVCSLSAMAGSKPVDLILRVLVDAPPPCSIKGSQVEFGNMIADNVDGTNYRQDAKYTLNCTNSLANDLRMQLKGNTSTINGETVLSTNITGLGIRIENSADNSLFAVGENSWTPFNINNQPQLKAVPVKASGAQLAAGEFNASLTMVVDYQ

SEQ ID NO: 9456 - protein, 792 aa, Stenotrophomonas maltophilia
MNPSPTVTGLPRLRIAAVAAALCIAGLAHAQPLAVDLPAQPLAQSLNALARQSGAQIIFLTDVAQGLQAPALRGTLEVREALQRLLAGSGLQVRAQDERTFTVERSGGPAASSGAGGAVMAEVRVLASRAEDTAYYAPSAASGTKTEAPLRDVPQTINVIPQQVMRDQAATSLQDTLRNVAGIGLSHGDGQRDQVSIRGFTSIGDQFVDGFRDDALYFRDLSNIERVEVVKGPAAVLYGRGSSGGLVNRVTKKPGVNVSDVAVSVGSWADKRAEFDVGRAPEGSDWSWRVTGAAEDANSYRSQQFLKRETIAPSVMWKPDGNTSLTLQAELLRDKRVTDFGIPAYRGRPVDVAPGTYYGSANARDADTSESTVGSFTATFNHRFSDTLRVRNALRYYHYELDRQNTLPAGTTNEAAGTVALTRSGVDRNEHGIFNQTELIQNLRTGSVQHEVLYGVELGQQNKDALSFSGGTLANVNLWNPVLPVAPLNGGGTLSGSTLNRYLTRALYLQDQVTLSPQWKLLVGLRYDRFGQETDNRLAGQSDFSRTDSTWSPRAGLVWQPDAVQSYYLSVSRSYQPSAEMFALSATNAAIKPESTTNYEVGGKWDLMDGKAMATASLFQLERTDIKTTNPAQPTQLIPIGTQRTRGLELSLSGELRPGTQATFSYAYLDAVVTESTTVDAGQPVQGKRATITPRNSLSVWLTQRLGDAWTVGGGLNYVGDRFANPGNTVTLPAYTVVDAMAQYRIGRATTVQLNLRNLFDRRYIVSAHGTSPNLNLPGAPRNVMVTLRHSF

SEQ ID NO: 9457 - protein, 201 aa, Stenotrophomonas maltophilia
MKRMVSALALTSALAALAGPALAQQQGDWTVGVGIANVNPKSGNGTLANQDADIDDGTALSLTVEYFFRDNWGVELLAASPFEHDISLGGTEIASAKQLPPTLSVNYHFPTQGAIKPFLGLGLNYTTFFEEEIAGGGTLKLDDSFGVAVNAGADYQISDNGALRFNVRWMDIDTDATLNGDSIGTAEIDPVVVNFAYVHRF

SEQ ID NO: 9458 - protein, 768 aa, Stenotrophomonas maltophilia
MLAGIISQALIPTYANSQERTSEQQVETEEKIVVTGRRVTQTDIAIGTDEATNTLAVSREELLSAPSGISGLKMLESLPGFNVQTDGALGLYEFGNSVQVRAFQLSQMGFVLDGIPMGRSDAFGGSPIFRYVDNENLGAVIASPGAGDVSAPTYASLGPIAQYNTVRPSDEMGGMVAVTAGDFDLQRTFVKLETGDIDGFKAYVSRSKTDSDLWRGPGTIDREHIEAKALYEFGSSYIQATYVANDFFDYDSPSAPASVFEDDYYYSYLDSIPEGCIEPQPEVYDFNGDGTIDDTDFTPVFTGSNCTSYYEDRINIRDDKLYSLGFGTYLTDDIQLEATAYYEDKNGYGVSPDSYSNTLSIYTDQAAAGLDVVHPRGVQYGLSTVGGEREGLVGSVTWFVGEHKFEAGGWVEEDTYNRTQARLNKTGGSADGDVIYDEVAYYRRNYTAVRDTTQLFIKDNFAMMNDDLLLEVGFKSLSIDYSLDGYRDYNDYEIDGELGYGPQSIEAEYTDNFLPMVGAVYRLNESDQLFASFAQNFALPAGTDDIFDNAVGFDVEAPQGEEADNYELGFRTNREHYNGAVALFYTQFDNRLIASSVINPATGQPETFYVNAGASKAYGIEFSGVFQPEMFDRKLYFNANISYKKAELEDGFAGNPAGSQLPDSPEWLMTGGITYEPTEWLVANFSAKYTDIRYTDFNETYELESYLVAQAYVDIGGPNNFGMPENIRLRFNVDNVFDKEVMSFGFTGSSFGRPLSPRTFQATLTVDF

SEQ ID NO: 9459 - protein, 707 aa, Stenotrophomonas maltophilia
MTPRLLSAAITVALLAAPVGAAFAADADSERTTDLDTVNVIAKLEAARNALSPDIGSSQFAITADDIDRLPLGAATPLNQVLLQAPGVVQDSYGSIHVRGDHANLQYRVNGVMIPESISGFGQSLEPRIIKNLKLLDGALPAQFGDRTAAVVDITTKSGAELGNGGSVGITAGSFGTINPNASLWGSSGRWSWFVSGDYDQNKNGLENPVDSLNPIHDKSHQGKGFADLTYLVNENTRLSLLVGYANNRFQIPNNPGQTPAFDYLGTTDFDSARLDEKQRENTRFGTLALQGTIGDTNYQISAGQRYSSVAFSPDVAGDLIFNGTASQVDRSNRANTVQADFATPWGGSHTLRYGLYGNFEHAIASNNSYVFPANDDGSQSSNVPLFIPDGSRFHASTYALYLQDEWKIGNDWTVNYGLRGDKYKAFGNTEGQLSPRLGVIWRASDSTTVHAGYARYFTPPASELISTSDIALYDGTTNQQSAGNGQTTPLSERSDYYDLGISQVVTDHLTLGLDIYDRKVDRLQDEGQFGAAYVYSTFNYRYGRIRGAEFSADYTNGPVTAYFNIAYSKAMGKRVITSLYNFDPDALAYTYDNWIHLDHDQKLTSSGGINYAFSEGSKVGLNYLFGSGLRTDTDTVPNGASLPSYFQLNASVGHDFDVNTHPLHVQLAAVNILNRSYQLRDGGGIGVFAPQWAPRRGVYVSLQQDF

SEQ ID NO: 9460 - protein, 341 aa, Stenotrophomonas maltophilia
MNVRSLSALALVCASAWCIASQAVQAQTSVTLYGLVGLDIASSKRSNGPPAALAEQSPGLTAPYWGIRINEELGAGYHAIAVLESFFQPTNGGLGRTAADPFWGRNSYVGIAGPFGRVTFGRHTNLLYLAEQVANPFQASILFSPLVMQTFTAPYGGAIAGDTVWNNGIQYTSPNLNGLTATAVYAPGGVAGANGIYNAAFSALYAGGSLTAVATVQRTRVVAGVAAPTQNAYIVGAAYDFSLFKLYGALQGLRTDSTDVGAHTFETGLSVPLTSQLTALAEWAYTRRSAPKNIVTGRNTGSAGLDYFLSKRTDLYLLTVYDRLSGYGTAMTYAAGIRHRF

SEQ ID NO: 9461 - protein, 192 aa, Stenotrophomonas maltophilia
MTVVNKSFLTILIFFCQILFPLNASALEAPRTVKAWASVLGDNIAETWNEPQHVDLYVPAITWHARFAYDKEKTDRYNERPWGAGMGKSRWDEKGNWHGLYVMAFKDSYNKWEPIAGYGWEATWRPLTDDAFHVGLGYTVGVTARDNWDYIPIPLVLPLASVGYGPATFQMTYIPGTYNNGNVYFAWLRLQF

SEQ ID NO: 9462 - protein, 811 aa, Stenotrophomonas maltophilia
MTRPTLSVIGMAIAAVLSANAQAQQADAGATTLDTVIVTGTRASDRTVLESTVPVDVLTAEDIRKAGVVNGELGSALQALLPSFNFPRQSNSGGADHIRAAQLRGLSPDQVLVLVNGKRRHTSALVNTDSKIGKGTTPVDFNSIPINAIKRIEVLRDGAGAQYGSDAIAGVINVILDDNPERGELEASFGAYNTDVAPIDRRVTDGQTSYASAKVGTLLGDDGGFFKVGLELKNREATNRAGFDQIPSFEEQTPANLALRGQRNYVLGDGATKGLNAWLNSKVPFSANGEFYAFGTYNQRDTEGANYFRYPDSSANWREIYPNGYRPISEGENRDLQLVAGARGQWGNWDYDASVNYGRNDFTYRLRNSLNASLGPGSTTRFKTGDFAFAQTVGNFDLTRVLDAAGATHTFGTGAEFRREQYRTHAGDPASYAAGPFTDRPTGSQAGGGLTPQDEADLSRNVASAYANVSSQFGDKFSTDLAGRYEHYQDFGSQWTGKLAARYAFAPAFALRGAISNNVRAPSLSQIGYEATSTGYDAAGRLTQGRLLSVNNPIARGLGATDLKPEKSVNYSLGFTSKVGDHFDVSLDFFQIDIDDRIALSEDITGDALTSFVQQNYGVTGVQSASYFLNAADTRTRGAELVANWRQYAFGGDLLLTGTYSYAKTELENIIATPAQLLALNPEYVLFGVEESNTLTDAAPRTRASLAANWSNEHWNLQTRVNRYGSATRVFDFGGGFVPRQTYGAEWQLDLEAEYHLGTQWTLAIGGQNILDNYSDRSIDDIAYFGNLPYDVLSPIGSNGAYWYGRVRYSF

SEQ ID NO: 9463 - protein, 412 aa, Stenotrophomonas maltophilia
MPSSYAWPVAFGAALGFMSLGAPSGAAVAPVTLAQALQRAQAQSPLISSAQAALDAARGRARQAGFSPNPEAGLQSENIAGSGPYQGISNAETTFSLGQRLELGGKRRTRVATAQAEVETAAVRAAIARADLTQEVKTRYALALEAKARVAVAQEAAERARDLARVAAALVEAGREPPLRALRARTASDEAEAAVLAAQTLALAARRALTSLWGDPDFEIELVEPLAAPTPQMAVDPNISLDVRLAQAERAAAEAAIERERAAGDPDLTIQAGVRRFEQTGDRALIVGFTAPIPIRDRNQGNVAAARADANAAQARERLALTGSIRAMRDAQASLKAAEARLEVLSSRTVPQAQQAVDLARQGFEAGKFSLLDVLDAQAALLASRNDLIAARLERALALAALERAAAQEDRS

SEQ ID NO: 9464 - protein, 389 aa, Stenotrophomonas maltophilia
MRPIPTLLALSLAALPAFASAADFDNWPTKYAFGDGTELAATANIAYDYNDFSSGSGLEDDDAVRRKEFGATLKKKGVYDAMVYYDFQSDTWLDVFVRFESKAFFGRDIGRFRFGYMKTPVGLDANTSSRAGSFLETALPVQAFYAGRRTGVEWVLERPQYLLQAGAYGGKDLQGDNPGTTQAVRAVWTPVKAPGDVIHLGLAYSQENPRGYSDGRDVHHEASARLRARPEAGLTDIRFVDSGALVTADQIRRTGLEGIWIRGPFSLQAEALRATVTRNDGKPDYTGSGQYAMASWVLTGESRPYNAGAVANIKPAHDYGAVELVARYSRLDLDDGSILGGRQHDLTLGANWYLTSHFKFQANYVKVDASRRGVHSTPEIFELRAQMHF

SEQ ID NO: 9465 - protein, 391 aa, Stenotrophomonas maltophilia
MEFTFAWRRPAAMMALAALSAPAFAAEDDRPVTASLGGRLHLDFATFDNDNRGTPNKDDTEIRRAWLDVSGKFFVVDYKLEADFSGDRVEAKDVYLARSFGKAGKLTVGQFKQYFSLDDRTSSNYGSFLERGNAGTTLAPLYRLGASWQANPGDFTWAASIYSLESIDAWQVKGRAAGGRVTWAPSPSEGDVLHLGLSLAREAYDNPGANGTPGLSIRPRPAGHLSDESRLTLVNFSAGRDTDVNKWSLEYAQVRGPLSWQGEFSGATFDDGAQRGDVMAAYGMLSWFVTGESRAYDRKTGRFARVKDIRHKAGAFEVALRYDQMWGAQHLDGAPDLRRGSTEAWTLGGNWYLRDNLRFMLNVIESRNRDRLAGVTVDRTRAVTGRLQYDF

SEQ ID NO: 9466 - protein, 718 aa, Stenotrophomonas maltophilia
MQRTTKHFQINALALAIAMSTISAHAETDQQTSEYGTLPTIKVKAGSGQENEKSYIAGKTDTAVPLGLSVREVPQSVSVITQQRLQDQQLSTLVEVAENVTGVSVNRYETNRGGIYSRGFVVDNYIIDGIPTTYSLPWSSGEIFSSMALYDHIDVVRGATGLTFGAGNPSAAINMVRKRATSTEPTANVEVSAGSWDNYRVMGDIANSLNQSGTVRGRAVAQYEQGDSYTNLLSKEKLSLLLSAEADLSENTLLSGGVTYQEDDPRGPMWGGLPVWFSDGTKTNWSKNTTTSADWTRWNVKYTNLFADLTHKFNDSWSAKLSYSHGKRDANSKLLYVSGSVDKNTGLGLSPYASAYDLEVEQDNASLQLNGSFDLWGLEQKVVLGYQYSNQDFTAYARSTGTKMDIGNFFEWNGSMPEPVWNAPKLNEKYNIEQNALFAATYLNPIEPLKFILGGRFTNYEKNIYGRNSSIKYDHEFVPYAGIIYDFNDVYTAYASYTSIFQPQDNKDFDGNYLDPVEGNSTEVGLKSAWFDGRLNGTLALYHIKQDNLAQEAGQVTRNGVKETYYRAAKGATSEGFEVEVSGQITPDWNITAGYSQFSAKDANDADVNTQLPRKIIQTFTTYKLPGKLENITVGGGVNWQSSTYVNAKNPKKVIEKVEQGDYALVNLMARYQITKDFSAQLNINNVFDKKYYGVFPAYGQITLGAPRNAALTLQYKF

SEQ ID NO: 9467 - protein, 697 aa, Stenotrophomonas maltophilia
MNPAARRHCLPLSALLLSPLAAMAEPAPIALPAVQVQAARVPGIDPFALPASQDTVWIDAGRAGNSVQLSEALAGVPGLLARDRQNFAQDTQLSIRGFGARSTFGVRGVRVLIDGVPATMPDGQGQLSHASLLGAERIEVLRGPFSALYGNSSGGVLQVWSAQGQASDPWRLRLNAGADNTLSIGAQLKGASHGLDYNIAANHFRTDGWREHSRARRESLTARIGGDLGGGRLELLLNALDAPDAQDPLGLTRAQVAADPRQATAVAHQYNTRKSVRQQQAGLRWTRETDAQRWQLMGYAGQRAVRQYLPIPPAAQTNSPLHAGGVIDLEGGYGGLDARWGWHGDLAGRPLDLVAGLSADRQRQHRTGYENFIGSALGVRGRLRRDQIDTVQNVDQFAQAWWQWSPRWSLLAGLRHSAVRFESDDRYITGRNPDDSGRRRYQATTPVAGVSFEASPQWRLHAAVGRGFETPTFNELGYRADGQAGLALDLAAARSRNLEVGSKWHAQDGTQLDISLFRADTDDELAVASNIGGRSTYRNIGRTRRQGVELQYRQPLAEQLELQLAWTWLQAQVRSPYLTSNNVVAAGSRLPGVPRQQAFARLQWTPADWQWALEASASSDTVVNDVATERAPGYALLHVEGGRRWTLPGGELRAFARLENVLDQAYIGSVIVNDGNGRFYEPGPGRRASLGLQWSWR

SEQ ID NO: 9468 - protein, 757 aa, Stenotrophomonas maltophilia
MSPTRTSRGRLPVARPLVAALSALLPLVAAAQETPAAKDPVALDALQVTAQRRVENAKDVPVAISAIQGEKLDVLGSAGDDIRFLAARVPSLNIESSYGRAFPRFYIRGLGNTDFDLNASQPVSLVYDDVVQESPLLKGFPLFDLANVEVLRGPQGTLFGRNTPAGVVKFDSARPSQDADGYVRVGYGSYNSWNVQGAYGGPLTDRWSARVSAIYQRRDDWVDNTRAGAPNSGFEGYDEAAGRVQFLYEGDDFEALFNLHKRKLNGTARLFRANIIEKGGNSLVENFDRDKVANDGVNFSDLKTWGGSARLQWNLGSVTLHSITGYETAESLNRGDIDGGYGDASLGAGNYGPGFIPFSSESADGLPHHRQWTQEFRVESNEWGRFDWQAGVFYFDEDVTINNFNYNSLKPGNPQTGHVVQNQRNKAWAVFASGDFDVTDRFKLRAGVRYTQDKKDFNASVLQAVLPFGTPVSGPYLANTDVNDVSWDVSGVYKLTDNVNAYARVAKGFRAPSIQGRLAFAPGLSQADSEKVISYEAGIKADLFERRARLGLSVFRYNVDGQQLIAVGGTNNTATLLNADKTIGQGVELDLEAYLADNVLLTFGSSYNDTEIKDKDLAVAICGGGCTINDPTTVINGGTYALVNGNPLPQAPKWIHNATLRVGFPLSDGSELYAYTDWAYRSAVNFFIYESPEFRGRSSLEGGLRLGYNWDYGQYDVAVFGRNLTNQTRVVGAIDFNNLTGFLNEPRTWGVEFTAKF

SEQ ID NO: 9469 - protein, 420 aa, Stenotrophomonas maltophilia
MAGPCRVTHHTKIFLEDGESMKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 9470 - protein, 929 aa, Stenotrophomonas maltophilia
MKHSISLLCATSALCWTAAVAAEIDGRVTNSDGDVALRGAQVTLVDTGRTVTTDRDGGFRFAGLAAGEYTLEISYVGTPTQTVTVTLDDAADTAMPRIALADGEDIFIVEGQIGQLNAALSQQKAADGIKTVLSADAIASLPDENVAEAARRALGVSVANDQGEGRFITVRGISSQLNSTSVNGVRLTSPEAGDRRIGLDVVDADILKNIVINKSLLPDMDGDAIGGSIELETISGLDRDSRFTKLKLGYIYSEFSEEFGPKVSGTYTDRFADGRLGVALSGSFQNREFATENKEVDGEWVTDEALPYPEEQLELRNYDVERERLSLAANFDFMATEDLKLYVHSLFNDFSDQEYRSRVEVDVEDADFAFDTDAGIVTASDASDTLRIDRDIKDRLEEQQIWSVVTGFEKTKDVWTIDGSVAFTHAEEAEPNRLDTNFRRDFEGEGVSIGIDVNDPVKPRLVNIPGGYLDASQFEFDAIELTNGETEDEELALTFNVQRDVEFGRFPGFVKVGAKSRMRDKSYDLDFDVYEAGDDLALTLADVATTVDYPLDVFGPAPSVGAVRDFFFTNVGNEDLLEFAEDDSIIESAVSSYDSEEDILAGYLMGQIDIDNVRITGGVRVEQTDFSVTGNVVDEEDTGTIVQTKTDNDYTDVLPSVALRWAVSDDFIVRASYFESIIRPNFGQATPAGVINEDLELEVGNPDLERTEAANFDLLFEYYPSASSVLQAGLFYKDLENLITGTTSNVDGVFNGLAYDEISTFQNIDDAEVIGIEVGYQQALTFLPAPWDGFLVAANWTYTDSEATIRVDEDGDDVFEEIIKIAVPGQSDHIVNAIVGYDKGRWDLRAALSYKGENIDDVDIDGSAGDGRIIPEQTFLDLSAKYEVTDRLKVYGELDNVLDTEFQVTQNGGLLSQFEEYGLRAQGGIIFKF

SEQ ID NO: 9471 - protein, 412 aa, Stenotrophomonas maltophilia
MPAEAFGHIAPQLSPYRNWLAERGFSFEFSYKGEAMANVGGGISKGMSYAHELTFNTRWDLGKLLGLDGWILHAVMMERAGREVSYDHVGDHHILLSEVYSLSGHAAAHLADIYLEKSFFNNRLNINIGRITLTHTYATSVLLCTFMVQCSAPPAIKADEGWSVYPKANWGGTLRFKPTRDLTLRTGVYRVGALTENPSGWAWGSEHSTGVMLPIELTWEPFISPDNLPGHYKLGFAHDTSPYADRLGTIPAMFAKEVFHDATKPRDTFYIEADQMVYRKGGQHQMAGGYILAGYVHNTPSVSTFSDQVYVGASLLGIIPRRPFDRFGVMYSYYQMSPAITVGQRLRQLEGMSMGAFVNGPQTHSAILEAYYGVPIRPGLVLQPEFEYMMRPGQTSVIPNATLVGLKVLGNL

SEQ ID NO: 9472 - protein, 183 aa, Stenotrophomonas maltophilia
MIHLGLAGSYRDFGGNEYQLKDRAEVHLAQQIVTSGKTVAENLTLFGIEAAALFGPLSIQSEYMRLSVNADDGAEDAEYDGYYVELGYLLTPGYRNYSKGMLGEVVPTSPTGAWQLMSRYSVLNAEDNNEGVNAENFALGLNWFANKSVRISANYIMTQLDGIGADPNNDDGDAFSLRFQYVF

SEQ ID NO: 9473 - protein, 744 aa, Stenotrophomonas maltophilia
MYRATASLIAIALAAPAYANEKDPTDERQSQDGIANPSESIIVIGGRIDAYEVAGAADLIDGEELSEFEHGDVNRVLRQVPGVNIQEEDGFGLFPNIGLRGAPVERSSNITLMEDGVLIAPAPYAAPAAYYFPAIGRMDAVEVIKGAGSVRYGPRTIGGAINFRSTPIPTESLAGEASGQLGSRGYYQGHGWIGASADNFGAMVESYQQGSDGFKTIDGLPGAETGFQRQDYRARFAVHTNPDSPVDARLEFAYGRSELEANETYLGLADADFASDPYRRYSASQRDVFTGEHDQYRLTGTLRLPDDTQFAVTLYRNDFTRSWSKLQDIDFDGDGSFDAIQPVFDAPSSNERGLAILRGADSAEGALRIRNNNRVYRSEGVQLSFERPFETGEVRHNLAASLRYHEDEEDRLQNEEFYTQTDGDLVFVRQTAPGAQANREAKAKAIAFYLENRIEIGGLTLTPGIRYEGIDLTRLDYDRADPARLDGPARIRKTNVDEWLPALGATYALGDVLLIAGASRGFSPPGPGNPEARAEKSWNYEFGGRFRNGAIQASAIAFYSDYSNLLGNCTQSVGCSVGDIGDQFNAGAVSVKGLELAASTEHQVGREISIPFSVVYTLTDAQFESSFESAFFGSVSQGDALPYIARHQFYAETGLAFGPASLLVSANYTSQVRTEAGSGDISPDERIDERIVFDLAGRFALTEGLSLFARVDNLFDNAYAVARRPSGLRPGAPRRFVAGASVRF

SEQ ID NO: 9474 - protein, 902 aa, Stenotrophomonas maltophilia
MNTRKTLLSAAIVSCIAFSAHAQQAAQNATDLDTVQVTGIRGSMEKSLDTKRESNARVEVVTAEDVGKLPAHNVADTLQRLPGVNISSSSADEGGFDEADRVSLRGTSPSLTQTLINGHTVGSADWFVLSQGNNVGRSVSYSLLPSELVRSVEVNKSSQAKLQDGGTTGTVNILTRKPLEFSKQFTAEGSIGMVRSDQAKSNDPQLSALFNYKNDEGNFGVMVQAFSQKRELRREAQEVPGGFFQIDPNGTVAKSNPDLAGVYAPGLLGSTLFEQTRERKGGLVSLQFKPLDNLTLGLEGFSSELKANNYNRNFMLWGGRILNDRTVEDANGNKTLIPGQAPNPGYVVKDGVLTNATFAGQADRDYAVYDMIYRESKAKTNYITFDADWQINDNLGMKFQAGNTKGTGDTPRQYIAEVNLARGGGANWSTHGNGSPIDWNVGGNISPGGVTDFGTWGNQQVTAIDKEKWATVDFNQYFSNAGVLNSLDFGARFGDHKREAKSPEGATPGAIWNALKNGATANFPGGFANGIGGSFPRDLWYFTPGALKDAVTNNSTWLSGNDGPTGRHNYGAEWKVSEKNFAAYVQANLSGDRWSGNVGLRYVNIKQDIDTYAAATGSTVPDVSSLFGAWTRQAFDNKHNRVLPSANLKFDLRDDLVLRFAASQTQTLPDFSALGASSYGSDLNRTGGGGNPKLKPVVSTNFDANLEWYFMPRGMLSVGAYSMRLKDYVAFSTEKEMLFSELTNRLEEYNISRPRNADGKVRGIEVAYEQPIGEYFGVNANYTYADGSTEHTWADGSDNLLGTSKNTYNVGAYFENDTFGARLSYTRRSSFLIGLSGANPYYQDDFGTLSASLSYKATDWLSISLDGLNLNNPTYKYYQTAAIPTSFYSNGRQYYLNFRFKY

SEQ ID NO: 9475 - protein, 355 aa, Burkholderia pseudomallei
MTTLRLRSPHRCRPPALAAAATLAALSGPAHAQSTLTLYGVADAGVQYLSRADGQHAAWRLQNYGILPSQLGIKGEEDLGGGWRARFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSRGLSASAVLHRSHGTAQGGADRSAQRRDIGTFAARYAFASLPLTVHAGVQRLTGELDPARTIVWGGARYQASGRLGFAGGIYHTDSPTPQVGHPTLFIASTTCSLSKRTIAYLNLGYAKNSGRSAQTVYEYDPTPLAGASQFGAMLGMYHVF

SEQ ID NO: 9476 - protein, 391 aa, Burkholderia pseudomallei
MLPGHFPDMGDMMGDVMNAKSIAAAALAVAQAGLAHAQSSVTLYGALDAGVLWQNTSAASFSPTAPNTGAVVRFKDGGVYSSLWGIKGTEDLGGGYRVNFRLQGAFDGGTGKFGLSDAPGAVAAFNQIATLGVSGPFGTFNAGRQIVPMIYAMADTDVRAARFFGSVLTAWLGLNTAAGWPGNSTNAPIGALYDSDALVYQSPAFGGALLALEYAPGGVPGGVQRGARASIVLKYASNALNLAAVYYNGHDTNPAPGASATGLDNNRFVYVGAQYKLKDVAVSASYGNGRNPARGDRVNLDMFAFGLGYRVSPFFRVSSGVYYLKDRNRSANRSTSIVLGADYELSKHTTLYAQGGRVDNRGTMAQMLAYGQPVAPGLATTAAMLGMRHSF

SEQ ID NO: 9477 - protein, 1028 aa, Burkholderia pseudomallei
MKVRILWLIAFLLFTVQLSAQQKVTVKGKITDEHNEPVIGANIMEKGTTNGVISDFDGFFTLNVSSGATLVVSYIGFAQQEIPVKDKRDFVIRLAEDSETLNEVVVIGYGSARKRDLTGAVMQVKSAQLENESPSSMQDLLRANVPGLSVGFSAGPKPGGSLLIRGKNSINAGTDPLIVLDGVIYPGDLADINPNDIEQIDVLKDASSAAIYGARSASGVIIITTKMGKSEKPTISFDASIGVATQAIVPEVYQGDEFTAWRTDVFNSANPNHRPYEFNDPRKLPADVSIEDWMKYDNSTGDPVETWLRRIGFKNLEIQNYLDGKSVDWADMVFQNGLRQDYNASISGKTKGVNYYWSMGWTDNEGIIVNNGYKSFKTRLNLDAKINKFLTVGLNAQFVQRDASAIGADWVQYQKLTPYGSPTNEDGTMKLNPGDDTSAKHPLIDSYYTDKRNVINNLNANIYAKVSLPFNISYQMNFSPRYEWATDYVHKSSEHPSWKDFGGSASRTFRNDFLWQLDNIVKWKQTFAKVHDVDFTFLFNAEKFQRWSDEMNNEGFDPNDDLGYHYMKGGILPTISSNDEYRTGDALMARLFYSYDNRYMITGTVRRDGYSAFGQKNPRAVFPSVAVGWVFSDEPFLKKLNWLDYGKLRFSWGLNGNRDIGVYRALARMGNSKYMYVSPDGKVYNGSYLYVNSLANKELKWERTASFNLGLDFSIFNERLKGNIDIYKANTKDLLIERTLPELIGFSSVMSNLGEVENKGIELSLTSKNIDTKNFAWSSTFNFTLNRNKIVHLYGDMVDVLDENGNVVGQKEADDIKNKWFIGKSLDEIWGLEVIGVWQQDEAEEAKKYGVAPGDFKLRDVDGNGQYTDEDKVFQGTTSPKFTWTLRNDFKIYKNIDVSFMLYSLWGHKGTYDVAKHSGTTVYNDRQNAYKLPYWTPENPTNEWARIDSSTGGNSFSVYRKKSFIRLDNISVGYNVPSRWITKLGLGSLRVYANVRNVAVWAPDFKLWDPENSSPTPRTYTFGINVTM

SEQ ID NO: 9478 - protein, 756 aa, Burkholderia pseudomallei
MSRAPHAPSRRRAFGRGFAAAARAAHGAPVAHGAHACFAAASRRATAVERCVTALACAVTASGALAAEAEPADAARGPHRELPTVRVTSDGVHASPLSTPLAAGSRLKLASLDTPASVEVITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDADLVLYARNLANRTYAASTLNGGAQWLLGPSRSAELVATLRF

SEQ ID NO: 9479 - protein, 638 aa, Burkholderia pseudomallei
MFHLSTRSFTWGECMEHVMSKSFQPTRLVGAIAIAMGCSPVIFAEDATDATQLDPIVITASKSAEKASEVPARISIIEPKIVEQSPIAELPHLLMSDAAINMVQSGGLGQTSSIFIRGTNSEHALILRDGARLNTASTGAANLAFIDTTDIKQIEILKGPASVLYGTDAIGGVVQIISKTPEKTSAFVTGEIGENKTYKSIVGADLAENGFYAQVRGQRLESDGSRITDLKGNDIKKASYDQKGFSTKVGVEKEDFGASVDYTQNEGTSQYDTFRYDGSLTSQDFKNELLNIRGRVNLNSDISLNARLSQFKDELDQNGSRDFVHSTTKEAEVYGKWQFTSSQNVLAGVTHQNIDGDVLSYGSPYDEDVNSTGYFVQHQYQNNGLNTQVGVRVEDNEKYGTHTVAQGAIRYQLLPLTSIYANIGSAFKAPTLNDMYGSGGNPNLKPEESISYEVGIDQKLNYNISTGLSAYYTKIDNLIESRCIAVCNGDWINTFPVYQNINIDKASMRGGEIYANWNRDDLFIKSSYNYVKAINDETDQELSRRPRQSFTVSTGLQNEHYGLSISLSAKSKAKDYKQDTPGYTTVDFNGYWNATPNVKLFTNIQNIGDVKYKTASYDKGIYYVNGGRLASAGVTLSY

SEQ ID NO: 9480 - protein, 358 aa, Burkholderia pseudomallei
MKSSFSRALQTTFACAAVAALAAGASGACAQSSVQLYGQVDEWIGAQKFPGGQRAWGVQGGGMSTSYWGLRGTEDLGGGYQAIFTLEDFFRAQNGHYGRFDGDTFFGRNAYVGLATPYGTVRAGRLTTQLFISTILFNPFIDSYVFSPMVYHVFLGLGTFPTYTTDQGVVGDSGWNNAIDYTSPSFGGLNAAAMYALGNTAGDNRSKKWSGQLNYSSGPFAATAVYQYVNFNGGPGDLGALVSGMKSQGVAQLGLSYDFKLAKIYAQYMYTKNELNTGSWHVNTAQGGVSVPLGPGSALASYAYSRDSGGHDQTRRTWALGYDYPLSKRTDVYAAYMNDRYSGMSGGDTFGAGIRAKF

SEQ ID NO: 9481 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDARDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEGAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 9482 - protein, 636 aa, Burkholderia pseudomallei
MRKAIRMKKKNILLLSIAGLWTMTGFAQAAKDSARIARNLTIDEVVVTGTRNETDIRHLPMTISVVNRKVLEQRFQPSVLPALTEQVPGLFATSRGIMGYGVSTGAAGGMNLRGIGGSPTAGLLVLIDGHPQYMGLMGHPIADAYQTMLTDRVEVLRGPASVLYGSNAMGGVINIVTRKMQEDGVKTHAQIGYGSYNTLQTEVSNRIRKGRFSSVVTGSYNRTDGHRDNMEFEQYGGYAKLGYDFNDSWKLWGDVNITQFKASNPGEAGNPYIDNDSRITRGMTSLALENHYEKSSGALSFFYNWGRHKINDGYHPGGTPQESHFNSKDRMQGVSWYQSATLFTGNRLTTGFDYQHFGGESWNRMVSTGERVPGVDKQMDEFAGYVDFRQDLGEWLSLDAGIRVDHHSHVGTEWIPQGGLSFHLPRQMEVKAMVSKGFRNPTIREMYMFPPQNPDLMAESLMSYELSFSQRVLDGALYYGINLYYIDGDNMIMTVPTDGKPKNVNTGKIENRGIEANIGYRITPHWQANANYSWLHMENPVIAAPGHKFYAGVDFTRDRWGVSTGVQYIKDLYTNVSKGKEKKESFVLWNLRANYRVCRYADVFVRGENLLAQRYEINDGFPMPKATVMGGVNINF

SEQ ID NO: 9483 - protein, 717 aa, Burkholderia pseudomallei
MPTLSARTSVLSRRTAVSTALALLLAPAAARAQNTGSPPVATLPAVSVSGDTPPSSLLDTAATGSFLRLTPFETPASLDIITNEQLRERGDVSVMDAITQAPGISAFRHPGNGGSSLSSRGFTDSNSVAILYDGLRQYGGLGQTFVYDPWAVDRIEVLRGPASVLYGEGAIGGVVNVIPKKPTRGPIENEIQATVGTHDTQRLGFGSGGALDDRWSYRLDVSGNRSNADMSLGDSQNAAVTAALRLDVSPELNFTLTQAYAWQEPARYFGTPLIDGEIDYSLRHKNYNVADSKIIYRDSRSELQAEWTPNAATTVRGRVYYIGSDRDYRNVENYIWQPASGLIERSAYTAIQHDQSQVGARTDAAFDGHLFGLRNQVSVGAEVNRSKLKHTNNSPYGGVSLVDPYDFGHGEFINEAGTTPRYRNTADQYALFAEDRLSLTERWSVLGGVRYDHIDLEREDLVAGTTAYRRTYTNVGWRIGTVYDLLPTLAVYGQYSQAADPVGSLLLLSPANKDFDLSQGRQVEVGIKQTFWGDKGEWTLAAYHIRKKNLVTRDPDDPSLREQVGSQSSRGLELTVGVELARDWRVDFNGAILDARYDDYTDSSGGAAVSRRGNVPPDVPERLANLWISWKFAPRWTASAGLRYVGKRYADSANELEMAAYTTTNLALQWEARPDLSLALRAYNVFDKQYAETAYYNQTQWLLGAGRRVELSANYRF

SEQ ID NO: 9484 - protein, 744 aa, Burkholderia pseudomallei
MLHYSCQVPETSPSLEPGLDVRFPFKFTRRALPLALAASAIFPEAYSAETERSSSPGSSIVLDAIEVQAAPDSPTNSLDPSSTLSGKELMLKSAATLGATLQNELGVANATFGPNVGLPLIRGQHGPRTRVMVNGLGTHDASAMSPDHGTTVESLLAKEIKVLRGPATIRNGGGAIGGAVEITDGRIPEHLPTKTKVTTQLRFNTNHDERIMATELLTKAGQVAFHADVHGRESNNIHIPGMAIDQDAFTQLFYVPSPNNTHGYTGNTNAHSDGGSMGISLFGEMGYVGMSISRYSNNYGIPLGPAHCHGPCTGNAAEADNVRIDLHQERLDLKGELFLPWEWLESISFRIGKSRYHHDELSNGIQQTRFQNDVTESRLEFTHALHARVSGTLGLHGIDREFSALGIEAFVPSTSIDTKGVYLIETIDLNPWQVELGLRKEQVKLDPSPQTVYFGPISHTEVFPARKLAPESYTLAVKRMHSTGSITVNRWIAKRAPDVQELYALGPHLATRTYDFGNQDLDIETLNGWDIRFQQRLGKLEGNLNLFKYSAKNYIYQQNEGLYETDAAIPHPVMRCANPATCLITTRHSQQDARFHGYEAEMGLPLHIPGLRKFRASVFADQVRGMLDDDTHVPRLTPARHGLLIQAGMGKWDGEIRLTHMRAQKRTGTMPMNDEIVLEPGTDSYHKVDIALRRSIEVPNWFTGDLFINMRNITNAEIRNSTSFLRYYTPELGHNIEIGMRIDL

SEQ ID NO: 9485 - protein, 364 aa, Burkholderia pseudomallei
MGASKNTLRKLQCVAALGAACALPAMAQTSVQVTGLVDNFIGSVKYSGDAGRSSVVNSGGMTTSWFGFKGTEDLGGGLKAKFNLTSFFRADTGGAGRFDGNETFFSRDANVGLIGKFGEISLGRDLAPHFLPSILFNPFGDSFQLSPLMLHADVPLFNGSRWSNSVAADTGWSNEIIYTTPNMAGLKANIHYQFGEVAGQSGKNNVGMNLLYSNGPLGLAAYYQKIRVNNPLEQTPGNVLPAATLLGGLTPARQTGWFVGGSYDFAVAKLFATYNQTSHDVDLQDRTVQLGTSIPLGQGAILASWANTKRDGAAIGQDLKRNTASFGYDYNISKRTDLYAVYMYDKITQQNTGNTVALGIRHRF

SEQ ID NO: 9486 - protein, 359 aa, Burkholderia pseudomallei
MDKRLSALCGLGLASAGACAQTSVTLYGVADAYVEYATNQADAKGKPAALARMGSGGKSGSRWGIKGTEVLGGGWRAAFRLESGVNLNNGAGTGAGGFDRSAWVGLEHPRWGALRFGRQYTTMFDIMEHYSPTGAYSTLYEPDGAIVGISFRENNVVKYLATAGPLTFEAHYAFSNEPGAFQASAAHGAGFEYTGGALSFAFAYDDVHTPQAGGFAHLRRYAAAAMLTVEATQLIAGAAHGQGNVATPSVVTRYTFWWIGVRQAITPVVQLIGALYAERVRAQNPASPPAARHASGTPQQATLQLNYFVSKTTTLYAATGYARHAALDFDNYNYGFLHYSLAGARAGSAGAAVGVRKLF

SEQ ID NO: 9487 - protein, 399 aa, Burkholderia pseudomallei
MKKAAAAWLVAGSMCAGAHAQGTVTLYGIVDAGLGYTSDQRVAQTKGALGSPVGYRNESSYGFASGTWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFSTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 9488 - protein, 759 aa, Burkholderia pseudomallei
MARRPLRAALFGAFGLYAAAARAAGPASEPAAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 9489 - protein, 209 aa, Burkholderia pseudomallei
MAGGFANDRLYGAALQYQRGGLTVGASYPKMNRARSADAAGAVTGDNTFDASSQQNVGIGATYAFSKALIGFAYSHVDVYDPTSNAYFTGTTRPAGGHWQSWKFDHFEINGRYRVTPAFYAGAAYTYTQARVDSTAGAFHPKWRPLSTKLDYDLSKRSSGFAEGVYQHAQHAMNARTGTDFDHAYIPGAANIASGPNQYVVRPALPHPF

SEQ ID NO: 9490 - protein, 377 aa, Burkholderia pseudomallei
MKARILVAAAALMLGNAASAQSSVTLYGVIDAGITFVSNANKFGEKLWQTQSGIAQGSRFGMKGAEDLGGGLSALFQLENGFDVFSGRLAQGGLLFGRQAYVGLSDTKLGKLTLGRQYDSIVDYLQVTTFNGNYGAYFSHAGDIDNSDNGFRVNNAIKYTSPSIAGLTFGGMYALGGVAGQFGRNSTIAAGLSYQHGPFYAAAAYMYAKNPATQFPDGNFVPNGANGAPTANGPFGYVGIPSNEQVFGLGVTLQASNWLLGANFTDARFDGANGTTSRVRFDTAEGWASYRVNAAMTLAAGYQYTWAKADYNDSRPHYHQINAMADYYLSKRTDVYVMGVFEKAGGGAKASIYNGLLGSEASGTTQVAARVGIRHRF

SEQ ID NO: 9491 - protein, 347 aa, Burkholderia pseudomallei
MVKKTLLMVSLLTFGMAAHAQNSVTLYGRVVAGVDFQNNVQNADGSSGSLLRAGDNQWGTSMFGFTGTEDLGGGLKALFKLESGFGSSAGATNGTALFNRRSFVALQSATWGQLKLGNDLAIADQIWALDPTGQQFIGSATLVRGRNWQGDNNMIAYETPNWGGFSGLVLTSLGGKAGSLNSSRKDAISLTYTARPFELRAIYDVARDKNGKYSDLFNASRELTLGGTATFSALKLYAAYENLSAPDSVAGAPTKANHYWLGVNYQLTPFLTLIGAAYRVNVNHNGGNANLFMLGANYSLSKQTLLYVSAGTVRNGPNANFSVEATNNNPAPGGKQAGFYAGISHSF

SEQ ID NO: 9492 - protein, 379 aa, Burkholderia pseudomallei
MRHSARLLACGALCVTAAHAHAQSSVTLYGIVDTGIEFVSHASAKGGSAWRMPAVTGELPSRWGLRGVEDLGGGYRALFALESGFNLRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSGSAMLKYDAERFGVAASYEEQRGGANAAANFFDGAAPMPIASSADKDTRAHVSAYANAGPVKLGAGWIGRRVSTDAPAAPDVRTDLFFVGAAYRATPFVTIDGEAYRIVDARHDARATMATLRASFSLSKRTAVYAQTAYLWNSAHARYSVSGGGGGTTPAAGVGQLGAMVGVRHMF

SEQ ID NO: 9493 - protein, 400 aa, Burkholderia pseudomallei
MHIRTWIAAGVAGAAVAPACAQSGVTLYGTVDTGVIYSTNQQVTHADGSTSGGHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQAGDFSVRRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQRASIAFDIAELNATYAFTPMLRGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 9494 - protein, 362 aa, Burkholderia pseudomallei
MVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWSQFELGDTYSLSKRTQLYVNVLYEHASGNAKAAFFTAGASSTANQVIVLTGIHHSF

SEQ ID NO: 9495 - protein, 1131 aa, Burkholderia pseudomallei
MLMTRHKKRKMMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKLEDDAEHRVWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENKPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVREAALERLWTARGAPGRAGAWARLLGAWGSARGGDVNGYTSSTGGFLAGADAALLDGVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFIVSSVPVAKDAAVLNVGAGLELGKNGWLRVGYSGSLASRQSEHAVQGSLHWKF

SEQ ID NO: 9496 - protein, 783 aa, Burkholderia pseudomallei
MSRSRYPASVSTLALLLALAAPAAAQPTAPQSTTSGPTTSGPTTSGPTSSGPGAAGDREIEEIVVTAQLRAQPLQDVPMPINAFTGSFLRDVRIDDFEGLADLAPGLEVLEQTVQNPTIVVRGVSSGGSAANIENRISVFQDGISISRAQGALQELFDVGQVEVLKGPQGTLYGRGSTAGAIAVASARPDFDGTYGSVSAGIEEFDGWTGGAMLNVPVNDRAALRVAATRHYRDGFIKNLENGEPTGGTDMMAGRISGTVRLSDAVEATLILNGQRDRGNSNVFKAVTIPTRGGGFSGSGDNTPWNRLPFRTDPFAPMQSDLGDASYLRRDVAGATLLVDAQLGDITLSSISGYRYLKSDDYFDVDGSYLYIVNGLEDTDLDQYSTELRAAYDGGGRLTGVAGLSLFRESTDYRIALDYDPNRVATLVLASSPFYRLPVAANGALNPVLPLGFPARVGEEGLTESDTTSYSVYLDGSYRITDSLGLSAGLRYTFDDKSLATTRPISNLGLFIPTSTGDRRTRSADFDAFQPRVVLDYRIDEDAKVYASVTTGYRSGVIPEAGRTNSDPVTDPEYVISYEAGARTTWLDGRLRLNGSLYYYDWTDFQTQVTDPETNLPVSAAAGEASAFGFELEGDFDLTKALRLFGNLNLMQAEYDSFVSGGQDFTGNTMTRSPKVRFTLGAQADIELPAGWTLTANGYASYRSRQYYSDENTALESQDAFTLVNANLVLATPEEGMTVTLYAENLFDVEYLADVGNTGRSFGIPTWVPGHPRVIGVELGARF

SEQ ID NO: 9497 - protein, 698 aa, Burkholderia pseudomallei
MDDHRRIAPPFARRLHPLSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 9498 - protein, 749 aa, Burkholderia pseudomallei
MTSTFLRHAPTARGDHARRRRRAITLTVPALAAGAFHLAPAVAQTSEAVHGHGTLGASGVASRADTDTASAKSDGAVREAASAAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQTTRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 9499 - protein, 482 aa, Acinetobacter baumannii
MSWVLGYAAGAGARRLRHIPCRSPLPMPFPPLASAPVRIRFRRVLAALACCACLPAMAQQAEPVQGPAEAESPFAFHGQSTYIWQRKPAFGAAYSGPNSLGTERAKSYSFSATLDLGLKLWPGAEFHFNPEATQGVPFSGLHGLGGLSNGELGKAASTNPVFYRARAFVRQTWGLGGGSEALEADFNQFGRTVDQQRVVLTAGNFSVLDVFDQNEFGSDPRTQFMNWSFMTHGAFDYPADARGYSWGLSLEYIGDGWSARIGRFLQPLESNGLRLDTRMFEHYGDIIEVEKRYQLAGRPGTARLLWFRNKARMGAFSDAIGFGMANNTTPDVADVRREHAKSGVGVTLLQQVTDSLGMFARASLSDDKTETYAFTEIGRQVSAGGVLKGDAWGRARDALGVAVAINMLGPDHRNYLAAGGQGAFLGDGALRYGPEQILEIYYSFQPVKYLSISPDFQYVRNPGYNRDRGPAKFYGVRLHGEF

SEQ ID NO: 9500 - protein, 712 aa, Acinetobacter baumannii
MQRTSYFISSILGFSLFPGFTWADDKSTNLLSTITLQAAHQQENQTKTSATTKFTHDVIDVPFSRSFLSEEILKQQDVQRIDEAIQLVNGVYAQNNYGGGFWDNYSIRGFTTDPNVSATIIRNGLSVNRGLSAPRDMVNIESIDFLKGPAAAMYGRGEMGGLLNITAKKPQWEPQGEVYLRANTEEKYRGSFEYTAPINDEVAYRFAVAHEDNQSFRNHVNSERWFISPQLSWKLSDQTQLNFDSEITRQKGLFDRGISAYKGQILMDRKTYTGEPSADQNEVSDQFYQLHLAHTFNDDWKLNSAISYKQGKISGSSNEPRSFEADGETLNRQRRQRYTYTTDRLAQTELLGKVNSSWARHEILVGGEAGTLVFNQSQLRCDNGRAGQINGGYSNPKRYCVNQINVNHPQYGTYPKDMGLFTNTHEVQNYAALNLQDQMFFNDHWSVLVGGRLDHVKQNLDNNVNGIYSSKTFNEVSPRVGLNYKLNDHLSFYSNYGRSFALNTGTDKSGNVFAPEKGEGYEIGSKYRPTDDSLLSAAIFHMKKRNALTIDPNDTSYQYAAGEARSQGVELSFQTQLASKLNLLANYTYTDAIITQDTSIAKGTRLNSVPKHNANLSLDYTLLDDGHRKAGVGGNVVYVGKRNGTQNDQGRLELPDYTIMNLNAYYAPNAKFRYQFNLNNVFDKTYYLESYSDMWIQPGDPINASLSVQWMF

SEQ ID NO: 9501 - protein, 756 aa, Acinetobacter baumannii
MGNKIKSHKLFTRKSEVKNIIPLLSLGGAIFLSNSAFAASTSETTDVEKKPEALPTITITASRADELSTSAKQVTKLDEKQIELLRNGSSGNIATVLAKAVPGLSDSSRTITDYGQTLRGRNALILVDGVPMNLTRDTSRGLSAIDPESIANIEVIRGSNAIYGGGASGGIISITTKAAGGEPTAKTVVGLQTPLTNFRSNALSGDIHQYFTGSFNAFDYALDFGYQRIGSPYDASGDRVAPEPSQGDLYDSDGYSIGGELGYHIDDNQYVQFAANYYNAEQDSDYASDPSVKNAPAGTVPAKAIKGLKLKDQNKNENQIYNLTYNHKDFFGNKVDAQIYYRDFFTRFSPFDARKNPNRGGNVDQIYQENNILGSRLTVTTPLEFLGDTSLVWGGDFSREKSEMPLDTFNPDIYDQSGGLEFVKTGKLIYLPELTTQSVGGFVQLKHRFNDQWSAEAGTRYEDSYAQIDSFIPLSQFDPKTQSYKPNPYVYQGGKVKADAWLYNANVTFSPNDQHSIYASFNQGFQLPDVGVIIRNADNTDKKKNYELSSSFLEPVKVDNYELGWKGNFNNFSSSLAVFHSTSDLGAVQSFSNGLALTRTKEKVTGVEATFDYMDDANVWGTGGSVTWMKGREKPQDGAEQDMTGFRIPPLKLTGNISYSPTETWTNRLQATYFGSEDYRLNGKNSFGRYDVKSYTTADLISSFALNKKDTVTIGLENMFNRKYYPLYSQLLRTSDNTSHLVANGATLKVSYSHKW

SEQ ID NO: 9502 - protein, 742 aa, Acinetobacter baumannii
MKYPHEVLQFAPSRLLTAMAAGAAMASPLAHAQQTPANAPVAQQTAQAEPADKVLPTINVKGQAEVEPKTYQPGVTTIGKVPTLPRDVPQTLNIMNESLLLDRGVDSMKQALAGVAGITFNAAEGGTPGGDNINIRGFTARGDFYMDGMRDASTYSRDIFNDERIEVLKGPASMLFGRGSTGAVINQVSKSPMLIDTGRIAVTAGQYSYGRATVDVNKVTGEDAAFRLNAMVQDSDSAREGVTSKRYGFAPSFRWGIGTRDEFQVSYYHLNYDNTPDLGFGWFQGKPVDAAADKFYGFANYDYQKDSADVATANWTHRFDKDTTLTTALRVGQYTRDLFATQATLANGTTSINDNTTVSRGTQPANNPAGENTNVYLQSTYVTRAEFWGMGHQLVGGIDFGNEDVQNFTYTQRATKPATTFGDPDTMAQIGPRGDKVKSNKYKDTSIGVFGQDTLELTKQWKLLLGLRYDYFNADYISPPPNTPNAIGTQYGRTDRLWSYRGGLIYQPSNSQSYYVSIGNSYNTSGDLYQFDARGANTPPEESRNYELGGKWELFGGDLSLSAAIFRTEKFNERNTDPDTTSTNYLLSGKRHTNGLELAASGNITPDWQVYLSYTLQSARIDASNAPASVGQRPGNTPIYAGNIWTTYKVTPKWKIGGGVERMSQRTPPDVVGAGVSTWGGNTNVAPAYTRYDALIEYDEQDYALKLNILNLTNKVYWDALYRGHAVPGQARTVLLTGEYKW

SEQ ID NO: 9503 - protein, 749 aa, Acinetobacter baumannii
MNFTLKPIALAVNLTILGSSAMALPALALPFVANTAQGTIKDIEVITISNQRHNSLVDNQSYAQGKTTEADLANWLASVPGANINSNGPITGIAQYRGLFGDRVATSLDGHPIIGAGPNAMDTPLSYSTPLIVDSMTVYRGIAPVSAGMSTIGGAIDISMRKAEVMNSENVQVSGDLQAGYRSNNSASTLSGVTNIATGDVAVLLYGNTQAGDSMESGDGTVIEPTDFDKTQAGFDVRHATENNTVGLSYHYTKTTDSGTPALPMDIEYIESRRFNVDGDFQLGQWQGEWSVGYLDADHGMTNFLMRAHDPMKKRRNTALADTTDFKFVLNREFSFGELSFGVDGYLATHDSVITNPTNAMFEVVNFNNVQDDRFGFFTEWQNQYGQTTVQLGVRVKHAISNADEVSGNMAMNMADMNMDSGMGGMDSGMGDMDSGMGDMNSGMDDMNSAMMPSMGSLLSDLEGDFNNADRKVSDTNVDVALSTQTQLSETLSLYVGVGMKSRAPSYQERYLWTPMESTGGLADGHTYIGDIDLESETAYQADLGLTWQSSDFMIAPHVFYQNIDNYIQGTQLDMDDASAKMMASMMAQDDNPLKFSNVDAKLYGADVNWYYNLTDNFQLSGIASYVRGERRDIDDNLYRIAPLNGQVSVSYHNENVITNLTLVAVSAQDDVSATNTEQATSGYGLVNIDIEYFVTADFTLRGGVDNLLDREYQNHLGGYNRVKEVGTPVMDRLPSEGLSAWVEATYSF

SEQ ID NO: 9504 - protein, 356 aa, Acinetobacter baumannii
MMKKSLFCMTAALFALPTVTSAASPYFSLKDGDGFKRFSVSAGPLYVKPTGKAQPFRINTSVKENEQSKVGDIKVKTIQDNISDSNSNVVLEEFIDVIGLGTDTIPAWLSGTAEIRSLSQWEAENTGLEADDVTTLGLMTNYFFTDNISLEVKAGIPPKVDLQGKGKIYAPFSATAKPAGGILGSMELENNIFITDLEAHGSAASARAWTPAFELQYHFGKTGVNKFRPYVGLGVMYAYFNELEINPEIENDLVNAGHMIVNIKDGKSGAALERKTSSGDPKVDLEASDAIAPVATLGFTYDFNDKWYAVGSVTYAHLKTDTTITVNDAKYGELINAKADIEINPILGYAGIGYRF

SEQ ID NO: 9505 - protein, 448 aa, Acinetobacter baumannii
MNKYLLWGCIGLGSVSNAYAELPQEFGKLELKLNTRYWNDEGTAHPTLANPSPSSSEYEQSALGLELNYQSPYIWDWLGVDGSLYAVTKLFDSGKPSAQLLEVENNGKLDQNFATLGQLYIKAKLGDKGEIKLGRQLHDSLLLKSTNNRAVPDTFSGASGQFQLNDQLQTYMAYYDRWKPRSMDSFEKLVTENDERIDYVGLLGAKYQYKNWSLNAEYLNSKDYLKKYGAIAQYKLPLHGLVWTFNTGAFFSRDDGKLFKCGAETELDCVKGQDINNRGNGYFIDVNLAKNNLEGGIAVSKFDGFWIEDNFAVHSARNSVLTQDHGTNPFPTSATIGPDFTNNDETAVALRLKYNWKDYVKGLKTEAKYIYGFGAHQSNISSDIEGKERYFDFTVSYALPWVKNLDVRYSFLHYESKFENANLGEKINGMSRKGWDQHRVFINYRYTF

SEQ ID NO: 9506 - protein, 426 aa, Acinetobacter baumannii
MILIDGKRISASDSLIGMSDFAYSWVPLNAIKKIEVIKGPMSSLYGSSAIGGVVNIITKKPTDSFFGEVDAKYGFSSADGGDEQDYSINVGGKITDKLSATIFAQAIKIEPMKDGTNVLAKREGRDVKNAILNLWYDIDDSQQIAISSMRGDEIRDNLKYKEYYDIEKSHDSIEYRKYFDNVKMNLKYYMTSLDAHSDDTSLLYTHKMDDEVMNAEFAISAIDDNYIILGAERRVEKYHKAYDFTPAKDFKDEIDYTSFYLQDEIAVGEKTLLTLGARYDKHEKFGAELSPKANLVYKLDEYNRLKGGYGHGFNAPSLTQNSDDYVLAYPINTSSMPMQFYRFRGNSALKPEVSDSFEVGYEYARDTTSFKATVFYTKVSDLITYKDNGTTVAMPIAYQEKLYSNVDEAAIYGLEVEYEEKEILSN

SEQ ID NO: 9507 - protein, 754 aa, Acinetobacter baumannii
MSKRIIQSVLSVSVLASMMSMAFAAQNEQEQAEQTLEKPAEPVKLETIFVTAEEQVKQSLGVSVITKEDLEKLPVRNDISDYVRRMPGVNLTGNSATGQRGNNRQIDIRGMGPENTLILVDGKPINSRNSVRYGWKGERDTRGDSNWVPAEAIESIEVLRGPAAARYGSGAAGGVVNIITKKVTNETHGSVEFYTSQPEDSKEGSSNRVGFNVSGPLIKDVLSYRLYGNYNKTEADDVDINKSIGSTAAGREGVKNKDISGRLAWQATDQQTVLLDISSSKQGNIYSGDSQLNANAEADAILSQLIGKETNTMYRDSYALTHEGDWSWGKSKLVAQYDKTHNKRLPEGLAGSVEGKINNLDDKATSRLETLRFNGEANIPFEYYLPQVLTVGTEWVEDRFKDNVSTTQGKDSSGSGYGDQLAKGDRSKMESRIASAYIEDNLKVTDSTDVVLGLRFDDHSKSGSNWSPSLNITQKLNDNFTLKGGVAKAYKAPNMYQNAEGYLLSTNGNGCPANIESRCLLQGNGDLKPETSVNKELGIQFQRDIVNASLTWFRNDYKDKIVAGTHVVGTVDGSSTNANTGAVTNTKWNILRWENTPKALIQGFEGSLGLDFGDIRWTNNFTYMMDSKDKQTGNPLSLVPIYTINSIFDYDITDQLDVNFVFTQYGRQKSRQFAENRLESGIGSGGANSALKPSTVKSYSTAGINVGYKFSDQISTRVGVSNLFDKQILRDSNSISQTYNEPGRAYYASLKYSF

SEQ ID NO: 9508 - protein, 753 aa, Acinetobacter baumannii
MYLMIKINKKVALVKVSLIFSALFFIGNAQSIFNVNAQSNSTKQDQLYATKSQLLQQQQNLERDREKIYNRIDLEKIKSHSNILDKLLLYPSNQVTVYLNEQDPHDKNYVRPRSNMLYRHINDAANYINNMCTLMVDIVPGYTSNGPNATDPARLVTMTDQEAQLNSKVQRFANRLRGVNNAKQQCRGVTTEINELSQELNQFHQALVNVQAQIQALSLPSLNDLSTEVRKLHLGIANQLVAVDQDIQACERGSNSMLKLGQYEQLLDDLYRTSENIVQILQNNVQAGNAQAITPIIPQDELNQMYKQMQDIETLMPKFTQDLGMLAKQLRDISCLIATLDPRAELDPAQIGLQQVQPGLSEKIRKIVNDIINDFPQVLQQYKNNLENDLKSINHKIANIDQLVSSLNQKLDTLQQEQLLSDQIAPTKAITSFEKQQPLHQVSQHNAMLANAISFTADTAVSATTSILSKIATVQNQSPKIISSGSNIYNSNGWNIDGNVFCGKTKKTEHKEIQGYSTDISGAFITVNKYLNKKVVIGVTGLYSNLDIKYGQNVILNKTNCKVYSLSLNGRYYPRQDIFMQSIVGVIKYDGTTRYYATVQPSSNIDGKGWYGDFMLAGNVYPLKHNSKLTFSPIVGIVYTNSSHAFETTIRDIDYNILTGRAGITIKYVIDNINNNMSIVPEFHAFIHRLLCVKSNKPEYVNSFAEQIPQSLGQLGVGVTVWHGKVGIGISYSAYLANEYISHIGSANIKASF

SEQ ID NO: 9509 - protein, 704 aa, Acinetobacter baumannii
MNQMRTLLALMPCVLIAPAYAQDDTTKKGDSSGDEMVITASRSNIQQQKAPQVVTVITKEQIEQQMQVTSDSSQILSNLLPSFSPSRQKMSGSGETFRGRAALVMIDGIPQSNPLRPTGREMHTVDYSMVERIEVIHGANATNGMGATGGVINIITRRPENGSFNQHVSVQTTIPTEKIRGETASYKTTYRVDGRQDYLDYLFAIGYENQGLYLDGNNRPVGVDNTQGDTMDSRAYDIMAKVGYWLDDYQRIQLSVNRYHIKNENNYLSVDGIRDQGIPTTSVRGTPPGEAPNNSIWTTGLTYEHHDLAGMKLSALVFNQRYEALFGATISNTFQDPAIAPRGTLYEQSRSVANKYGTKLALTKDDLLDDTLKVTVGFDTLYDKGKQDLYLTKRTYVPEMEYTNYSPFIQGEYQLLDKVTLHAGVRHEIAKLQVGDYQTLASNGGYTVEGGSPKFNETLYNAGIVYAATDSLSLFANYSEGFGMPDVGRALRSINRPGVSLKNFDGFKPIVTDNVETGFRFKRDKFDFEASYFESKSKLGERVRESGGVFLSDRQRTQIRGVEVTTGYQINEQHKINASYAHSEGKYDNNGDGKVDKKFNGLNIAPDRLITSWSANWNDNWSSFVQANYAFGRSFDDAGMAFDGYLLMDAAVGYKLPYGRLNVAVANLLDKQYITYYSQAALVNDTRYFSGRGRTMTLGYSIDF

SEQ ID NO: 9510 - protein, 2404 aa, Acinetobacter baumannii
MSADGATKWQYNHNGELVITGDNTTVNNTGKTIVDGKGATGTEIAGNNAVVNQDGELDVSGGGHGIDITGDSATVDNKGGMTVTDPDSIGIQIDGDKAVVNNDGDNAISNGGTGTQVNGDEATVNNNGSTTVDGKDSTGTEINGDKAIVNNDGDSTILDGGTETRITGDDATANNSGNTTVDGQGSTGTEIAGNNAVVNQDGELDVSGGGHGIDITGDSATVDNKGGMTVIDPDSIGIQIDGDKAVVNNDGDNAISNGGTGTQINGDEATVNNNGSTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGSTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNDISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVADADSIGIQIDGDKAVVNNDGDNAISNGGTGTQVNGDEAIVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVADADSIGIQIDGDKAVVNNDGDSTILDGGTGTRITGDDATANNSGNTTVDGQGSTGTEIAGNNAVVNQDGKLDVSGGGHGIDITGDSATVDNKGGMTVADADSIGIQIDGDKAVVNNDGDNAISNGGTGTQVNGDEATVNNNGNTTVDGKDSTGTEIAGNNATVTQEGELTVSSGGRGIDITGNNAKVDTKGKMTITGTDSVGVSINGDSATLTNTGDIDVSNSATGFSLVTNEGIISLAGSMKVGDFSTGMALSGDNNSVTLAAKDINVTGQKATGVNISGDSNTVDITGNILVDKDQTADNAVDYFYDPSVGVNISGNSNTVSLDGKLTVIADSELTSRKYMEFDGSQENISGLTVSGDGNTVNLNGGIQFVGEKNALADGSTIADKRSYFGKTPLVSVDGQSKVYLNGDSTISGSLPLGYANILQLSNKAALEIGSDATFSMQDISVYEHYFTQTPQIIKVDTGSQVVNNGDVDIWNISFAGIWGENSTGINNGNITLSQYDYSSPETSFSEPDHMAFLSSSGGSAVNNGTITAKVMEQHSVLNMGSAAGVADPRVFNNSVSSMMGMEAYGKGTVLNSESGVIDMHGRGNIGMLAVDDSAADNAGKITLDTLWVDQNDTTTLRTDLPSSTAIDYGVGMATGTNSGGGARSNGVATNQQGGVITVYNAGAAMAAYGASNMVINQGIINLEKNGNYDGGLGANMLVGMAVYNRGTAINDKTGVININVDTGQAFYNDGTGTILNYGEINLLGSPMDSADSHMGAIPENLDLLTALTGSGETDMRTASSGGFVTTKALANYGNETLNSNVAAKAWLYNQDKANLTINGELSIGQGLENSGLLDSDTISAAANVYNRASGSIITDQLSLTGSNSFFNEGNFSGSVAGSSYKQNVVNTGTMAVMADGKSLISGSFLLYNEAGATLSNSSSAVSGGENAIVNVTRTGDSLAQVNRGTITAINGYSAIKTASTGSNSNGKWIWNTDTGVISGVNPNAPLIDLGRGYNFANAGTINVQGDGAVAISGGTTSYTVQLVNSGTINVGTAQGKADGTNGTGLIGIKGNGSDTTINNAQSGVINVYADNSWAFGGKTKAIINNGEINLLCDTGCDIYAPGTTGTLNDHNSTTDIIVPAATSTPTQGSVPTVPADSSAQQKLTNYTIGTNSDGTSGMLKANNLVISDNVKVNTGFSAGTADTTVVINDVFKGENISGAENISSSTVMWNAQGSTDASGNVDVTMTKNAYTDVVTDSSVNNVAQVLDSGYTNNDLYTSLNVGTTAELNSALKQISGSQATTVFNEARVLSNRFSMLSDAAPEVANGLAFNVVAKGDPRAELGNDTQYDMMALRKSLTLTEHQNLSLEYGIARLEGNGSDTAGDNGVTGGYSQFFGLKHQMAFDNGMSWNNALRYDVHNLDSSRSIAYGDVNKTADANVKQQYLEFRSEGAKTFELREGLNVTPYAGVKLRHTLENGYQERNAGDFNLSMNSGSETAVDSIVGLKLDYAGKEGWSANATLEGGPNLSYVKSQRTASISGAGSQRFNIDDGQSGGGFNSLATMGVKYSSQESALQLDAFHWKEDGISDKGVMLNFKKTF

SEQ ID NO: 9511 - protein, 1033 aa, Acinetobacter baumannii
MDLKKALFVCLLLYYGTSANSALPVHSMAGKTNLSEQAKGIRISGTITDKDKNPLPGVNIRVMEEGGTGVITDMDGHFYMDVPGKSSVIEISYIGFKTQQIKVGSKINFDVILEEDIEALEEVVVTGYGSQKKMSVIGSIETLQPKKLQVGSSRSVTNNLAGQIAGVIAVQRSGEPGYDSSNFWIRGIASFSGGQSPLVLVDGIERDLNHIDPAEIESFSVLKDASASAMYGVRGANGVIVINTKRGKIGAPSVNFRVEHSISEPTKLPEFIGAADHMALLNELTEDRTRLPFSQEQIDRTRYGYDRDLYPDVNWLDQITKDYAYSTRANLTVSGGSDFLRYSLVGSYFGEKGIMETDKTLPYDTGMKLTRYNMRANVDLDVTKTTVLRLNVGGFLQTHRKQAFSTDNAFDRAFMTSPFVHPARYSDGTIPIMNINGVNPWAAVTQSGYDVVTASQIQSLFAVEQNLKMITPGLKAKVSFSFDRWNQSSITRGKNATYYTIATGRDIEGNLIHSVLKYGDDSLGHGNKGEYGNSRVYFEGTLTYARTFGKHDVDALFLYNQQSFDNGSVQPYRKQGIAGRLSYTFDSRYVTEFNFGYNGSENFAKGKRFGFFPSLAVGWLISEEPFMDKFRNTLSKLKLRGSIGKVGNDDIGGRRFAYMTTLKTDADTYHWGDTGQIERKGISEGEVGVENLTWETALKMNLGVELGLWNELELQVDVFKEKRTNIFMQRKIIPSQTGFLTNPWANFGEVTNRGVEFSLNYSKQINKDWFIGFRSNFTYAINRVDEYDEPESVVGTYKGLTGRSLNTLWGLQAERLFTADDFDADGNLKFGIPTQDVGASKVRPGDIKYVDMNGDGFITDADEGYIGGTVDPRIVYGFGGNINYKNWDLNFFFQGTGDTYRVIGNTTYFIPGSGQTLQGNVYSNYNDRWTEENSSQDVFWPRLSEEPNRQNYRSSTWWKKNMRFLRLKTLELGYTLPKMITEKIHSKSVRFYVSGNNLFCFSPFKLWDPELDTDTGLRYPAMRSVMFGVDLNF

SEQ ID NO: 9512 - protein, 411 aa, Acinetobacter baumannii
MEFTTGLMSLDTALNEMLSRVTPLTAQETLPLVQCFGRILASDVVSPLDVPGFDNSAMDGYAVRLADIASGQPLPVAGKSFAGQPYHGEWPAGTCIRIMTGAPVPEGCEAVVMQEQTEQMDNGVRFTAEVRSGQNIRRRGEDISAGAVVFPAGTRLTTAELPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLQRNADGELEVTTTGHQGSHIFSSFSLGNCFIVLERDRGNVEVGEWVEVEPFNALFGGL

SEQ ID NO: 9513 - protein, 488 aa, Acinetobacter baumannii
MKLKHLSTAIILATLPATGVFAAALDRSGQSMSAFLQPGNYFEAGLSVLDPDVSGKEAGSSTTRRNINDMADDYLFPNAALKLQLTDKFSFGLLYDQPFGAKAEYSGNNVFVSNPGNDTVLPQALINNLVQTKVQSYLESTTGQQQIAALIQGGATQQQAITQVTQGFLSSPQVVGLQQGLAAANSALGRGNTQVEVDTQNLSMVLGYQPTQNWNIYAGPVYQTVKGNVSLRGQAYSLYNGYDANIKETGGVGWLAGFAYQIPEIALKASLTYRSEIDHKVNINENLAIQSVIDANPALLTGLGVSADKLAAINSNGKTTITTPQSVNLDFQTGIMANTVAFANVRWVNWKDFSIRPYKFGKVSEAVGPLIGRSNGFNLVEYSKDQWSANVGVGRKLNEQWAGNVSVGWDSGAGNPVTTLGPTEGYWNVGLGVQYSPAPNYFIAGGVKYFWLGDAKAQTGAQAGSSDYVAEFSDNHAIAYGMKIGYKF

SEQ ID NO: 9514 - protein, 712 aa, Acinetobacter baumannii
MSLLRLDRLHYCILMSMGCISSPLVWAEDLNSDVAKLPTLHVEATRTDTGYLQTPASVFRIEAPQVDSSSQVNLTEVVKGIPSLQIRNRENYAQDLQLSMRGFGARSTFGVRGIRLYVDGIPATMPDGQGQTSNIDLSSLDHVEVLTGPFSSLYGNSSGGTILTSTKEGQGKDSIELSYSGGSHDKSRAGLVLQGGAKGANEPSYIISSSYFDTDGYREHSGAEKVLNNAKLSWNLDDGSKINWVTNYVKINADDPGGLTRADWQNNPKQVVQNVLDYNARKEIEQTQTGLTWSKPINDQHELYAMTYMGQRQVTQYQSIPDTVQKNPNTPYQAGGVIDFKRNYYGADFRWTGKELLPNTTLSIGVALDAMKEDRQGYQNFNDTGDKGVKGALRRDEDNTLWNIDPYVQASWQFLPTWRLDTGVRYSNVHYKSKDYYIVGLNGDNSGKTSYEEVLPSVALSWQITPEVLAYASYAKGFETPTFTEMAYPAQGGASTLDLKPSTSDTYETGLKSQNQLGDFTLAVFQTKTKNDIVSAESFGGRSTFRNADKTLREGVEFAWNKKLWRDLIAIASYTYLDATFDSTVPAAGKISEIPEGNAIPGIAKNQAYVSLAWQPSHGLYGGVDVQYMDKVYVNDTNSDAAPSYSVTSANVGYAWVMGDWKVNSFARVDNLFDRNYAGSVIVNDSTQPVGRYFEPADGRNWSAGLRVIKQF

SEQ ID NO: 9515 - protein, 628 aa, Acinetobacter baumannii
MEHVMSKSFQPTRLVGAIAIAMGCSPVIFAEDATDATQLDPIVITASKSAEKASEVPARISVISKEEIEKNPALNLSDILQKDASIYVKQNGGIGQLADLSLRGGQTGQTLLLKDGARLNSQNGFGPVNPEFINLTDVDQIEILKGPASVQYGSDAISGVINLISKKPTKSGINLTGIYGENNTYKSIINADYVDASGFYAQVGGQRLESDGTRILSIQDKNDKAGFDQKGYHAKIGYQQNQIDTSISISENQGTNVYYDSTLNSNTGIRDFKNQLINWLGSYQVNPDIKLNARYSNIKNTRVSTDTDWQTYKLTSSHYNTETNESDLNAVWKFMEHQNILAGVTYSKSEYDASSTPEAIRSTNSTGYYLQHQYQKNGLNTQTGIRLEDNDWFGTHTVGQIAVRYQLLPLTSIYTNVGTAFKAPTLEHLYGSYGSSFYSNPNLKPEKSVSYEIGLDQKLNYGLSAYISGYSTDVENLISSGKIDGKTTYINLNKAKIQGGEIGLKWVLDNLFANAEYVYSKAQNKETKLDTPYRPRQTYTLTVGYDDGLYGVNAAVVARSKANTSSANIKVPGYATVDLNAFWNISSNVKLFTNIQNIGDVENIVVNDFGSEYINGGRQASVGVTFRY

SEQ ID NO: 9516 - protein, 691 aa, Acinetobacter baumannii
MLFYKNILTLSILAAISIPVFAAENENVEKLETIRIKAHPLEQTSKDFAVADTVVDQKHLTEGAATIGDALNSEVGIYANQFGAGSSRPVIRGQDGPRVKVLQNSSENVDVSTLSPDHAVTVDPVLAKQVEVIRGPSTLLFGAGTVGGLVNVIDNKIPTQMPENGYEGQVGLRYNTGSDEKLASAGVTVGLGSQVALRVEGLTRDANNYIAPNYIHEGEKERRVDNTFAQGDSVNVGLSWIYDRGYTGISYSNRRDQYGLPGHSHEYESCSAHLGGRPHLHCDAHEHDHEEGEEAHAHEEHEHEHGGPWIDLKSERYDFKTELNDPFAGFQKLRAQASYTDYQHDEIEEGAIATRFQNKGYDGRIELVHNPIADWEGVIGTQLGQQKLNLTGEEAFMAPTTTKKWSVFALEHKQWKDVHFELSARADQQEINVDDNSKQDFDGSAFSYAGAANWEFAPNYKLSFVASHQERLPLAQELYANGAHFATNTYELGNDQLSKEKSNNVELGLHFDNDKLDYHLHVYHNWFDDYIYAQTLDRYKDFRLVQYTQDKARFYGAEGEIGYQITPMYKISAFGDYVRGKIDAEGNAPRIPAGRLGTKVDADFGDGFSGSAEYYHVFNQDKIAAYETETEGYNMLNLGVAYSGQYGAKTDYRVYLKANNLLDDTVYQHASFLSNIPQVGRNFTVGVDFSF

SEQ ID NO: 9517 - protein, 972 aa, Acinetobacter baumannii
MKKKYLSQLISLLVASTAAQGLLTTHALAVSGTVIDSAFTSINVVGTNDSLHITDTGSITGAPTTALTVEQNATLATLLNDGTISDDGTNGNNYDVNIVQINGAVTTFENTGTISSINQYHYGSIVAVGASGEIDNFTNSGTIKNAPDNFNPGMNNTGAVANIGYIKTLTNTADGKITGYTGINNQGRIDTLLNAGVITSDTGNYGMMMGDNAAIYNNMNSSIGTLHNTGTIQSISRYSYDGGGIFNFGTIDTLINDDKIIGGSFGIQNYGVIGTLENNGKITATNFGIYASTSNTTSIGTIANNGEISGANYGILISSYDQSLETNIINNGLLSGKEDALYLSDNNSSSLGNVTLTNSGVVAGNINANNTSPLKINGGTTTMGTLTGLNGIGTITSTRSNVEFGTGSLLLNDNVVASTVVNNAASLQVNNSITVTGDYHQKAAATLTSGISDVAISRTDLMAETGYGRLNVSGNATFDQGSSVNLIRTGNTYKFAEGQRYVVVNATGAETNYNADKLKYKAIGYRGAVQGSVFDDGENKALVLTVGAEQTVTPPVVTSPVVTAPGVTPPVVTAPVITPPVATPPTQPTQPDRGLATIPSATASLGGLGNYTGIASPQLLELFNASLAIDSKSEANRVGESLSPGQNINTSSAAAVATSTAQAVVGAHIDAVRNPANSGTSGVATGDDYASNWIVWGQPFGGYARQDSTVEVSGYSAKFGGLIMGADRSLGDDWRLGAAVNYSNTSVHGKGNLNGNTSTADNYGVIGYAGFTGDPWYLNLSAGVNRQNYTSVRRADFTGFSGAAQGKFNGQSVTLQTEFGYPLTLQAGVVLTPLASLTYGYQHVDGYKETGGNGMALDVGSSHAQSVVSDIGARIEKTFATGLGNLTPFAQVTWLHQYDDRQVSSRASYAADTVGETSFTTKGASPVEDMAGVAIGSTLYEANELNLDARYDLQAGERYQAHTFSLRLRKMF

SEQ ID NO: 9518 - protein, 519 aa, Acinetobacter baumannii
MTPCAWTRRGADPRCTRPRRRGGSTALDGAVLALVLPAAVALWCPLAGAQPAQRLPAQPPTADALPVPPPVAPTIPVAPPPGAAPPGGAPATPPSGAAPPSGAPATPPAGATSGTPAATPDAPPATIAPSAVAAPGAPAAGTSPAGAAPSSGAPPAAAAGVPPPAAPAAGGPPFQLAIGRLVLSPLVLVQAQAVPYVGEDAFLQAGDVAEGQGFRLRRARVGFAGRLAGYVPFAVSGELAGGADGSARLSEAWIGYAHFPFANLYLGAHDVPFSRSAMTGAGEGALIERPLAVRAMAPSRQVGLHVEGHFRGRAFSYFAGMFNGFQRSDQFFAGYVENAASFGNRFDHIAYVARLATEPLGPLPRSVQDLAVSRLRVGAGASYFFSDGGTRDIHGIGADVLVQAAGAHALAELLWNQSDPESTPTQPLGQLAPVTSIGMVGEVGYFVRRIKLGVSARFEWLDPNLDLSDETDSWALTAGASYHFIDNTLKAQADFTHRQERHGVALDNDAVALQLQLNL

SEQ ID NO: 9519 - protein, 721 aa, Acinetobacter baumannii
MRIIYIIFNLMNIPPRPFKLSVIACAICYANLTYAQDAQVQALQTIQVKASNAEQSSEQTKAYNVKNSSSATKLNIEAKETPQTINVVTRQQIEDFGLTSTRDVLRNTPGVTVSNQETERTTYMARGFEISNILTDGVGFPLSGYNYNNTNPDTYFYDRVEVVKGADSLTNAFGDPSATINNIRKRPTQEFQASGGVSYGSWDTQRYEADVSGSILPSGKVRGRIMGYEQTGDSYLDRYSAEKNGFAGIVEADLTDSTLLTAGYSQEQNKPNANNWGALPLLDANGKQISYDRSYNPNPDWAHWDNETQNAFVELKQKLNDQWNAKLTYNYLDTKHNSRLLYYYGYPKADGSGVSLTPWGGQEHQEKHAVDFNLEGTYKLFNREHEATLGYSYVRNHQQDKQSTGTINDSNVIKSTTTDWASWTPQSITWSDFTEAANYKQNINSIYAATRLHLNEDLKLLLGANYVQAESKGESYSSPMSYSESKVSPYVGLTYNFTPEYTGYMSYTSIFRPQTGIDKDTNQALKPIEGKSYEMGVKSSWLDDRLTGTLSVFKTEQNNYPLRNSDGNPLNRKVPTSDLESQGVEVGLSGQITDNVNLSFGYAQFSIKDTKNGGEARTYNPNQTLNLLTTYTPPVLPKLKVGAGLQWQDGIKLYDSNVNGTIKQDAYALVNLMASYEVNDHITLQANGNNIFDKKYLNSFPDGQAFYGAPANYTVAVKFKY

SEQ ID NO: 9520 - protein, 734 aa, Acinetobacter baumannii
MHGMAGSYSMERHSLNLHFMTCSKTALASSIALITSVVYANEAEVSQLPTITVNATQNNDALYTSKKVSLPGFQTGDVKKVPASITTITSERISDQHAKTLTDVIKNDSSLGDGYAAIGYYPNFVARGFALDLGSSYLINGHTIRGEQNVALENKEQVEILKGISAIQSGMSTPGGVVNYVTKRPADVKNITVDANSEGGYTLATDVGGFVNDSFGYRINLAHESIHPNVDHANGKREFGSVALDWKINERSKLLFDIEAQHQSQRSVPGYQLLDGQEVPTNVDQDRLLGYQSWSKPVVNNSLNASLKYQYAFNDQWNGSLSAFQSRVVIDDNSAFPWGCYSSICEVTGLGNTFDKHGNYDIYDFRSPDDTRITNQFAAGLNGQFNTGNIQHQIAFELQRTYKTLKHHTPLNVGVGTGNIYEDTVDYSPSSESPGDRYKALESDQTALTVSDRVQFNDQWSTLLGGKLIHLDEQAYNSDGQQSRDTDLNKFLPQLALMYSPTSTTNLYASYAKGLSDGGEAPWFANNALKVLSPKNSEQYEVGVKQQIRNFLVTAAIFDLKQDNQYSKVNADRTFDFVEQGEQHNQGIELGLTGALTDTLDVSSGVTYTRSRLVDIDTDNYKGHQTQNVPKVRATAQLSYKVPSVEGLRLLSGMQYSSSKYANKEGTAKVGGYSVFNIGAAYKTNFAGHDTTFRFNIDNLFNKKYWRDVGAFMGDDYLFLGNPRTAQFSTTFSF

SEQ ID NO: 9521 - protein, 696 aa, Acinetobacter baumannii
MRHKLGLLSSLGLSFISTLTWGEETSTVLETIRIQAESTREDVSQNSSATKFTHDVLDVPFNRAYLSKQIMEQQDVQRIDDALTLVSGVFHQNSFGGGFWDNYSFRGFSTDPNLGAAMIRNGLSVNRGISAPKDVVNIESLEFLKGPMAALYGRGETGGLLNLNSKKPQWESESELNLRANTQEQYHISLEHTAPINDELAYRLAVAHEDNQSFRDHVSSERWFFSPQLTWKISDQTQLDFDSEFTEHKGTFDRGVSTVNHQFVMDPKTFTGEPDDGDLKIKDYFYQLHLSHEFNPDWKLNSAVSYKDAKMVGFATEPRRMQADGRALERQRRYRDYTSEDVLAQTELLGKIDTSWARHEILLSTELGQLDYKQNQLRRNHSTSSTNTIDIYQPEYGKYLPNLTPFTDTKERQRYFALNVQDQIFFNDQWSVLLGNRFDQVEQDFKNHIKQTEDNQTLHQNSPRFGVNFKASDQWAFYTNYGRSFAMNSGMNRNGQTFAPEKGESYEVGTKYKINDQSVLSLALFKMKKQNVLTTDPIDKDFQTAAGEVSSKGVEFDLNSQITDRWFINANYSYTDAQIEKDQDLAKGARLSNVPKHQGSVSTNYEFLQDGARKAGVGANLTYVGERSGHNLDNGFNLPSYTLVNLNGYYAPSDRLRYQLNVNNLFDKTYYVSSYSDLWVQPCEPLNASISAQWKF

SEQ ID NO: 9522 - protein, 924 aa, Acinetobacter baumannii
MPHRSSRPPHGTWPATVLAVALGLRPDVALAACDLAAPADGQTATCTPLAPNPATTPIVAQPGSSRVTVTIEPNAELAVAAGSAVVVREQSLVDNGGTLRGTGDAAPTVLMQGTGNTLDNRGTIIATGTASHAVFVDGNAPATVRNSGTLLATGTDSSGLQGGTALTVTNTAAGRILSDQSNAIFANHGITLDNAGLIHSDATSIIVNNGPSSIDNTGTIESLSGNAIGATRAAVVITNRGTISGGFRAIDLDVGNDVVNMLGGTIRGAIVLREGDDRFEMSGGQVDAVDMGPGRDTVVISGGQVNGAIALGDDSDAATLRGLTDANLAGMPRLDGGSGLDSLTLDQSRLSGVARLVGFEAVNLTNHSTLVMDGDLVLGDPALQAPAALGLQRPLAVTAPTAGTLDIDSTSTLQIGPAGNAAIVAAAAGQLAAVNNAGVIDLTTGSTPAASRLQIVGHYTGNGGQLLLRSILGADNSPSDRLGISQGTVSGITTIALANAGGNGGLTVVDGIPLVVVTDGGTSTPSAFRLAGGQIQAGAYVYVLYRGGVSNGTADSWFLRSSLAPASSVSPAPPSAAPQPVLSPQPAAGSPALPPAPAADASPVPLYRPAVPVYAAIAGVARQLGVDQIATFHERQGEQALVTERGALGAAWARAWGSNGHQSQGGEVHPDFSGTLAGLQVGQDLYAMAGDGPGGHRDHFGAYFGYARAAGDIAGFALGFPGYAAGKLDINAYSVGAYWSHIGPGNWYTDTVLQYSTLTIDPSTHTGTGATTHGNALALSAEGGMPLQLSPTVTLEPQVQLVWQHLSLNDLQDQVSTVTFRNADSTLARAGVRLQKVLEYRGVRWQPWLRTDILHAFGGTDQTTFAATTSIPTSQAYTAARFEAGIAGKAGPRGSVYGTVGYLTSLDGVPRSAWFGNIGARWSW

SEQ ID NO: 9523 - protein, 715 aa, Acinetobacter baumannii
MNEIARPTSFRDGLFRGSPGKVAMALLLAHGQLYAQEDKNEENPTLGTVVVQHERLTPAEQARTRIENIPGGASVVDSAQVELGKAATVQDILAYQPGVFVQSVGGNDAIKVSIRGSGIQSAPGNMTEGIKFLFDGLALTGPGGTSYELFEPLGLDHTEVLRGANAFDYGAVTLGGAINFVSANGLNAPGTRVHVEGGKYGYRKAFAGTGGTLGDADYHFSVKESRRDGFQRQTFKRAEGLSANLGYRFSPDLESRLILRYNEEFHEQSAPLTRARLHHDPSDTTSAYRVSRSNVDKYGSFLAGLKTTWQIDDHSLLEVGLAYYKYPQKLNRYSTTPSTSDYRDLNPSIRYIRNDTLFGLPSETIASWYYTRHVKGETDAYQRNADGSLTHTKKSRYKGSYDNVFVLGNTLDLTRDLKLLTGLTAIQVRRDVELAYSAAPINSGYSDRVNYDNWSLAPRLGLSWQLNPTLQVFANASRSINPVATWGYSPSTFSTAVNFVKQLEEQKANTLEVGLRVKTERLDGSLVLYRSWLRDELLTVELSPTTETSSALVTTSNADKTMHQGVEAGLAATLWEHGGHRLSLRQAYTFSDFRFRGDDSFGSNYLPNVPRHIYQAELHYQQAGGFYASLNVQARSDYYIDYANTFKSNGYALLGARLGYQAPQRKWSVFLDGSNLTDREYASSTNVVYDAQGKDTASFYPGDGIGVVAGLDFRF

SEQ ID NO: 9524 - protein, 717 aa, Acinetobacter baumannii
MTQPHVACRALQGRALFSLLFLASPGLMAADNSAAKSNNDAEETITVVADGAQQSATCGYQPLSSATATLTSMPLLDIPQVVNTVSDRVLEDQHATSLDEALYNVANVVQTNTLGGTQDAFTRRGFGANRDGSIMTNGLRTVLPRSFNAATERVEVLKGPASTLYGILDPGGLINVITKRPERQFSGSVSATSTSFGGGTGSFDVTGPIEGTNLAYRLIGEYQNEDYWRNFGKNKSSFIAPSLTWFGERATVTASYSHRDYSAPFDRGTIFDLNTGHAVNVDRKTRFDEAFNITDGYSDLAQLNAEYRLNDAWTARFDYSYSQDNYNDNQARVMAYDSATGNLTRRVDGTHGSTQKMHSTRADLQGNVVVGGFYNELLTGVAYENYDLLRTDMLRCKNVKGFNIYHPVYGTLDTCNTVSASDSDQRIQQESYAAYVQDALYLTDNWIAVAGVRYQYYTQYAGKGRPFNVNTDSRDEKWTPKAGLVYKVTPNVSLFANVAQSFMPQSSIASYIGELPPEESTSYEVGAKFDLLNGITANIALFDIHKRNVLYTESIGDETVAKTAGKVRSQGVEVDLAGSITDNLSVIASYGYTDAKVLEDPDYAGKPLPNVPKHTGSLFLTYDIHNVYNSNTLTVGGGGHAVSKRSGTNGADYYLQGYAVADVFAAYKMKLQYPVTLQVNVKNLFDKTYYTSSIGTNNLGNQIGDPREVQFTVKMDF

SEQ ID NO: 9525 - protein, 187 aa, Acinetobacter baumannii
MLRICMKKFSILFLSFIFISDIFANDYYDTGRVFAGIELGGAGIADFSTGVIGGYAYYFPQSYQNLDSFRQGIRGIVGINWGLYRHSKLNPQGISWVETSSNALYTRIGVDWIIDFNPQDTFVWGAFAGLNIGYFKVFTSDFIPPTHRGFNLEGHIGGSLTYNNMHRIELLLGWGYSRSALRYVYMF

SEQ ID NO: 9526 - protein, 750 aa, Acinetobacter baumannii
MQLKPLFTLLPVVLSSVVQAQENTEQAVDETVTVHGQSILTDQRTRSDLDKVRGIANADIFSGITSVQSNNMHNEAGALDIGIRGVQGEGRVPIFIDGSLQSTHTSRGYQGVSDRTYIDTDLLSSLTVNKGATIESSPYASGAVGGVVNATTLGIKDIIKDDQAFGVVLKARANNHNRTPDVSGDYSEQGQYALDERGEHSAFKHGSLMLGLGYQAESFNTVLAYSKRSKGNHFAGKKGYEEYQEPVVGQGQEVVNTSFESDSWLFKLASDTGTAHNADFNYRHHAQKAGEVLMAYWYKSSEDWEGNPYPDGKDRMPQWGLGTAKVNTYSANYYYQPDHPWLNLNANFWYTEADLAQYNGLWALGTNAEQYFHAYHNDRSGLSLTNETLLTQWPVRLNYGLAQQNERLSPEEDGQTRFTKTVTSRHGKRTAQNLFANADIDYSPLRVQLGLNLHNAKSTDYQTKQQLDYKEKLDLLSEFTYALTPSTQLFLKSSRTYRMPSLYETTLSNEVFSYNPYNPIKPEQAWNNEVGVQFMASNSVLQDDRLNLSVSYFRNSIKDFISGGRLAKTPGMSEWQANFTFTNYDKLQLSGWELGAHYQYAWLYTHFAATLYSETKICSVQQAQYAESDTCNSLGFAWGLTPTRIPPKQNLYLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 9527 - protein, 741 aa, Acinetobacter baumannii
MSHIKLSALSLAVCLSLPGYALANETTQNEAQKASFEKIEVTARKRTESLFESPTAISSIGSGLIESANMSNLDDIGKYVPNLNITRYGVGNAAHASVFIRGIGLQDHVITTDPGVGVYLDGVYLGRQMGANLSLPNVERVEVLRGPQGTLYGRNTLGGAVNIITKQPGSDNIVTVNTKLGSRGRIAGDVYLNTELTDELSFSASGSFKKRDGVGKAINLANPEKEIGEEEELSGRMSAKWQATSELAFTVSVDAVDNEAGQSPYTIEFTSALDANDPFNGDFPLLTPDMIPSNPDDLATTVAGIESTGYSGWGTSFIADWQINDIYTAKFISSFRSSEYEGGLDDDASALNLSEFPEEGGADQYSFEIQVNATFDNMDFVSGLYYFNEDGYTRSGPFVFSPWNTPNGLLNDGTTASFGDYGYFDINQETDSYAAYFNMSYDLSADLSVGGGLRYSKDEKAADAIFPSFSERKFETAEFDAVTWDVNTSYKLANGMNVYGQIQKGYQTGGFPPRPFGGPAQFVSFDETHAINYEMGLKGQVLENVSMLLAVFKTNYTDLALPFSDPTAGGGFVTIVENAGESEAMGFELETTIAVTDDFSIRSAIGYLDAEITKVDAGVIGIGKGDTPALTPKWTIMIAPSYFVDLENGATIAMNANYSYRSEIQGQSVYNASETIDSRELVGFNVSYQAPAGDWEVTLYGENVFNEIYDQGRLQQSGFVGVMRSNDRSEFGLKFRKDFEL

SEQ ID NO: 9528 - protein, 206 aa, Acinetobacter baumannii
MFKKVLTTTVFGVSALGAMIAHAAAPGVYVTGQVGYANNNMHLATEDRIDNNNLSESSLGGRVAIGYQFNQNFALETGYFHSMKKHVTLVGKDKAETLISDNLGLRQHAIDLVAKSIFPVNTNLNLYGKLGVAYLTTDFDKDTFNGRPISNMIAKHKLAPEAAIGVSYDITPNVSIDSSWTHIQPIGKNRPGNIDFVALGLGYNFG

SEQ ID NO: 9529 - protein, 375 aa, Acinetobacter baumannii
MELFGSFAFFGGALFGGLGLLLYRTLGLPWRLGYRHLIGALCLAVWLAVFWTRPYQPLGLLAVASAALWAMRRGHLPTWAAVLLTMALLLLLKCGITTMTGMLGLSFATFRAVDVLLFAPRNERISPLDYCNYLFFPLTLLAGPMYRWRNFQADLKRGYEGVTLETWLAGLELLIFGVIQKFGVAEAIWRYGLNTLDAHDYSLTGVALNASLYSFYLFFDFAGYSSMAIGVGMLFGFTLPVNFRNPLASANPQDFWRRWHISLSEWLRDVVFMPIYKALSKTAFFGRHRLAAQNIGILATLLAMGVWNGLALHYVVSGLMFGAYSVGHNLLVQHARTRPALQAFLARRPVQWAGRALTLILAALALYVFSGRSPI

SEQ ID NO: 9530 - protein, 439 aa, Acinetobacter baumannii
MPNVMKLSVLTIAVLGSQFALANEPWSQDRQWLLGDWNGKRQQLEQQGYKFTASIMSQSATNLDGGYNDSNTFENAAQLSLGANFDLEKIAGWKDTTASLVMTKRDGNALTLERIKDPRSSQLGNAQEIYGRGKIWRLSQAWVKKGFVDNTVQVKFGRMGMSEDFNSSQCEFQNLLLCGGQLGKSIGSIWYNSPVGVWATNVKYQFAPEWTLGVGVYEVNPDNIKTESNSDGFNLDMNNVKGATIPVELAWKPKLAAFNGLPGEYKVGALYSTAEANDIKTAGKVHDGKQSFWINAQQQLSHAGQDPKRGLYVSFNSVVNDKATTFVQSTQQLALWYKGPFDSRPNDSIGFGIANYVVNDRAKDKQIATNESRGYYSYDPIASDYIPIQDDELNVELNYTYQWSPAVMLRPNIQYIHQPAGVKEVDDAWVAGLSVKVNF

SEQ ID NO: 9531 - protein, 699 aa, Acinetobacter baumannii
MKRSVLFISSVGVMTSHVYALEADQQAVTNLPTISVKADKEISLKQEVGQASSATKGLMQLKDVPQIVNVVPKQVLREQTVTSMQGALQNVAGLSFSVGDGQRDQVMIRGFSAITDNYVDGIRDDALYFRDMSNVERIEVLKGPASVLYGRGSAGGLVNKINKKPMDQSLREVSLIGSTTGQRRAEVDVNEKVAENVKVRLTGAVEDSDGYRDQAFLKRQAVAPSVQWDITDKTKLLLQADYLHDNRLADQGFPTDPITGKPVKTNPKIFYGALNGKEVGDVDTEISSQTISLDHEFNDNFKYHGAVRHYNYSLDRQYSVDSHPAADKSKITLTQNKRLRNEDGVYVQQELSALFNTGFLKHSTLIGAEYSKQHKDELVWSKARQITNIFNPQLENWAPLDTNVDADTNNTNTFENYGVYLHDLMTVTDQLKVLVGLRYDNLSQDRDDQSSKNVDLNRTDNTYSPRIGVVYQPVNNLSLYTSYNRSFQPLADSFVFYKNSDDLRPTKTENYEIGAKWDVNDQLNVTLALFEMSQTNIQNKDPNDPKGLTAILAGEQKTKGVELSLAGQLTDQLSVLAGYSYMDGKIEKSAIGFTGNHSALTPNNTANLWLKYQINDHWYAAVGGRGESSRFSAPDNKNVLPGYAVVNAALGYQSERYDVNLNLNNLFDRDYFVSGHSGANDSNMMGDPLNAQVALRYRF

SEQ ID NO: 9532 - protein, 743 aa, Acinetobacter baumannii
MSLIRTRKKIVSSAIASSLSMIATTAMAQEAVSQLPTIHTKATQEESLKVDQSANSKFVAPLLDTPKSVSVISKQFIEDTKVTTLADALRTVPGITLGAGEGGNPNGDRPFIRGYSSESSMYIDGIRNSTSQNREMFAVEQVEVTKGSASAMGGAGSVGGSINMISKVAKKGDFLEGSVAAGTDNYQRITLDGNKDFGNGIAARVAVLGHQNEKAGQSNGAEYKRVGIAPSITFGLDTPTRATLSYYYLQTDDKPDSGIPYWDSSLGKAQGKPAEVKQGTYYGWKDRDFQKQENHIGTIKLEHDLTDNITITNTAMYAKSKNDYVWTNPDDSKGNVGKGLVWHRLNSAITDSETFTDQLALTGKFDTGFLKHRFNVGAEYSKQKTDKGGYNIIDAKGNVSSTGFYSDCSDLSTNWCTSLNGPTQKPFVDRLQARPDFDATVESTSVYLLDNIEITPKWLLDLGLRWDKFEAEQNFLATSSAAAYTAKNDSDFVTYQAGITFKPTENGSIYTSYATSASPVGLNAGWGDNSETINANNQMIDPEEAQTFEIGTKWDFLDNHLNLTAAIFRTEKQNTRVQIDPTTYANVGESKVDGFELGLNGEITDKWNISAGYTYLDSELTKNGKSCRSGKCTDQSIYNGNQMPNVPKQAATLWTTYKVLPQLTVGAGAVYSDKVYGDVANTKWVPSYVRYDAMARYNVNKNVDLQLNINNLSDKRYFTKAYASHYATEAEGRSAVLAVNFKY

SEQ ID NO: 9533 - protein, 713 aa, Xylella fastidiosa
MPPLLLHKRALYLALTLPFAPLALASETSTTIPKELDRVEVRGRAQALYRVDDAAVGTRTDTPLELVPQSIQVIPRELIDDQAARQVTDLYRSISGISYFSYAGVTLRGFRQENVLYDGLRGDPYAGFSVPQLFNIERVEVLKGPAGALYGGGDAGGVINYVTRKPRAATERRIEVQMGNRDFRAGSIEGTGPLNAAGSVRYRAGLYADTEQGVRWNTDSESVIGDASLAFDVGRTGELVLQFTDVTQNLGGNRLRGVPVNDAGTFLTDRHWNHNEASDFLDMRAKVALAQYRFAPRDNLDLDFAARWFSNNEHQMYHEPMGLIDRDRDGVAEWMTRQLRNQIRDNEAFTANGNAVWRVTTGTVEHKVLFGADVYQLDADFTAQTASSADLARGAGPVRGIDLFNPVYGASTWHDYNLAALPWRSTSTRSKRYGGYLQDELALGTRWHVLAGLRWDGFKDDDRIAGSSVDGNDLSWRLGSTFTVREGLNVYANVASGFVPQSATNQNPAAGGPFDAERSKQWEVGMKSLLADRVTLNMAAYRIDRSNIVQATGEVIGGVNQLAALGLVRSTGMELDLLADVTDRWVLNLTYAYNDARVKDAGPNGITNASGDRFANAPRNKLGLWTRYDLPSINSAIGFGADHVGERVSLDGQTVKAYTVFDMSWKTTWKQWQFQANVKNLFDKVYAASSFIARNGHFPGEPRRVYVQAAYSF

SEQ ID NO: 9534 - protein, 793 aa, Xylella fastidiosa
MNPFVSLTVASVTALFVASPAFGQEATQSTTLDTMIVTGTHVTERTVVESQSPIDIISAAHLAATGSSELATALSRMLPSLNFPRPALADGTSGIRPAQMRGLAPDQTLVLINGKRRHLSAQINVNATIGRGSSAVDLNTIPITAIERIEVLRDGASAQYGSDAIAGVINIVLKGATQDGSLAVEHGQYSAGDGATSKLSGDSGISFANGRGTLHLAMDISQQEQTNRAGPYQGSAPNTGNYPDIGRTAFIYGDPRVNAAAFSANGMFHVGEHVKGYATAMLSNRDITSFAFYRSRNHNGQSMLLAQRYPEGYVPEIEQNSKDRSLVAGLKGSTEHGLNWDVSYNYGSNHIGFHTNNSINYSLGVESPRDFYDGALEYTQHLLNTDFTQVLDWGLTYPVTLSFGTEYRYEQWNQSPGIPASYNGMTGGAQGFAGFSPLNTVHANRNNYALYAGLDGDLSEHLSAGVAGRFEHYSDFGNQTSGKLSARYALTDQAALRATIANGFRAPSLAQQRYQVVTSTYSNGTFYESGTFPTTSPVAQALGATPLRAESSLSYSLGLVLQPFKRLYLTLDTYQIDIAHRILLSSNLNDAAVLAALQQQGNSNVTSVRYFANAANTRTRGVDLVGTYTIPFAVGQLDLTTSYSGIRTRIRSAVTQPAALSAIGSTQTIVGRDEIGRLEESFPKDKLILSGTWKLTQWDLMLAATRYGTVRVRNPTSVSRDQTYGARWVVDASASYKPDMHWMLTLGANNLLNAYPDKTVNAINSIYGQMPYSNYAPFGFNGAYVYARIGYSW

SEQ ID NO: 9535 - protein, 788 aa, Xylella fastidiosa
MKNRSCSLALIITIALICTISPLQAQSTSNKTLDTLIVTGTRISDRTAAESSSPIDIISQESLEATGTTELATALSRMVPSLNFPRPAVSDGNDAVRPAQLRGLSPDQVLVLVNGKRYHTTALVNLNEIQGRGSAPADLNTIPIAAIERIEVLRDGASAQYGSDAIAGVINIVLKGAGKGGSITGHYGEYKVKDGKQYELSGDTGLSFAGTGKVHFAAQGGHEDQTNRAVPYNDGIIRQRYGDPKINQGAFSYNGSYSPTEGVTFYSFGMVSRRKVLSNGFYRWADDARNRPEIYPEGFLPQIYNVANDTSWVSGMKASTAWGLNIDLSYNYGNNQLTFDVRNSLNNSLGLSSPTAFYAGGLEITQHVLNADFNKSVDWGHLAYPLNLAFGVEWRGEIFNEYQGEEASYINGGVRSSAGTLLPGAQVFSGFKPSDSGGFDRNSHSMYIDLEGNLTEKFSAGVAGRYEHYSDFGNTRTGKVSLRYAFTPQVAVRATTSNGFRAPSLQQQFFQSIATDFIAGIPYEIGTFRTDNAAAVALGAEPLKAEKSKNYSLGLVVQPVDDLHLTIDAYRINIDDRIVLSENLTSTAVRHYLQANGYAGIGGGRYFTNGVDTKTTGLDAISSYHWALSNSTMDFTLGYNYNKTEVKRVADNPARLTAIDPSAVRISQAELTRITSGAPRDKAFLSGVWNIGHWSFTATGTRWGEFTVYNTPTSVPVQQRFAPKWTLDLAMSYKLQHWNFTIGGDNVTNTYPERDLIGQGTQAYLPYSRSSPFGFNGAFAYANISYNW

SEQ ID NO: 9536 - protein, 958 aa, Xylella fastidiosa
MKFKPDIPHRLLVVSLAIAIATFAPPSIVFAQEKDTSAAAVLDAVNVTGTRLKSQSMTASSPVAEINAEEFQYSGATKVEDLVNQYPQLSLNFDGFTNNGSDGYATVDLRGLGAKRTLTLVNGRRIPKGIIETPDITIIPTAIVKRVDLLTGGASAVYGSDAIAGVVNFVLDDAFHGISVNAGYSAYQHNNDNTYMRGLMDKAGYPYPKGGSGFDGVSRNIDLAIGGNFGESGHATTWVTWRQNDGLLQGQRDYSSCALKPNGTGCGGSLTANPPNFNIVAPTAGTFFVLPSANGTWSKTDTPNLYNYAPVNYYQRPDTRYTAGTNIQYEINSHFKPYVEALFVNHRSSTQIAPSGTFFNELKVNCSTAVIGSLCNDVGITDSAFSVYVAKRNIEGGPRSTNTDTSSGSITAGTGGNLIGNWSYDASFTYNRSATKSESFNDFITTRVHDALLGCPTGSFDGCVPYNVWTNNISAAAAQSLQGVGIVNYTTSMKVFNAYVTGDFGYALPWANNKPINLVAGYEWRTEGYTRTADSNTQAGNFAGSGGPTSNVDNSISVKELFLESAVPLLANTGILKELDLQFGYRRSKYDVSGSTNTYKAGFGASFAEGQYLLRGGWNRAIRAPSITELYEPNTIALWDGSDPCAGTSPTFTQAQCANTGVTAARYGNITANPSGQYNEISGGNKNLKPEIADTWTLGFAATPIKNLDLSADYYSIKIKDTIRTIGASNILAACALTNDANLCSRIRRNSATGDLFLGSDPATSGLVLNSRGNFGALQFRGIDLTASYAWNVGPGRLTTNMIGNYVIKQDYQPVPGISDNNYSCAGIVNTACGDTDGRKGGTSKWRHMVNVRYGFDRYTMGLRWRYIGKMNYEDTDGTPGSTDKLVVNGGNRVSAYNYLDLTGSIQLDNDITWTMGLNNVFDREPPLVGSSLSYNGNALKGYDQAGRYFFTSIGLKF

SEQ ID NO: 9537 - protein, 731 aa, Xylella fastidiosa
MKLKFQKRKFLTVVIVFSMCGGSVVYANGSVPSVSNKYDLGTLTNDGSQYSYVNALSKDGRVVGGFVTPDGNDYIATIWSWNNLKDRINIGASFARSKVKALSADGSIAGGYQYIRIHESISSANLEKKASNGKFLANDDSATFIPVIWSADSWENVVKLELGILESGVVNALSGDGKTIGGYGFSTHLVPIIWSGRHWKDIKQLDVPKEYYDAEVRALSTDGKVAGGYISSKNTTRGILEGKSRNDTQNFTHAFIWSGDGFGIKTDLGTLNNNESEGAEVRALSTDGKVAGGYFSMENGSVFYGAIWSGDQWTTKTQLGTLKSDNSGNSLVYALSADGKIATGFAESDSSIGRATVWLGDHWQTKIDLGTLKSDNSGYSIATALSADGTVAAGYSEVDSGKDHATVWKIIYPTQSHSESQPQSQPSVVKVDTVNTIGALSVLAAETFSVMDLQRQGLILLQQGCEIDDSQVCWSVRTGLVSTGSNRDSVVGFRFGYAMFETLSAGFSLDRSLSRSLQDSYFKNNHNLGAGFYAQWNAPFRGGEWYVRPAVAFNQYSVVVQRPLLTNTEAGSGRSRMKGRDASLEAGQRFNADQSVLLGWHLGVRHSSVLRTAYSEQNAAFPVSYSAINNRRTSAYVGADVGVPLTARLKWIAGLEIDRRLYGDDPVYGGHADYIGGFAHQMVMKRVIGTISSGVEYRLSPTMFLGATFDVSRRALGDRTWSGTLSLGGRF

SEQ ID NO: 9538 - protein, 1095 aa, Xylella fastidiosa
MKNMKQRFSKYMRYYEKSLIFILMLFSVSVIQAQNRTLKGTVTDAQGEPIIGANVVIVGGTKGVITDLDGKYSIQIPESGAVLKFSYIGFKTKSFNVAKGKNVLNVTLEEDAVMLEQTVVTAMDLRRDEKSLSTAFQKMDVANMTETRDAGFVNMLQGKVAGLQVISNGAAGSATVRIRGANSISGNNQPLYVIDGVPIINNVLDGEIDYGNPANNINPDDIENIVVLKGANASALYGSDAANGAILITTKKAGNRSGWGVTYSTNVQFTEFSQYPIYQNIYGSGHINQFENNKANTFANDIKVPYDPNLPYGINRLDGGYGERSWGMPMLGMQVVGRNGEIKSYIPTPENTTSMYQTAYAWTNSVSIERSTDHVATRIGYTNLRSDDVLEGLNNLTRNSFNVRTNIKLTKKLDVDLNGRYTHEHVNNRSYRNNSDRNPIYTLINMPRDISVGEMYPWKDENGKPTSLLFKSPVWMLNELSNQDKGEWLLADITLNYKITNDLKLRLKAALDLNMKQGYEFRNMYTPGDADGFYKEFTEKGRNYTYEAMLSYNKTWKDFNLSASIGTNAQDFLFKKENSEIGTLATKDFVSLTNNGATIRTWPEYNAKKKQAIYGTASLGYKDFIYVDVTGRNDWSSALPSDNRSYFYSSYGTSFVLTELVKSIPKDWLSYAKFRVSYAKVGNDTGFDQLLNGFNYNNSYLGDMAWFESENKRKTNTLKPESTTSFETGFDLRFLKDRVSLNFTYYNKNTKDQILTSTINGVSGYGEALFNAGEVKNWGYELTLGVTPFQNKDWEWKVDLNWAKNNSEVVSLANGMDYMTLTTVQNSVELRIVKGQPLVSLYCREPWKRNEQGQVLVGANGRPLSGEAKFLADVEPKWTGSIRTSLRWKDLTFSALFDVRMGGHVWSETAFIGSRNAGTIMSLGGREEHLFSKLILNEDDQTGYLGTLDSKYVPNGMSNIYMDASRPKGMNIPGAVYDASVPGLAGQPCQAWIQPIDYWTNDSGRNGELYLYDASYVKLKEISLGYNIPKNWLRKIGFIQSMRISAVGRNVAILHQKTPKGIDPEATSSMGIQQGLERGFNLPTSTYGFDFKITF

SEQ ID NO: 9539 - protein, 809 aa, Xylella fastidiosa
MPFIIFFICFTFSMLDKLTAQNPAASSSSSAVNEPIMLPTVEVTEEALPGPASSSTTAYGPELSVLETPRQITQISRQALDTLSPGNLMGYDDLAPLVPSMTTMAPAGDYSVEPFIRGLPATTFRNGMLVGLESYGTSGVLPNFYAYENIDIVQGPVPAVFGAREMAAGYANQITKQPYFDRFRGAAQYSVGMYDQNRWNVDIGGPFAGGKAAYRFDYAGQYSGSYYEGAYMHSQAFYLALSARPTENYSIDSNFEFDTLGFNLPLGINRPDQALIDSGLYQSGNMIGWLGPNGQFHPGIGTSVPGEGYIIQWGPQVPISLRSNLANLAGSGNRSTYGVAQLIQTLKLSDELQLVNNSMYEYVTLLQNPLANSNWTYTPGDWLVENRLEAIAKTNTELGKISLSHALDGGLFFMFGSNTDYTETSRIADNFWNMTKPLSRADLLPPLTLAEALRAQNIYLTDIPVPGIPYITYNTNNFATAKDQFFQISPFVQDYVQLGKHWSLLFGARLQWYMIGATDPPGTPPALMLQSYYSVLEPQVNASLSYKPYPWMNAYFTYANAQTAAMDVLGGFCPEFTSRYYHLTNIEYEAGVKWNLIHDKLFVTTEGFFYSTFFPVTVLPGGFTPITPADVIGAEIAATYQPNRDWSFNCGFDYLTGEEFWTQSSAQTGPTVIQNYSAAVAAAYNLPVDPYITLPTGIYPFIGFPHEHGTAMISYHSDRGFGINFWLWIQSGMFLSYDYATRIPVDYTLNTSLFYGTNRWKIQVQLYNITDNHYWFPTGTGFQGDRVYNYDKVLIGLPFWVMGTFSVFF

SEQ ID NO: 9540 - protein, 398 aa, Xylella fastidiosa
MAIRRLRTIFVSLLLGLAASATQAADHSDRNVTAKLGGRFEWDFALFDNDARGTPNRSDNEIRRFWLDVTGKIFAFDYTIEGNFTNLQDKFKGKSIEMGDVYLRHDFGNTGTLTLGQFKQHFSLDDRTSSDYGQFLERSGGANTLAPEYHKGVSWQATRQNTTWWISAYSLDSISLSNVNGRGLSGRGTWSRDTPEGDVLHLGLSLAHQRYDHPGSDGMTALSIRPLPAGHLSDNSDITLAHFANGRDTKVNRWALEYAQVRGPLSWQSEYIGGAFNDGMQRATVQSAYGFISWFVTGESRAYDRNTGRFTRIKALHHPRGALELALRYDRMWGNQHHNNQPNFLNASTASWTLGVNWYIQPNLRLMLDLIDSRNRDHLVGTTLDHTRALTGRFHYDF

SEQ ID NO: 9541 - protein, 355 aa, Xylella fastidiosa
MRPHGEPDVITPRFIRTAAAVAVAACGAVAHAQSTLTLYGALDVGVQYLTHADAHRSAVQLQNYGIVPSQIGIKGSEPLGGGWRALFKLEQGINVNDGTATVPGLAFFRGAYVGIAGPIGTVTLGRQFSVLFDKTLFYDPLWYASYSGQGVIVPMSANFIDRSVKYQSPTFAGFDVEALVATAGIAGNTRAGRVLELGGQYTSNGLSVGAVLHQSHGDVSATDDASGRRRELGTLAARYAFAALPLTVYAGVERRTGDLDAARTIVWGGARYLTAGGIGLNAGVYHTDSRTPAIGHPTLFIASTTYALSKRSVAYVNLGYARNGNRSSQTVYEYDPTPLAGASQFGAMVGMYHLF

SEQ ID NO: 9542 - protein, 949 aa, Xylella fastidiosa
MKTIFAARTILASALAAALSACGDPLVRSETPTTPTTPTTPTPLPDLDPALAAKFRAHLDVTNTEPAHTLGFTGKGYMIGVVDSGVNPDHVTLQGRVIRNNVYVDYQDPSSPHDVDGHGTTVAQLAAGRPFGDFPGGIAPGATIFSARVFSSAAESAKEDPIGGNFFEGEAAQLKRVNADMIAAGVRIQNNSWGYESDDSNGEPIWTSPIITGLFVNAYRDLVLNNNGLMIFASGNGKQTQPGQLSRLPSLPTVEGGASPADLERGWLVVAALDSFDHPDQLASYSNHCGIAMHYCLAAPGDVITVNSSVTNSSSVSDKYYVEQGGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLMLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGANNAYVTLQRLNVSAAAQALGIVDRVAQASAQRVEQAFRAIDAQQAQGRGALPTSFIGAAAALQQSSSAAVAAGSLQSLSGQSHVAAAAASLDAIDLGRRSLATRLDVLRSGERIVTWHQALGGPGQNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 9543 - protein, 1008 aa, Xylella fastidiosa
MKKSCSSQLLQIRRLLCYAFAVCLYLALPNAFAQSSNATLRGQVSRAQAGAVVLVTNTATGLVRRSTLLSDGTYAMTGLPPGEYTISVGGVSRTVTLSVASSVTVNLDAGVAISGDAKTLDAVQVTGQAIREVKTSEIGNTIALRQIQQLPQATRNFMEFADTVPGMAFNIDPQGRTTLRAGASNSSASNLYIDGVGQKSYVAKGGISGQNDSQGSPFPQLAIGEYKIITSNYKAEYGQIGGAAVTAATKSGTNEFHGETFYRYTNQNLRDRRPDEGETKVDSQTKEYGFALGGPIIRDRMHFFFAYEGKDNVVPRSVQADARAAPYVHFLPSYLSQQYGPVNLPFNEDLFFGKIDFEPSGDDRLELSVQYRDETQIDNIGGQNAADHGLNKINKDKRGSLRWQHSADAWFNELIFTRENARNNPNPMSIGNGFNYVYLDETDPNIGEYTFLSIGPDGGSSMQRRHQDGWSLQNDLTFTSVKWHGDHTIKMGVSYKNITLQSQDAASLNPQFSYAVSSSGVATTPYRVDFYSPYATPGQKALVETRAKQYGLYLQDDWNVNQKLTLNLGMRWDYEDNPAYTNFVTSQAFVAALYADDPENPGHPWANRLLPSGINVADYISNGHNRHNFNKGWAPRFGFSYDIYGDEAAVMHGGAGRSYDRNLFEQMAYETSKAALSPVAVYFQDPATHTCYHSGRLCVPWDPKYLNGIDQLNAIAGVSGSGELFIFNNKLKTPYSDQYSIGISNKIGGWLTDVTFQRVLSNDGFVMSLVNRYPDGRYFDAEGNAPWDQSVPGHKNTILGMNGLKQRSSQVLLSVEKPYSKESGWGVNVAYTHTSARQNRTIDEPFAFDKATIYEYPFVKSDAVAAHRLVVSGSMDGLWGMTFGAKVVLATPTPINTIACYGQIDPDGANCQQVGVIPPSSGKFLVGGNIWGYRTVDFQASKEFTVFNDFKLSARVNLLNAFNFKNYASYVYNSFGSDGRLQPDITINRIGDINYVPRTVTFELGMKF

SEQ ID NO: 9544 - protein, 645 aa, Xylella fastidiosa
MIRRRTASSLTVGASALATLLAGSAGAQDIDLGEIVVTPNRAPTALSGAGSTVEVIDEDSIEAQSRPLLTDYLNELPGLYVATQGGVGKETSLSIRGADKKYIKTLFNGIDISDPSATQVQPSFEHLLIGGVSHIEVLKGSQSTLYGADAVAGVIDISTLRNDPVGTTHRVLVEGGSNETGRASYGLSNVTETGRMSLDIAGLYTGGISAALVNGNPLIDPGQSSLEDDFYQNVTASFAGEQQMGDNVTIFGSGLLINSKGAFDDSGLPPTDNEMNEGHSRQMAGRAGISFDLMEGRFRNTVSGQLSEIDRDISSVSIFGPFEGEFNGRRGKLDYQGAFDVNDRLTLQFGADYERRQAHITNNYGTDTRDADWIAGIWGQVIAEPIENLTVTAGLRHDDHSRFGGYTTYRGAVAYLFPSTGTKLRSSIGTGFRAPSLYENNYVSYDPTVPLPDLEPEESFSWDVGMDQSFMGGRGTASLTYFQLDTDNLIDYDFIRDTYIQFEGTTRRRGVEMGLAYEVNDWLSLGGNYTYTTAVEADDERRPRIPRHMIGLLAEARPAEKWTVSASAKIALDTVDFISPSFGTYERVELDDYVLLNAKVAYKPTEDTELYLRVENLLDQDYQTVYGYGSPGISAFAGFKAKFGP

SEQ ID NO: 9545 - protein, 1041 aa, Xylella fastidiosa
MKTFSRYTPALNHLALALASTLLLIATYTANATAAESEHSTNEDSKAAPHESKTTELDRVVITGSRIPRAGFDTLEPATVVNRQYIDSFGFTNVADALFSQPGFDSSASVRGNQAGFGAGVSFLGRFGLGSNRQLTLVNGRRLVTSNPPTVFGPGDGGTQVDLNVIPTSLIERTETIGVGGAPTYGSDAISGVTNIILKKNYEGAEVNIGYGLTERGDNARYSYSALLGSNFANSRGNVTIALNADDNAGVLNEARRYYRNGYSMQTNPNAAAIAQFQPGRQYATDGRVNPTIPFNTSNTDGIPGRVLIRNRRINNMTWGGLLYPSTGRYIRDASQQPRGFGPNQDQFLQFDKHGNLVSYNPGVNFGNSSSSGGDGLDFNQTTQVTSQLDRKSVFMLGNYDVTDNISSFFEGSYYTSKALELTDQSIYNAVSFGTGNVNGSGDQSGALNFNIDNPFLSEQNRQALRNLGITDFRLSRASRDLVIGNSSTDTRLWRAVAGLNGHFDAGGHPFTWETSLNHGEGNFDYYRTGLIQQHFINAINVTRNSAGEIVCDSSAAGTTVDPNCVPLNLFGEGVASAAARNYVTTPTHAKAQMKQTVFNANLSGSFIDLPGGKLGFNVGYERRREEGRFTPDEYQRLGLGRTVPTTGSHGAFTTNEYFGEILAPLVNPDAHLPGLHRLDLTAKLRRVNNTVNGWFTAYTYGLQYEPFQGLQLRGNKTRSFRAPAIVELYTSQQPSYSSIPEPCTPANITAGNRPELRQRNCEAFFAYYKGVNPGTFQEAPTTQLGSVSGNPTLENELAKSWTAGIVFQPEWAHGLRVAADWYDIKISNVITQLDSGDITSGCFDNETFNRNDVPNANRFCSMITRDPSTGVASSIRKEYTNGPYINFRGWTAEINYRLDLKELRWGGSGILDLGFYGYFPKNLKYTAAQDIPAEESVGTIDNSKRQFQWNARYLTGPWNFGVSANYKSAALYSLTNTVETRDYLGIPSYTSYDANIGYTFDKHSSLNLAILNATDKMVAFPYVYDGLGRRYMLTFNYKFH

SEQ ID NO: 9546 - protein, 681 aa, Xylella fastidiosa
MLVTHISILPRTVLFLAVSSLLLTPALAMADVGPPPTDSRHFKTTEVTRHLKDLDAVVVTAIPLRDSYSDLSRPVALLAGERLDEVRASSLGETVAVLPGVQSSNFGPGVGRPIIRGLDGPRIAVLNNGLSSQDVSTVSQDHSPAVEPFLANQIEVLKGPSTLLYGSGAIGGVVNIVDGRIAEAPVGGFNGRAEMRLDGGDKHGNTNMFRIDAGNGSALSVHADGVYRNEKDYDTPKGRQVNSFIDTKSGSMGASFSGDFGFFGLSVARFHDSYGNPGEPGDPVAGDRGSWLRLHQDRYDLKAGLTDPWGEASALRFSLGHTQYDHIEFEGNEVGTTFGKRASEGRVEASFAFGGGWRTAFGVQGGDSTFQALGEESFVPKTNNKSIGVFGLAHNTFGLFQAEFGARGDQVKYDTDNGVTRNYHPGSLAFSGDLALSKQWRLTLNVDHAERAPVEEELFAKGPHIATLAYEVGRADLKKEKANQAELGLVFRNDWSDAKVSTYYSRYGNFIYLVDTGSTWFWDDGQRDLPVRQWSQANAIFHGIEGEATFHLAKNTSGSWDLRVFGDTVSGRLKNGGNLPRIVPARYGAELRWEDAGWRTSLSAKRYEKQNKVAVNETPTAGYTMVDAHLAYHIDVDSIAWEVFFDGNNLTNRDARVHTSFLKDDVMLAGRNYTAGLRMFF

SEQ ID NO: 9547 - protein, 762 aa, Xylella fastidiosa
MTHTRTSFLAQSINMVLFASALGASTHLVAAEEEQERKGIEVINITAQKRVENLQEVPMSMTAFSAEAIEKNQLTDIGDIAAVTPNFSFSTTGSGRPEFTIRGIGTSGVVRAGLDNAVNTFVDDVYISRSSSSIFELFDLESISVLRGPQGTLFGKNVVGGAISINTKKPTEDLEMKIKGGVGSEGLRTVQAYINGGLTDELAGKLTVSTNQRDGLGYDTASGQELADRDSKSVRGQLYFDNGDFTTLFTADYSRDKNNGQIISERGLGSLAATDNDRFTSSHGIPQSVDSKIYGFSLKAETEIDSGLITSVSAIRKNSLATVESFTAEQLNVDNGNRTGTQKIPGLADIFDNSESSTQITQEFRFTSNTDTDLAWVSGVFFIKEEINRIECEEVYVNGTQPVFIGGGAAGKSRPCWDNTNDTTGLAFFWDGSYDLTDSVKIRVGARYTQEEKENYIEATYNETLLDQYVPGAENLPDAQLTFPLSEAYTAKANKSFSGFTPRFVIEWTPSDDLLTYFNVSKGFKSGGFDGKVNSNNLTAEGIGKAERPFDEETAINYELGLKSQWFDDRLRVNTALFQSNFDDMQRLIIVPAGGLAVVNAASATSKGLELDGVALLTDDWELNFGYGFLRATFDEFVINANDDRSGQVLPNAPKHKFNLGSTYTHTLENDGTVTFYASYGFTASQHFNRAPIANLETQGAYNVYNANISYTTPDENWKFTLWGKNITDTEYSNKLGQFIESTKENPADPATYGISVTYNYF

SEQ ID NO: 9548 - protein, 218 aa, Xylella fastidiosa
MRKISLIGLATMSMLAFNTSAFALGAASSNSGASGKHWSVVGGAALVQPKNGKNAAQNTVKFGGDVAPTLSVTYYINDNVGFELWGITKKLSYTAKTDASGKIGNVTQKTPLALSAQYHFGQAQNVFRPFVGLGYSQAKSRFTALGSTDRVSLGNFRGAIGTIGLDMNVDSNWFARLDARYTRFSNSNSKAALSSSLGLDQNRRLDPWSVGFGIGARF

SEQ ID NO: 9549 - protein, 725 aa, Xylella fastidiosa
MERKNHKKTTLATLISVLLMGSAGATYANSASISEKLDLATQHLDGAASTGEAISSDGKTIATSINNRTRAFLLSGDNWATKTELGSLKSDSSGTSIVRALSADGKIAAGISSVDSSSTQLHATIWSGDNWATKTTLGTLATNNGGDSVVYALSADGKVAAGQTAASIGTLHAVIWSGDNWATKTDLGTIRSDGTGDSMVKALSADGKIAVGSAASDIKTPVNGMYAGGVLTGPNSVRAIAWSGDNWATKTDLGTLRSDNLGAAVANAISADGKVIGGASHHYVTTEYYRANADQLATIWSGGNWATKTNLGSLRSDNSGASLVAALSADGSIAGGAALNDANATRAIIWSGSHWATKTDLGTLKSDNSGNSQVAALSPDGSVAVGTAATDAGSNHATVWKITYPAQSDTSTPSTPSQPSVVTVDADNTKKTLSQLGAETFSVMDLQRQGLTHLQQHCQIDAAGQSCWAVQTAISSIDGNRDKVAGIRLGHGFTETFSAGVSLDRSLSRSLPDSYLKNNGNLGAGLYAQWNTAFKGSQWYVRPAVAFNRYNVTVQRPVLENTEAGIGTSRMKGRGASLEAGQTFKSDHGVLLGWHLGGRYNNVSRAEYSEQNAAFPTTYGKASFKRTSAYLGADATIPLTRNLKWMAAAEIDRALKNRDAVYSAQADYIGSFNHRAGIKGTIATLSSGLQYTISEKILLGLTLDVNQTAFGDIARGGTFTVGGHF

SEQ ID NO: 9550 - protein, 597 aa, Xylella fastidiosa
MTSNFTRSLLAFAITLTTTQGIAKPAFQQTIFFGDSLSDSGYYRPLLPNEIQAITGKFTTNPGWVWSEYIASYYGSNASPNGNGQTGNNYAAGGAHINEPSISILGEAPSLTSQTNTYLSAHGGKADPSALYTLWGGANDLLDTLTTPEQIHTIIGNATTAEISLVSTLKNAGAYYIAVAAIPDLGLAPRARSTGTSAQSTAAATAYNTTLFTGLKSAGLQVVPIDTFHLLQELITSPATYGFSNTTDTACTLQLPLCNPTTLVDANAPNTYAFADDIHPTTAAHHMLGQYVISILEAPRLQQVLTRSAQGIARARAYQVAWHLDGTPQQDGLHWWGSMRSDSQRNDSNDLYKSVAPAGLFGFDWHSGQIVSGGFIGYGRMHADFSNGNGTFKQKDTTLGGFSGWYTGPVWVNAQISYTLLNYDIKREVQLGPATRIHRGSPNGSNLTVALNASYEMGEGRLRYGSVAGLTWQKTKLESYTEQNASSTALGYPDQQLNSLLGRVGLQMRLEGNVVTPYLQVTYDHEFKKQQNQANAWLQTMPEAGIYSVPGLTFNRNYAGIVLGARTKIGHLQSNVGLTTSTEKNARDVTLFVNGSF

SEQ ID NO: 9551 - protein, 683 aa, Xylella fastidiosa
MPSFRCFFSVSLFSLILCSVVFGVHATAVTTSTDHSLPLSLGKIQVEGTHDGATLVDSKLGSVDVLSDDLLQGQHVDYTWEVFMRAPGVQVTQFKMGTESGRISFRGFNGEGRINAIKLLIDGIPSNDNAGGMPYLDAISPLGMSAIEIVRGTNDPRYGLNAIAGHVDVITRSGGNDGLLSVTTGDFGTRKIQWVKGIERGAWSQNYVVSWLDSDGYRDHARAIKRAVSGKWGYADPRDAWRAGLSVRYFHNDAQEPGYLTYDAAVADPRSSPAYSGQDHSQRQTVQTALHLDGRMSEAFHWTAKAYINRYTNDRVVKFTAASARQERYTDETHRGVLTNAIWRPSVDWVHEFSLEGGVDAQWQSNVSRRYRMLDGQRGTVLRDWDFNLDTYGAYLQAVIRVNDSLKLVPAYRVDRIDGRFSDIASGLRYPVYRYGTIQQPKFSVSYDVSQDVTVYANWGRTFQIGSGNGAYRTQADDLVPSMNDGWETGLTFKPWSWANARLVYWQQRASGEVATLFGTNGAIAINEVGNVGKTLRNGWDAQLNLQPDEQWRVWLAYSRQKAEIAIPDPSVPATRGKQIENVPRWLTNVGAEWQVLPKLKLSAWGNGQGNYYVERTNTLGRYGRYFLSNLSATWLLSNKSELTLQLNNVTNRFYVYAWYDSGLSGYSPGDGRALYLTWNLTF

SEQ ID NO: 9552 - protein, 868 aa, Xylella fastidiosa
MYNHTIKLAFCISSVLYCSTSATAAPNTDAVTKLDTVTITGYRASLEKTQSIKHAANSIVDAISAEDIGKFPDSNAAESLSHLPGISVDRQFGEGEKISINGTDPALNRVLLNGQTIASGDWGGNPTDTSGRTFNYSLLSPEIIGLMEVYKTPEARIDEGSIGGTVIVHTRQPLDLPKNTIRGSIGYSYNDRSQKSNPRGSILWSWKNDSENFGALISATHDKQDIARAGIEFFGYTTGANIPPEATITGDGSTPTTAKVPAGINSAFFQQTRERNGLQGALQWKPNEQNEFNLTGIYIKGKYNNFSESRYICPVCNNDLNKASAANVQNGYITTATVSDGTAGQPYAQLDANYRISTVTTNSLNLHHQWSGDKWVLTTQTGTTKATGGKDPEYLMKFLLQEGGYRFNYDGTHTGVTYDNNNASNWALKSGEQAGGLEYTRTNDQENYFQFDATRDLHWGPFNKLQFGYKYIGHKNGQTSRGNALFANQDILLTAFNPGMTPTGLYNGLGASGDLINWPTADLRSVLSYLNALPEAAFETKYNQQFSVTETTNNLYTQLDFDSGKWRGNLGIRYVDTKDNILYWQSTTVNDTVNYQPVKDSKRYYKPLPSLNIAYDLTNNSVLRFSAARVIARPRYGDLAGSFSLNSTSGDLTASGGNPNLKPYQSSNYDLAAEWYFAPSSMLSAEAFYRDISSYIVTTTTTETLSDPSNNIFNKPYTVTRPMNATGAKVTGLSLNYQHAFAYGFGLATNYTYAQSNSNDGLNLPYLSKNTYNVIPYWEKGPWAVRLNYSYRSKYFTQIGRLDSQVFTDAYKELDLTTSYKFNDWVTLNISATNLLNSTYYWYNEVKYAPIGMYKNGRSYQAQLNFKF

SEQ ID NO: 9553 - protein, 809 aa, Beijerinckia indica
MKPNTSAKRHSLRYLLASTVACIAAAPALAQSDETPDDVIVVTAQQRAQSSQDVPISLQVLDSEFIDAVAADDMGDLEAFVPGLDVSNGSPTQPRYSIRGITTSDFGVGTDPAVGIYVDGIYAARSGASLLAFNDIERIEVLKGPQGTLFGRNSAAGAVSIITREPSDELEGRVAVRIGSHNRMRTEAMLNLPITDTLAIRANFLSNKADGWLTDAVTGEDYRREDSSADRFTVRWNATPSTEILLRHSRDTIDQDARPAIGIVEIPAFPGTPPLPVDTTAFLDPFNAPVRNDVVFNREARNLAETTLTVRQDIGDMTLTSLTSYREFDTMNREDEDGTNRIDTYFDTNNVEDNEAFYQEFRLAGTTGTVDWLVGASYYDETAIQASETFTFTDTVNTVLGNVGAGTPFTDLEYGLLVPFGLPFSMLGHSWQETMSNQGEFTARAVYADMIWSATDRLNVSVGLRYTEDEKSFQWINGGRQADSLDQTLAALDGAGILALAGASPADFLFDFVFDLAPLAGVACDNGVNVAEGVACVMEDSWNNLSPRVVVDYQLTDNVMIYGSFSEGYKAGGYNSVEVGSRFENETVTSWEFGFKSDFLNPDLVFNMSAFSYVYEDKQSIRLVVPTGGGVPQYLVQTSDDEAIGVDIELDWQASDALRLRGNAQWLDSTHKRRVDSNGADLAGEPTGEPYWNVAFGADYVIDLDGGSDLTLQANHAYRGESRCNSQSVLQGTCGGYTAFATGEARNRTDLRARWTAPNGDLTVSAFVNNVFDNQYVGGVNNITASTLGTAFASISAPRVWGLEIGYDF

SEQ ID NO: 9554 - protein, 326 aa, Beijerinckia indica
MASKAGLGQTPATTDARRTQKFYRGSPGRPWLIGAVVIPLLIAAIGYGAFERPQSVTGPTGVLPTLTPTSTRGASALSLSLLSISRSGNTVTLIGDFPDEAAKAALMTALNGLLAPGVNVIDQIHVDPVVRSLDFSSAEPVFTASVPIPDFGLKVERDTVTLTGTAPSSEHKDAVKRAATSTWPDMKIVNNIEVTGQAPPGPPASGPCADLQSAINAVTGGPIAFGNDGASLIPADYEILNRVADKLKACPDARVTINGYTDNTGSEGINIPLSAQRAKIVADYLVARGVAGDHIATVGLGSVNPIASNATPEGRAKNRRVEIVVN

SEQ ID NO: 9555 - protein, 370 aa, Beijerinckia indica
MKTLYKLAPLAMLGAFATHAGAQSSITLYGLISAGVGYATNQGGKNAWQALSGTNQNPRWGLKGKEDLGQGLSAIFQLENGFNVMTGTAAQNGREFGRMAYVGLADRTYGSLTFGRQYDAIHDYIGPVIIASNGVNIGDNDNGYNDIRVQNSVKYVSSVYYGLKFTALYGFSNATGFANNSAYSFGLGYERGPLRWSVVYAQYNHPYSSTNPDGAIANDYGSPLLIFAKSAMSPAVFASRQRIVGTGGFYTIGRAQFAALFTDVRYDYLDNSHLHLQNVGVNIVYTMTPQLFLGAAYAFTNGKYDVIDKRPKWHQVNLQADYFLSKRTDVALTVIAQQAAGDAQHAQIFAYARSTGTRQMMATLGVRHVF

SEQ ID NO: 9556 - protein, 275 aa, Beijerinckia indica
MLRTHSLRFSLIFFIYTEAFMRKILIGTAALATVTLAPSVQAEYQWGFGNVSLNYLDWTRSTTHKSGDSSHKDDFAYIELEGGAGFSWGEVYGFFDLENPFNSKTAQPGDNQRYTFKTTGRYYLGDSGFNLYGHVYGTYSLPGDNRNFHEVNTLYGIGYNAAFDALWLKPFVALHYVDQTYYSGNNGYVVGWVAGYDFTAFDEKFSITNWNELEFNRAEAYAAGNGGKNGINGAIALWWTPVKPLTTGIQYRYAYKKLGEDFLQDGIVYSIKYNF

SEQ ID NO: 9557 - protein, 788 aa, Beijerinckia indica
MKRCLLYILCCFGVVQLSAQPADNIRNSFVKAETFYKSGDIDEACRILEENLSSFQGTMHTEACRLAALCCLALDRFPEAEKYVSLLLKDEPYYYISLQDPERFADMVRKHRETKVTLVTASQQVETPEEAPVPVTLITEEMIRAIHARCLRDVLIAYVPGISGLSSNEEMNLAMRGVYSPEQENILIMQDGQRLNSYITNAVSPDYGISLAKVKQIEVLRGPASSLYGSVALTAVINIVTKDGVDVRNGSVSVSAGNRGQLAADLLLGKHDMNMDFMAWFSLYRATGESVFVPAEKQYALYPRDGFIRLDNYSGFPAMDGGIKLQRGNLLFSFSMNYAKKRQPYSMWLFSSPYSYERFRTFDGSGPGYSRWSAREQTVYSRTWQRITFNTAFYTDWNKNVHYETSGDTLQDYPIFPNYDYQPIIYPTRGTFQYIRWMDFNVGFNGRVNYAYDWGKLGKGNMLGGVEWNRYTLYDSEYLEGMNFKEIVRTWIEKRLYTGHEMNTDAFLQIKHNLHQNWIVNAGIRYDYKRRSNKRTLQAFSPRLSLIYLRNGLNIKASYSRAFVDAPYYYRNNETDTYSGGENLQAEYLSSYQVTCAYHHSPSHIDVECNLFYNRASHFLFTQPETRVYENAGSLDMGGVEVVARYKADRLSLDGNLCFQKVLNYTNFFVTDGSVNNVPGFSMNLVANYFLLKKKVQSWSAHLKLNCSSHCYTQVSVLEDGLNGDATNYTVRLPGYAVFSFTTRYKYKRVEGSLGIENLFNNRYECGGATVPIRQKGRWISASILYNF

SEQ ID NO: 9558 - protein, 843 aa, Beijerinckia indica
MLLKRISFLFFIFITTPIFAEVSFRARVFSRSKSLGDANVSVRISETKKFYQTDSEGYFQAVVPSSGTYTFRILRDVGFQEIRQEIGEGEALVILYTDESTKSSESIPKGTINVTGEKEKQLMSRTKLRFEEIKRMPGTFGEPLRSIETIPGVVPVAAFGGGANNYSFRGADPNTNLYLYDDLPILYPFHFDGLTATINGNLIKSMDVYTGVLPANFNNALGGVIEIESPDKVERSSGNFLTSLWAASANYQTTFANGKGYILGAVKVGYIDKTFETLGTLAGGSLLPEGVRLPRYTDSQVKMVYNFNDEHQISFYSLTAKDDFALDPPAKRQNDPTKDELAGFAGGNLSAGQGYRTQAFRYTWRPSEKFNNRITLISYDPFVDFNVSFGSIKAKQRGSGAYNGVRQDASWEPNKHFTLEFGSELRFLNYKTTGSTIQQTDPNNPDPNPYDTTSPDFKTVPDTNRVQSKYYNAYTTMKIKFGGLLIEPGARYDYIPYIKNGALGPKAQISYKFEQGILKGTTVFGGAGNHFNFPLDTRFSEQSGNPHLKFQKAFKYGGGIDHQVTSEWQIKGEVFKQEFSNLIVTDPYITEAIGTNPDQYGRITQPYILNKPLSYSNNGTGHSRGYELVIRKTAAPGKRDWFGWISYTWSQTFRNPNIYKPDAIMTQVATGSEQRLVAQTFPNSKETLYDYDRTHIINLIFGWRFSQDWQFGARWSYMTSTPITPIVGDDGGKFSNPANNQTIWIPVSGNNPYLAEYTNSKRLKDYHRFDIRIDKFLNYEWGYVNTFLEIINVYMRENVSGENFDVTRPYSATNPKPNPTFGTLTLPGGAIIPFFNMGIEVKF

SEQ ID NO: 9559 - protein, 374 aa, Beijerinckia indica
MMGLDLDTDRLVGLKGGTIRFYVTNRHGQNLANTAIGNNTSVQEIWGTQNTHLAEFTWNQKLFNNRLELVAGRMSGNAGAFFSSSIYCNFQSNSACGNPTMIFKDSNFTYWPASAWGGYFKAWITPKIYFEGGAFEVNPYRKRANDDGFTFSIKHATGAMAPFELAYTTNFSNDKLPRTYRIGGWYDGGDYTDPVLDANRKYAVMTGDPYATLNGRGGIFFRFDQMIWRPNMNSERGLTVFGVAMKNVAGRVAEDHFLEIGFVQTGTFKGRDKDVLGFMINDQRMSKWTIDNILVARTSAGGSRHVPRDEIMMELTYGAQISRAFRVSPNLQYIINPDQIAEPFRTKNIKNTFIVGLKFTLDVLSHFNIARNPN

SEQ ID NO: 9560 - protein, 1028 aa, Beijerinckia indica
MAFGSSKQNNISALAIAVASALTVSASAVQAQEEAAVEEKDVEKVVVTGSRVAQDSSLEAASPVLAINAGDIKTSGQIDLGAMLRESPQLQASLPGSFSAFNGTPLGASLLDLRNLGSERTLVMENGRRHVSGIEGTGSVDVNTISTALLRNVEVLTGGASAVYGADAVTGVVNFNMRNGASFDGLELRTQTGVTDDGDANEFFLSLANGFSTDKGDLVFAVEYQETSPVYARDRDFAGSGLYTQVANTEATQSAFGIDSRFKNTWVPDYRLPISSDRGVISLTGSAFGDVAGSGGVLGCGTIGTSMFPTCQVVGEDGTLRAYNPGDVYAGPFDASGGDGVPGSPDAELILPESKRVLVQAVSNYELNEFVNFFVDAKFVFSSTKETNQVNGFNDDIPISLDNPYIPAALLSQINELQAEGESPSLVMSRDVLDINANSNPEAERKTYRIVTGFDGYIPNTALEYEVFYNYGRTDADITSNLRIEDRYFAAIDAVTDPATGNVVCRSDLDSSALPPTSPFPSANANFGFLTFQPGDGSCVPVNLFGKDSISAEAANFIFQPGTEQNDITQENFLAVVSGDSSDLFELPAGPVMFALGYEWRKESSTYTPDPYSAAGLTFGTLDSRNGPTNPSDGEYDVSEYFVEATIPLLEGVDFAERLELRTAYRSSDYDPYGTHDAWTIGTVWSPVDTFSIRTTFSEAVRVPNINEAFAPTFAASLGAGDDPCNQNLISAGSEFREANCIALIGDAVADGTYDSTNFLSAFVSGSTGGNPDLDPEEAETITIGTVWRPDTELDGMLEGLVVTLDYYNIEIDGLIDSLTGFDIASNCVDAPTINNQFCDAIDRDATNGFITDFRSGFINLAAVETSGIDFRVDYGFELAKLVDTDGRIEFTINGTNFLKNDEVRDVSAPDEVTDVLGTFGRPEWIVNMSADYIIGELVVGWRGRYEGSQLLPGLENQDIESDPDFISQTHTGSALVHDFSVSYTFEDSLEVYGGINNAFEEDPYLGTLSRPAGPRGRFFYLGVNYTM

SEQ ID NO: 9561 - protein, 465 aa, Beijerinckia indica
MTLKNILLAGTALGAAVFMTAPAFAASNTQAELDALKAQIEALQRKVDDVQIQHGNAIKSLEERKSDVEVSLKDGRPVFKSADGNFTFGITGRAHLDVGGYDMSDSDEANMIAATGNPDGLRGNANFRRLRLGFNGTFAKDFGYNIEFNFGDSGTESDARIYEALLTYKGIEGVNLVLGATKPKMTLDDSTSSNDITFIERATAVNLAITPAAGEARMTAGGTFNTDNFFGATYYTAGSAASGGGLDDYDSSNVVGRLAYATSPKEGLNVHIGASASHSFNLPGDSVRFRDRPELRVDADRYIDANFAGAADTATVYGPELAFNYGPFRAQGEYYRYEVDGIAGGSADMDAWYLQASWILTGESYKYDIKKAAYSGVKPDNPFGFGGGGAGAWEVAARYSHANLNDTSIGLNGGEQDIITVGLNWYANNNLRFMLNYLDVDVEDRGAAQLDFGHQALALRTQFAF

SEQ ID NO: 9562 - protein, 488 aa, Beijerinckia indica
MRRGGHGMERGSAQPGRMAWAAGTLLGALAFGLPVSVSAQQPSPVGQFNDQTQPRTDPRIAEKPSDPVRVGPLAPWATHMAERGLTFDINIYNFYQANPSAGLRTGEQSNSTYFVLSMTADMQRIANISGGTIKFTQTFFGNVRNLNMAADIGDTTVGYQPPFNPNNNRLSLLTYQQKLLDDRLVIEVGRTHPDRYYGLPPCNSINSCFQDLFYINAGFTSPLYAVWGANAAYQLSPTSYVQAGAFSVNPGTNALSGYDFGYERLSGALVMAEIGTKTDYTMTAYPGRASLTGFFNTADHDDNFKTVFGTSKGLNPGAPVLQKSGTSGIVLTGTQTVWRADGGLVANPHPTAISLYTGTGYSFDPTVPIRFNSFVGVRLDAPDQSRPNDSYGLKMNWQRLSENYTQFLSDANFISGGSGAPYSRDKFVFEANAHFDVGAGVIIEPVVQYVVNPNSFWNPFTARRAKDGFYAGATLVVPLGTLLGLAPG

SEQ ID NO: 9563 - protein, 271 aa, Beijerinckia indica
MLISGRDSEFERKSKKGDETMRKFSTAAIGFVALSMAAPAMAADMAVKAPPPAPVVAVYNWSGFYIGANGGWGQSHGCVDFVTPAGTVAGGCADRSGGLAGGQIGYRWQTNQFVLGLEAQGDWAEIKNTRVSLIDPLISTTGKTDAIGLFTAQLGWAWNASLFYVKGGAAVTRNRFDIFNNVTGVGLASAGHTRWGGALGVGWEYGFAPNWSAGIEYDHLWMGRDNFGFAGVVTPGGLTLTGSGISQDVDMVTLRLNYRFGGFGAPVAARY

SEQ ID NO: 9564 - protein, 693 aa, Beijerinckia indica
MTSKALLFALCAGVSQFAFADLAVAQDKTDEVEGVVVTGSRAASASINGVVIDPMRLPQSVRVLDEALIVDTGVTNLSDLFDFAGGMARQNSFGGAWDAYAIRGFSGDINQGPDLLVNRFTANRGFNARRDVATVERFQVLKGPASALSGKGEPGGSINIVTKAPTETAQGSGELSYGSFDAKRIMGDLSGPLGGGVSARMIAVYQDTDGWRDHVGSDRLLLAPSLAWTPSDDLRLLYQLEANTVHFVHDRGLVAVAGNGKALPRERFLGEPNDGDITQKTLQHQLTTTYNFSPSVAVEAGVQYRDGSFRGQSTHNGALIGTQLRRQLRIHDYTWDDLSGRIEVSFDGKLGGLEHQLRAGADAFTYEQHRIFYRFNPTAATPYAIDILNPVYGQAKPVAPLNQNVLEELRGESLYLQDLVTLNSQFTLLVGVRQDWIRQTNTNYRNNTVTRQSPSQASPRAALTWAPNEAFSAYVSWGRSFRYNQGSDAVGGAFPPEKGEAWEAGVKWDLAGRLTGTASLFRIDKENILVNDPANSGFFIPVGAARSQGFEAETNLRLPKGITATAVYAYTDTEITRDTRTNMIGSSLSNVPKHSGAVYANWRSDGDAPGSVTLGGGVVYVGERAGDDVNTGFKLPDYVTVRANLAYNVSKAVSLHLDVENLFDTYYLESSYSNVWITPGAPRTITGRLRVSF

SEQ ID NO: 9565 - protein, 376 aa, Beijerinckia indica
MAKQCKFNFKPLAGVISAVMCAALPLAAQADFEYELSADAMLDAVSYSGSEFSENGQELYLRRANLGIELEYNKLLNAEISGEYSELDEEYSFKDVYVGITPLKLLEFRVGRFKEPAGLERNQGLKNQVFLERSLATNVFSFGRKTGIGVIVDGDGWNVEGALMNQQGKDEGYDDSRVLALHASYNPYRNDAKTDFLHIGTSYSKRDATERRYDIDEPTVAPIYGNTIHSQRYRDADITSYGFEGAVGYKKLLLQAEYFDQTFNEADGDEYIHTGYYLTGSYTLLGGARQYRKGEVKSNKDAPQILEIAARISQADTVNDGEGDSADVASLIVNYYPTKNYRLALEYAASDIQSYDNNVPLTLDGQAITARIQLSF

SEQ ID NO: 9566 - protein, 354 aa, Beijerinckia indica
MSGTDIGGTGRYSVGNDYKQYGFSYTNNVNDSLSYALIVEQPYGTHVTYEGNPLTDNLAGTSAELSSRAASVVLRYRFGERFSIHGGVSYEAVKADVTLNGAAYRDAITSAALIRATPGLTRSNFANQLATNPAIAGAIAAQSTAFVLNNGYAFNMQEDSAFNYLIGATYEIPDIALRFAATYRFETDHSASTVETVFGRFLAGTVNYKTPQSLNLDFQTGIAENTLLTASYRWTDFSAVNVVPMLLQSDLVNIDDSHRYTLGLAHRFNDSLAASVTFIYEPENNDPTVSPLGPTDGLFGITVGGQYTFDNLKLSGGINYSRLGDANPGVAGTPVASFTDNSAIGIGVKAAFSF

SEQ ID NO: 9567 - protein, 628 aa, Beijerinckia indica
MLSPIARAVLLAFAGLPHLAHAQAAAPANADASSTAASTASSTVLSPVVVTAERGPQALADTIPQTSLFDQQDLADTTATDLPGLLQLAPGAQISRTGGPGSTASLYLRGASSTQSLILIDGVRVDSVSLGTAQIAQVPLDQIDHVEVVNGNVSALYGSGAIGGVVQVFTKDGGAHPPRFNFSVGYGSYHTQTQQVGANGALDKDGRTTFSISLARSKDDGFSALNSSEAPNANPNANGYLNESISASLRHKFNDQWDAGVRYLQSNGNNSYDNAYGAPTDLNNLYTKVRQVSAFANGKLTDWWTTHFIVSEGDDRSVSKTNGLYNGRFDTDNRQYTWQNDFALAAQQKLRVGYEHLDQSLDSDTFAAPTRHVDSVFAGYTARFGRNQIQANVRRDQYSDFGGANSYYLGYGFDITPHWKLSASYSDSFRAPSFDDLYYPLSGNPSIQPERSHSLEAALQYASNALGVMRLSAFQTRYSNLIDYQQVTPGIYLAENVGHAKVQGLEGSWSGHVGKTDVRASATLQNPVDLDNDVDLVRRARRFASLTVNRSIAGWRVGGEWIVSGPREDSSGKLGGYGIVNLSARYNITKAWYVAAQIQNLLNKDYETAYSYNSPGRGAYVTLGWQQQ

SEQ ID NO: 9568 - protein, 1134 aa, Beijerinckia indica
MSLMKLLRLSLPICSVFAISALQAQNAASDDEEIFELSPFEVIGDDDIGYRATSTLAGTRLRTEMRDIGSSISVVNKEFLRDTGSSNLEDVLIFTPNTEIGGLGGNHSGSQGANPIPEQQRDDPSGGLTRVRGLASADLTRDYFLTNIPFDTFNTDRVEVQRGANSALYGLGSPGGIINASTIRADFNGDRGRVRFETDEYGTLRYSLRYNKMITDNVAIRIAALTEDKGYEQKQAFLEDDRVFAAVTAKLPFNLTARGSAEVTERHSSNPDYVLPNDGITPWINLGKPISSSPAEGAAIFRGTGDFFPGVANSSVFHLVGGGGASVGLYRFYQDPSNPDATFGGHAYLVNTIDKDLPPENQRPSNFPIDNSNWGQWMQIKAWDETNIIRRAGFYSDGTPVAAGTAAFFSNGFVSKQITDRSIFDYRENLFSGGTAQQTGEWENYTASLEGNWFDNRLGLEFSHNEQTFESAGNNSLQGVQQRTIYIDMNEYMLATTDGTAQGTLVPNPTFGRPIMGGGSGGNRIYNDRDSTRLQGYAEIRFNDFMDEDSWMTKLLGTFTLTGLLDSSTHYNQSLYSARADPIDTYDIDTYLPGHHAVTQRSGQIFALPVTNDTNFLNINSINDLAGVGIQGVSYGRERSNMSIVPISASFTGWNPTDGEFVNFDSVINTLYQPNSWPAASHASKSINTVDSEVFIGQHSLWDNTVVLTGTWRNDKATTAAGPGRSVANARRDIRDTLDPEYLAGPQGPYEVTADDDTTSYSIMVHTPPFLRDRLPFELSVYKSEADNFRPTGSNVTIYNDTVSATAGTTEEMGFIIDGLDRKFSARFNWFESAVVNNRFEEGALYASEGILLGLARELNNPANAGFTVADVQAVLPPAGVIGSSGFQVDWNNPDAATTNRNSSDTGTQDFKAEGMEVEIGYNPTRKWSLFFTAGQQETIADNTYPEMRRYVEEFVLDNWVNSTFAQNFYIDENATQTLAERAQTSIVEAVQRAALQDGSPAKEQAEWRFAFNTSYQFGSDSGVIPDWLGELTVGGGLRWQDKTGIGFEVGINELGDYALDINKPFYAPSKTYADVFLRTSYDLKDDRSLDLQLNIKDLTNHDGLIPFVANPDGSLLYRIEEGRLISASATLNF

SEQ ID NO: 9569 - protein, 500 aa, Beijerinckia indica
MRLATTGALLRPEQPVGLSRAAPIMTLMVLGLGLAACTTPARKAEVQLPSAYEAPAGPALAPQALDQWWTQFNDPALNALVTTALAQSPDARLAAARLEEARAIRQGQIRQIFIPQTPLVGSAQRTDTDINEQSGVGAFTQGGVSKTYSANFDVSWELDLIGRRLAALRVVKNDMAAARFAYEGARAALAANVAQSYFEARGLAVQLDDARESVRIARSLADVAAERGRRGLIATSEGERAAADLAQAEAQAAALEAELRAARRTLLILVGKGVDPLETLPVTASLAKPPPVPAATPGQLLARRPDVREAAARLASASGNLNISELALFPTLTLTPGGGISKAITPSFLDAGAQTSTTSSAWTIGANLSIPVLNIPKLMTDIKASNARVEQAAITYEKTVQTAFGEADNALVQLAADERRVALLTAGERRAAVAYEASRKSFAAGLTDLTTALQAEQAWRAVRSASTAAQTQALQRAVQTYKALGGGWSPEAVPTKASAQ

SEQ ID NO: 9570 - protein, 976 aa, Beijerinckia indica
MRPFFRPIIGDSLNMQPSSLKQALLFTAAGLSLLATPAFAASDADTPIATADSSTVSEVVVAGQRRSQARALQEQRDSLTVANVVSAEELQAQPTANLADLLSRLPGLSSAVDQSRNQAGTGEAQYVTIRGLDSAWNAYSMNGVRLAQTDSKARTISMNLLSPFALSFVRVDKAPTAEMDGDALAGTVDFRTATGFDFASNYNRFRLQGQLADRAIQRDVDGLGYTTQLEMARTFGDAEQFAVYGNLYYQDKDNAGESRAVQQDYVKKDSTAPGLIRDQGANLYARGPQWNFYRNSVKRQGATLSLDYKTDAQSLYGRFTHGEFKLLTSMDQSSARLGLATAPSGSKELVDFLTSVRPSSAWQTAGDSDPKNISLYGAIPGQYSRTEHSTQTLTTALIGGETKRNAFTLDYAVSYSKGRTEYPFRMQAGFYAFPFIGTPDQGGKAVVPLITDISNPKDPRAVLTPEGLRYISRTDITRQWYVTYGYEYAEESKTDLKANLAWDIEHPIVKSIKGGVKYETADRESNDVGTGDENRFYFYKKDASGNWTANSALLGNGSHRWANQGEFLFDLPGKTLTSFMMGGLQVPMRLVDPDYLKNQAYKYAATIPWTNEVLKRNLLSGEETRASAYVQSTLTFGDTLTVVPGVRYEDNNFKGSYWRPESVKGADGKTTSARVQASSDRGMGIVLPSVIATWRPTDEIVVRGAVRRAYTRPAFDQMIGATSISKDADGKIIAISIANPDLQPVTGINYDFSVEKYGEDGQYLMASIYYKDLKNVMFVSGSTNTGSDFNVWTGDVIKDAGGAEISRLDNAKNGSVLGIELGLRQRFTTLPGFWNGFGVSGNVTFQKTEADIRVGNLGKNLSRRLINAPDSIVNASLFYNKHGVRAELAYSRVGMIYKDVRTDNDDTWVQPMRRLNFNANYQLPHGWQIGMAVENILNDQSYWATQGKAETLLSHDRKGGYVETGRTYMINTSWTF

SEQ ID NO: 9571 - protein, 274 aa, Beijerinckia indica
MTTKYLITTSIFSLISISIAQAADVIVPEQPVPVVAVPAFSWAGFYLGGQVGNFSSKTALSYLGDEKTGKWTPVKKEFVPKLSGFVGGIYAGSNFDINNGFIIGIDTDVMWSGKKNTKIITWPEVPPEVSSEKKVERVSVGTNQDTSAEVTNGALSHTLKQKWFGATRVKVGFVVDRMMPYIAGGVAYTQLQNIFEKEADKTKKAIDISNVIHDEKKTMVGYTLGGGIDFAMTDNVIVRAEYRYSDYGKKKFADEKIEMRYKTNDFRVGVAYKF

SEQ ID NO: 9572 - protein, 244 aa, Beijerinckia indica
MLRIVQKLGIILFVSSISINSFAKIMYDDVDSAPDYDSTPYYENEGNLVFKMRLGGVFSSAKQKVLPTPTSPQPVPVGEVAKNGYGGDASTTIFFNNYLATELSLGFNVLRTKYTSLASVAHNYSVDNVKLGKHKPIYMIPATVTGQFHIAPYGGIRPYIGIGYHGSYMLTQATGLKIRNGYGAVGQIGVDFYAKDETLINIDVRQFFLNPKLEYKPNLVGTKTITSKVKLNPLIVSIGIGFTF

SEQ ID NO: 9573 - protein, 837 aa, Beijerinckia indica
MNRKSGLLGLSLASVLMAQGSWATEPRGKEKKQVADIHGLERPATTLKEWFAQIDAATVQITGVKLDRSETGLEILLQTADKPLQVEVTRFRAEGNRLIAEFPNAVLALPQGQPFLIENPAADISWVEILQQGPSTVQIIVVGQTTLPQTTVTLKTGGVAYRLNPEDDAAEVNIVVTGAREQGYWVPDATTGSKTDTPILDLPFSVQVVPEELLEDRQVESLNEALRTVAGVTPDNPSYSAFEGFTIRGFTGRNILRNGLRDDTNITSRIAVPNIEQIEVLKGPAGALYSQGSPGGTVNIITKQPLSVTRYNLEGTIGNFDTYAASADFTGALNDSKSLLYRFVAGGYSTGTFIDRFYRRNYVIAPKLTWLAGPKTKINFEGEYTIDQQPNARGLPALGTVLPNINGELPRSRFLGETDDALDSNERYALRLGYTLEHNISPNWQLRNAFRATLLKSPQNSLFPSALLEDQRTLERGLFATEDQSQDNYIVDTNVVGTFKTGPVNHKLLLGFDLNRDVYAASSKQYILDPIDIFNPIYGQSGKQFVAFYPREPFTTDSLGIYVQDQIDLLPNLKLLLGGRFDIVTQKYDYADGSKDYQKDEAFSPRAGLVYQPKDWLSLYGSYSRSFLPNFGTAFDRTLFEPQFGTQYEAGVKAEWLQKRLFTTLAFYQITRSNVLTEDPDNPNFSVQTGEQRSRGIELDIAGEILPGWKIAAGYAYTNAKITEDNTYKVGNQINNVPENAFSLWTTYEIQNGSVKGLGFGLGIFYVGSREGDLDNSFQLPSYTRTDAALFYRRENMRIALNIENLFDVRYFEAAEGPLRVFYGAPFTIKGTVSWTF

SEQ ID NO: 9574 - protein, 660 aa, Beijerinckia indica
MYRNSFSLSPLSLAILAATLSPVVSADEHNPEVTVMETMIVEATKQNISLQQVDSSVLIKTGKELEKAGIHEVKDLEKAFPGLMIQTRGNRTYANTTIRGVSSPDYYSPTVSIYVDGVLQDSAFLTQQLLNVEQVELLRGPQATLYGGNSQGGIINIITKKATDQNLASGGVTYSDRSKQLDASAAVAISDSTYADIAIRSLKDEGNIRHIPSNTDDANDSKDFSGTARFHYLPQQSPLAVTFSVSSAHLDSHEEWYLTQQEYDKRATSQDIPELKRVVNSYALHIDYDLGATQLTSITAYQNRNVDREYIGGKWVEDQNTFSQEVRANTQFSDDLSALVGGYYEHRNFDVSAGANNDIETQTYALFGQMTYAMTDSIDLTGGLRASRFFSESDFGGNSAWRIDSYQSDKSENVISPKAAIGWQINPDSRVFASLASGYRPGGFSPAPRSSGDKNGYSPEKSFNGELGWRTNLAENTVRFSGALYWIDTKDIQLYTGNPGSQVLRNMGDAQSRGIELDLAYYPTDDLTLTLGATFGQSTFESGNDGIEGKTLPYAPDTTVVAGIEYYLPQSWLDGELSIATNARYTSKIFFDESNTLAQDGYTLIDLAVQYAMNDNISFRVFSNNLTDKEYTTYAYSFGNTRFNNYGSEREVGVNMKLEW

SEQ ID NO: 9575 - protein, 678 aa, Beijerinckia indica
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 9576 - protein, 748 aa, Beijerinckia indica
MFAPITRSMTLTLGLCSVALSPDLLAETDTEKQLPPATPALELASTNITAQGLGSTTENTHAYTTSAMSTATRLNLSFKETPQSVSVVTRQQMDDFKLGTLTEAMSQTTGVVVQHYDSDRVNYSSRGYSINNFQVDGMLNTFSRMKSDSDTIIYDRIEVVRGATGLTTGAGDPSATINMVRKRPTAQLQALAGVSGGSYDDYYSYVDVGGPLAFDGRLRGRSVLAYRDSQSIRDHYALQREVGYGILEADLTESTVLAVGYDYQDKQVQGSSWGTVPYWNADGGKARLGRSTNMATSWSSWPIKDKTAFATLDQALAGGWHLKAAYTHRQSDTDGKVYYGGTGFPADDRSGMAAYMSHMIGTQKMKTYDFNVSGPYALFGREHEMMFGYGEAERSERSPYTIDGPVPPGYGRIRDWKYMGDIARFPDTVTGLTGSTSSTRQKAGYLATRLSFTDDLHAVLGSRYGSWKASKADNTFDDKLQVSAVDASRQQHNDMWTPYAGLLYDLTPEYTVYASYTDIFNPQDYRDANRKFLEPVVGSNYEIGLKGSLLDERLNLATAVFWSKQDNVAEVDDSVLPDPVTGEEFYKSGGKGNKVNGFEAEVSGEILDGWNMTAGYTYTHSANGEKQRSNTNQPLNMLRLSTAYRLPGNWNALTVGGAVSWQSDVYGNSNRPVGRGANGRVITERTRISQGAYSVVKLMSRYEFDKHLSASLNVDNLFDKKYYDNVGFYNGVFWGDPRTVTLGLDWKL

SEQ ID NO: 9577 - protein, 723 aa, Beijerinckia indica
MDAVNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKET

SEQ ID NO: 9578 - protein, 762 aa, Beijerinckia indica
MTIQCSKNLIAIAIASALSLPVSAADKQESESTMEEVTVVAKKLSHANHVIESSMIKQQSPASSILAIMDNLPGISINEGDAFGGDDWSTSITMRGFTIDGNQQQLGMTIDGIPNGGSNYGGGAKANRYLDSENMRTIEVSQGTSDISSASLEALGGTFNFVSADPAFEETTTLAYTDGDHDASRYFIRHDTGRIFDNTYAYASYSSTSTSRWVGEGSNGGMQREHAEVKFITELGNLSITGRLSYDDADEDNYNSVSLEQFNQTPDWDQLTWNWTGTPHLDQMFAEGWSTLRENTLGYVKFDYQLSDNFSFQITPYFHKNKGRGDWIPPYLVSAVDDEGNPVNQGGSIGSTYGFTDQNGTPLAPAAGCEQSFTWPWDSGPGLHPACYSDSAVPVMSYRHTHYEKDRVGLTANAQWSIAMNDIKFGLWAESNERNESRDWHKVIDARVYHHFDATPYWTQYSNEFQTDTLKFYLQDTLDFGDLSLNIGAQKYLVDIEKTDGFTNQQTGKVNSDSDVLFSTGAIYQINSNIELFAGYSENFSAIKDGVLEREASTLENIEPETAENIDLGLRYNTEDISFSATYYTIDFENRITFIAPGSDSDGIDYTIGTNGSYLNVGGIESDGFELSVNYRLNDQWSLYSSYTNNDSRYVGDAPGFTAGDKVIDSVDDMFVLSSDYTKGDFRLGASGKYTGERGDAPSYTTFDFNAGYFVPFDGQAISSIDIAFVVTNITDESYLSTGTGNGTTFFIGAPRTASMTFTASF

SEQ ID NO: 9579 - protein, 724 aa, Beijerinckia indica
MSGFKGVGSPRRVRGWLMLGLLAPFSLSALAETVASEVAADSSLDLPALTIEGNRLYDMLPSEETGGYSVDAATVGTKTPASLKEIPQSVTVYTQDYVKDRQFVHLDDLAKYTAGLRTLTNDSGRSSIYARGYEYSEFNIDGLPAPMASIFGTVPSLAAFDRVEIMRGPAGLFSSTSELGGIVNMVRKRPTAEFQGHVEASYGTWDTNHEEIDLSGPLDDAGRVRGRFVAARDDTNGEVDYNANTSNSYYGALDIDLDDDTQLSFGLIHEVKNITPHNGYPATLSGEVPDFSHSKFLGADWNYFDGKTTDLVAELTHRFDNGGYGRIAARGSHRDTNYLYAFTATNATTGANSERASARDFTQDTYSLDASYSQPFETFGQVSEFVVGTDYKNYDTEYLNGTTNLGAINVSSYSPTQFAKPSPNYSTETGMQEEEYGLYSKVTFRPVERLALIAGGRFSWYRGDFYTTTLSTASTVDDNKRVDGRFTPYGGVVYDLTDSHALYASYSQVFKPQSDTDSNGRVLKPREGEQYEFGLKSSYFGGDLNTRVSVFRLTDENRASTEYDEDGVDTGFSVASGKTRVKGAEVEVSGKLTPNWELLAGYTWMETETLDGDAETTFFIMPRNQASLWSKYTISRGPLTGLAIGGGVSAMSNFYSESGGVRIDAPGYATVDAMLSYPVTSKLTATFNVNNLFDRDYLSRVGSTSTFNFYGPSRSMMVGARYDF

SEQ ID NO: 9580 - protein, 1371 aa, Beijerinckia indica
MNKVYSLKYCPVTGGLIVVSELASRVIKKTCRRLTHILLAGIPAVYLYYPQISQAGIVRSDIAYQIYRDFAENKGLFVPGATDIPVYDKDGKLVGRLDKAPMADFSSVSSNGVATLVSPQYIVSVKHNGGYQSVSFGNGKNTYSLVDRNNHSSVDFHAPRLNKLVTEVIPSAITSEGTKANAYKDTERYTAFYRVGSGTQYTKDKDGNLVKVAGGYAFKTGGTTGVPLISDATIVSNPGQTYNPVNGPLPDYGAPGDSGSPLFAYDEQQKKWVIVAVLRAYAGINGATNWWNVIPTDYLNQVMQDDFDAPVDFVSGLPPLNWTYDKTSGTGTLSQGSKNWTMHGQKDNDLNAGKNLVFSGQNGAIVLKDSVTQGAGYLEFKDSYTVSAESGKTWTGAGIITDKGTNVTWKVNGVAGDNLHKLGEGTLTINGTGVNPGGLKTGDGTVVLNQQADTAGNVQAFSSVNLASGRPTVVLGDARQVNPDNISWGYRGGKLDLNGNAVTFTRLQAADYGAVITNNAQQKSRLLLDLKAQDTNVSVPIGSISPFGGTGTPGNLYSMILNGQTRFYILKSASYGNTLWGNSLNDPAQWEFVGTDKNKAVQTVKDRILAGRAKQPVIFHGQLTGNMDVTIPQLPGGRKVILDGSVNLPEGTLSEDSGTLIFQGHPVIHASVSGSAPVSLNQKDWENRQFIMKTLSLKDADFHLSRNASLNSDIKSDNSHITLGSDRVFVDKNDGTGNYVILEEGTSVPDTVNDRSQYEGNITLDHNSTLDIGSRFTGGIEAYDSAVSITSPDVLLTAPGAFAGSSLTVHDGGHLTALNGLFSDGHIQAGKNSKITLSGTPVKDTANQYAPAVYLTDGYDLTGDNATLEITRGAHASGDIHASAASTVTIGSDTPAELASAETTASAFAGSLLEGYNAAFNGAITGGRADVSMHNALWTLGGDSAIHTLTVRNSRISSEGDRTFRTLTVNKLDATGSDFVLRTDLKNADKINVTEKATGSDNSLNVSFMKDPAQGQSLNIPLVTAPAGTSAEMFKAGTRMIGFSRVTPTLHVDTSGGNTKWILDGFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 9581 - protein, 789 aa, Beijerinckia indica
MSLYSPVFPSPVSAIAQVAARRRTALQRTPLARACAGLLLASLAATASAQQAPATQGEASPTALDTVTVTAEHREQNLQDVPVSVGVVQGAAMRDYTAGGDDTLLALSGRVPGFYAETTTGRIFPRFYIRGLGNIDFYLGASQPVSIIQDDVVLEHVVLKSNPVYDVDQVEVLRGPQGTLFGRNTTAGIVKFDTVKPSDTYTGRVNASYGSYNTISLDGGFGGPINDVLSFRVSALYQHRDDWVDNTFAGSSADGTRTPRKDAMGGYNDRNARLQVLLKPNDAFSLLGSVHTRDYDGTSTLFLRNAITRGSDKVDVPRDRVAYDEGHDNPQAYQTDGGSLKAIYDFGGVSLTSITAYETTSGYSRGDTDGGAAANYPVNGVPNGFGQSMGQIRDLDQYTQELRLASEGDEALQWQVGAFYFDGRDTTDFYQRAYFLQTAARNPNNWVRLRNTNTSWAGFGQLSYKATDALTLTAGIRQTKDTKETRLLKTADTAAGVVTYRGRRDVRMSDTQPSWDLSAMYEIDPQLSVYARVARGFRGPTIQGRSAVFNSDFTTADSETILSWEAGIKSSLFENRLRLNVSGFTYTVDDIQLNGNDSDGNGVLFNADKAKAYGMEADLDWRPISNLSITAGLSLLHSEIHDKRVFAQACALNGVVVCTVNDPTIRVGANTFAQIDGNPLPNAPKYNLNLAARYDIPVGNDGAFFVSTDWNKQGQTSFVLYDSTEFRSDGNFEGGLKLGYTGGYGAWEVAAFARNITNEKNLKGVIENYMAAVYNEPRVVGVSVNVNWQ

SEQ ID NO: 9582 - protein, 307 aa, Beijerinckia indica
MIYIALILGLQATDYDNLEEENQQLDEKINHLKQQLTEKGVSPKEINKDKFEEEYINRSYPKISFKKKEKLLKSFSIADDKSGVFLGGGYAYGELNLSYQGEMLDKYGANAPSAFKNNIKINAPVSMISVKFGYQKYFVPYFGTRFYGDLLLGGGVLKENVIKQHVGSFIYVLGAMNTDLLFDMPLDFKTKKHFLGVYAGFGIGLMLYQDKPNQNGRNLVVGGYSSPNFLWKSLIEVDYTFNVGVSLTLYRKHRLEIGTKLPISYLRMGVEEGALYQNKEDDERLLISANNQFKRSSFLLVNYAFIF

SEQ ID NO: 9583 - protein, 574 aa, Nostoc punctiforme
MSNLLWKSLVVSPAVLGATLLVSSAAIAATNATTELSVTETVVPTELAQQPEIVAQAAPTTEDTKVIDQVNRYSSEGKGNAQSQVTSVSQFSDVQPTDWAFQALQSLVERYGCIAGYPNGTYRGNRALTRYEFAAGLNACLDRVNELIATATADLVTKQDLATLQRLQEEFSAELATLRGRVDALEARTAELEANQFSTTTKLVGEAIFAVTDAFGENTGDANNTVFQNRVRLGLQTSFTGRDVLTTRLAAGNATGFDFRDNNNNFIDAGGQGLQTFQVGSTGNNSVEIDRLTYEAPVGPAQVYLAASGGRHSHYAAVNNPYFFDKTDGGNGALSTFSSENPIYRIGGGAGIAFNVPFGQGGSILRPSSFTVGYLASDANNPGPNTGLFNGDYAALGQLNFSVGDRLALAATYVHGYSGAGGVLFNSGDTGAIVGTSLANNNSFLNASSSNSYGLSAAFRPSDKLSVSGFVSYSDVTGFGANDDREVWSYGIGVALPDFGKRGNVLGIFAGAQPYARGVQAGANEVPYQVEGFYKYRVSDNISITPGVIWLTNPGQNSNADDAIIGTLRTTFTF

SEQ ID NO: 9584 - protein, 778 aa, Nostoc punctiforme
MSDINKRIASGAGKFIRTTWLGHASALALLGGMALPAIAQETTPPPAAQEADTQEPATDELAVMSQVTVTAQRRAQSLGDVPISVNVVSGDTLAVQRISNLQDLSAFVPNLTVPERPGSTGASLRGLGTGGRNALFDQAVIVQVDGITSARSAQFTVPYFDVERVEVLRGAQGVLFGKNATAGAINIVTANPTDTFTGSVTAGYEFENQGYVMEGFVAGPLTETLGGRLAVKYERAGGFIEDRNLGEDAGEIDTIAARGTLQWRPNDRLNARFKIDVGEVDERGNNIEIAACTSNLARILSISPTEDCIMNRTSARSFMDEDNTRSAAFIANIDYEIGDHTFSSVSGYSQYEQSTARDLDVTPVEALNRYVDESYDQYYQEFRLISPADGRLTYILGVTGQFQNIELSDVTDLNVLGLPFGNLSPAPFSAASNRRSIQFADQSTASYSAFAHVTFNVTDSFRILGGARYTDETKEIDYVVTRALWGTNTPVVTPLDIDLTGQERSESNFDPQIGVQYDLTDRLMSYFTASIVHKGGGFNIDETDGRAIADTFTYQPEEAESYEAGLKWSGRGRYLNLAVFRTDFSDLQVASNDGTRTVVRNAAVARSEGVEVDGFWQLGDYITLAGGLAYTDATFLEYPGGSCTAAAAAAIAPTPCVADLSGNRLTFAPEWSGNLVADARFPVRDGLEATLGATLSYRSDQFAQENNDPTLAIDENTTVDLRAGLTTEDDRKSIRLVARNLFDETVPSFLFPFPRAPGSTVAISPRGRSVLLELSSKF

SEQ ID NO: 9585 - protein, 946 aa, Nostoc punctiforme
MIKLRFNLSIAALCVLQYNSALAQEQMQLDTVIVKDGIQQQKISEIKKSAKQLAKQQVQDSRDLVRYETGVTVVETGRMGSSGYAVRGVDENRVAITVDGLHQAETLSSQGFKELFEGYGNFNNTRNSVEIETLKQATIRKGADSVRVGSGALGGAVMFETKDARDFLTEKDYHFGYKTGYSSADNQKANSLTFAGRYKNFDILALKTWRDGHELENYDYKTADGSVQGKEREKADPYSIKKDSTLIKFGYSPSDNHRFSVVADLYEKKNRGHDFSYNLKPTTYINVDEYELRHTNDKSKRQNYAFVYENFSANPLWDTLKLTYSTQKIKNRARTDDYCDGSHCKETENLAGLQLKDGKVVDRDGNQPNLGVDELGLTTITDSKGTYTEGVNLVRAYWFDCSVFDCNKSVTAYYKDYSNNITSEEVALTKTYTDEKGRKFATLDPKSKFKSILLPGSKGYTENIYTERDLDTDTKQLNLDLTKSFSLLGQEHSLEYGGSYSRTEKKMVNRGGFGATSNTQWWTKRFLGMRNNFFKGTEEVITCKNATGSDQWNGLICPNEDTFSFLIPVEAKNGSLYFADNLKANDYLSFDIGYRYDDISYKPKYVAGQTAKIPDDMLQGLFVPLPDRPTKEQIRQNAEENIKYLSRNVKYQKHSYSLAATADPFSFLRVQVKYANGFRAPTSDELYFTFKHPDFTVLPNVDLKSERAKTKEAALTLHGDLGFITTSYFKTDYDNFIDLKYLGPKNLMNAFGGSATARPYQIYQNVNRQEARVNGLEISSKLNFGQLWQALEGFNASYKYTYQKGKMEGNLPLNAIQPRTSVFGLGYEHPEEKFGVDVYVTRVSAKKAEDTYNMYHSEEKAKDSYLKWRSGAYTLLDMIAYVKPWKNVTLQAGVYNLQNRKYLTWESVRSIRPFGTSNLINQTTGKGLNRFTAPGRNFKLTAEVTF

SEQ ID NO: 9586 - protein, 1105 aa, Nostoc punctiforme
MKKDELWNRLVAKPPKMRLLVMLMCIFCTFNAMFANVLADKTVTIKSENISVKEALNMVKKQTGIHIMYEDATLNNVPLKLTLNKEPLEQALSVICSQAGMRYELVENNYVLILPIDRNAKRRTITGVIKDDMGEPVIGASIVIQGTTFGTVANMDGQFMLSYPENTKNDELMISFIGMQTVKEKIGNRHVFNVKMESEVTNLDEVVVVGYGTSSVKDLTGSVASVGLKQLSQLNTPNVTSMLQNLAAGVQVSQNTGVPGETVRVRVRGATSLTGSNEPLYVIDGVPVEDPSMLDAISPNDIQSMDVLKDASAAAIYGSRAANGVVIVTTKKGVEGSKPTVNFNYNVTTDVQIKNFRILYGDEWRETVRRFAKETLVYDPSNQYALEILEPNSTALGSANTNWFDEVKQTAIRHNADLTVSGGSKVSKYLISLSIFDQQGMVKGGDLSRYNARVSTEMNVLPILRFGINANMSYTDQDNAGTSLFSAQGYRPDMPIYNDNGEFDMSTGQANPVANTYKKNHDNIYRIMGTVYGEVDIWKGFRFRSSLSGNLQFTENNSFSPSFLSTRNEASGSEYHYKYSKTVFDNTLNYNYEFNKNHVLDAVAGISFERGISRSTRMNGQTYPDNDIYTNLGSAASISSWSNGYNASGLFSSFARINYKLMERYLFTFTGRYDGSSMFGSNNRYGFFPSGAIAWRISQEKFMKNLTFINDLKLRASVGTTGTQNLTSFSNRDLYEATSYNNLSAIIHKQVGNRDIRWEKSTQYDLGLDFALFDYRLTGSISGYIKDTKDLIWSFDFPPSATGGSMQMNRNIGALTNRGIEINLVGRVLSTKDWNLDLTLNMSHNKNKVTKLVEEGRAQSAMDVVVQGSYADQVLAVGYPMGAFHGYEYAGIIQDQARIDELNAYAKSKGQSYYDGNSLKPGHLEIKDLNGDGIINYNDRVIIGNPDPDLFGGLTANLSYKQFSLFANFGYQIGGLKIYNKTLQNLPGQLTGLIDYGLNDRWSDTNKNAKYPALYIGDGVPRLTDHELFNASFFRLQEVRLTYNLPLNKVIKGQLFVSATNLFTLTSYPGTDPATVNSNSNYGGNYETSTYPGFRSFSAGLKINL

SEQ ID NO: 9587 - protein, 309 aa, Nostoc punctiforme
MQNAGSLVVLGSINADHILNLQSFPTPGETVTGNHYQVAFGGKGANQAVAAGRSGANIAFIACTGDDSIGESVRQQLATDNIDITPVSVIKGESTGVALIFVNGEGENVIGIHAGANAALSPALVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 9588 - protein, 373 aa, Nostoc punctiforme
MKLLRPVAIAALASSFAVPALAERQETIYLNPFAGYQYFGDKRDLDESGTYGVGIEYRFLPNWAIETVYSRADAERKYSSGATDFDEVRVDGTYYFAGPDRTWNPYVSVGAGHASFDGTGPSTPGINSDETRVNLGTGVRYNINDRVSLRGDLREFHGIDESTFDTMASLGISVAFTRTVGQAAPVAPAPQPPADADNDGVPDTRDQCPNTPRGAKVDAKGCELDSDKDGVVDSKDKCPNTAAGMKVDKDGCEGVVKTIDTFEIDVQFPLNSAEIGAAYDSQIRRVADALRANSTTYVEIAGHTDSTGAAAYNQDLSERRAAAVANRLTSTLDVNPDRVSSKGYGEAEPIASNSTDAGRAANRRVEARIQVRR

SEQ ID NO: 9589 - protein, 405 aa, Nostoc punctiforme
MKLTKISLAALVALGAFSSVASATPLEEAIKNVDLSGFARYRYTDDHFDNKGAKTTNANHRFRIESAFKAAIDDNFFGVLNLLYDTKDGSGHMTPNATDQTNTTGSFGVQEFYLGYKYGNTTVTAGKQLIKTFFDDGDISGTGVKILNTDVPGLTLTAAAYDALEYGTVDVDGPLLNAIGAMDKSPNLYVLGAMGSYDPVAFKIWYANLHDVANLIAGDAAVNFNINDFKLGLQGQYAHNESDHADYTDANFYGVKANFGILGASLNAGYINFKADNTSNGGVGTSFVSIDSNGGYINPAKILNGAMSSSSQFYNNIKDKNDYWFINAKYVFDQKYGIGAGYTKGKGYSNALAEKRAKRDEWYGQLDYKYSKKLNFMAWYAAAKDKKDGEKYKQDRIRFEAKYSF

SEQ ID NO: 9590 - protein, 696 aa, Nostoc punctiforme
MIKIKMARSVATLLVVSSGTLLSANETTTLDEVQVVTTAGGYEQNIKDAAATISVITKEELEKKSYRDISDALKNVPGINVSGSGANKTISIRGMGSEYTLYLIDGKPVQGNDAFNPNGGVVGAPINFLPPLEAIERIEVIRGPASSLYGSDAMGGVINIITKKHMDKATASIKTEYIKADKSNKVNDTTSNTSVYVNAPLIEKTLSFQFDAGIMDTSESDFFKVKKNANGSESTTLSGDSEFERKNAGGRFVVTPDENNTVNLGYSYTIQERTSTPGKSIPKELLNSMGVPVAQTESYSKSIKNKYFIDHQAKYDKFVIDSYVNYDKDKNPSRVNATTGNGIEFETTTLNSQGTYFFDTNSVTIGANYKKENLEDGATNGLPANINDIVKMERYQWALFAEDTWSVTDDLALTLSGRYDYNEQFGSNFSPKAYAVYSLTDNLNLKGGVTSGYKAPSLRQSAPDFAGVSMGGVMLGNPDLTPEKSMNYEAGLAYDNSDLGLAGSLMLFQTDFEDKLMRITNPKVCEANQPCTYKGTTYAPHQWGYTETKNVDEAESKGIELTTDYYILENLKYRHSYTYNKTEQKSGTDKGRPFTDTPKHMFNAGLDWDVTSKLLLWTQVNYNGKTTGSKSQGGGGSSYVERKAYTLLDLGGVYKYDDKLQFLAGVYNISNEINEDADNERDIDGRRYSVAMNLKF

SEQ ID NO: 9591 - protein, 841 aa, Nostoc punctiforme
MMSKNNIPSPDQDACCFPVSGSRSQPDLKRKGASSFLVWVLASTAFSCCAAQAADPKKQTRPVVHHNPGKAAPVAPVRSKAARARRATAREALESESMQVTAHHVPHGAVTTVSSEALADAVPGTNPLKVLARQPGVMFQSDDPQGMDTWSTQFYMHGFLQNQIGMTLDGIPLGDQEFHTFNGLNSVNAISAENVGRMDVSMGAGAESVASTSNLGGAVEYVSSDPKHKAGGLASQTFGSNSGFHTILRMDSGDLNKSGTRFYVSYMRNSQDKWKGGGDQFGQQVNAKFVQPIGERSSISSFFDYNLTQSYLYQDMSFDMLKNGGYGIDNFYGTPNAYKKAYLSALSANGLPGGALPAGYSKMSDPWDASYYDGALVERDYLGGLKANLALTDRLRWESVVYGHGQYLRGTWANPYVSSPNGAPLIDQATVTHSQRFGFTSALHYQIAHNDISGGVWYENFHTDVGRFGYQEPLLSDVESGKAKPVNSVGELPDPYATLWGQNLNSNSFTAFVQDTYHVLPNLSLHFGFKSLLQTVRGGQYANDESYTGVGQIAGGSITTAKAFLPHISGDWHFLKHHELYFDIAENVKSYPVQAFKEGASPFSVSQSAYNQLLQNGGLKPETDWNFAVGYRFTHKYALASVHAYRTNFHNRLQQVTSGSIVNPVSTVANVGGVTMNGVDAGLTLMPIKGLSLYNSISYNHATYDNNVTEAGTTYHIKGQQIVAYPRFMYKASLAYEWRNFSAHLDTQFLGTRNYSYTGDMKIPSYWIETLGARYRFGNLGKYSRSLDFVQNLTFEFNVYNLTNTKYISTMGETGVPMSGDYQSFLVGAPRQYYGTLKAEF

SEQ ID NO: 9592 - protein, 653 aa, Nostoc punctiforme
MTKRCVWMSAWVLAGCLLTAWPVQAAEVTENLDDEQVFTLGEVIVSGEEQVVNLATTVTEVTAEDMKQRGARTLAEALEMLPGVDVARSSSKNESFVQIRGFSDQDVKILIDGVPVYEQYSRQLDLAQIPTSSISKITVTKGASSVLYGANALGGVINIITKKATSKPSATATAAWGDYGTEEYSFGVGAPIGKFNYWLGYSYRHSNGWKLSDDYDEDWWGSKEDDGGKRDFSDYIQHNINAKIGFEPDADTSLYLTFDYHDNEKGVPTRKWYFPQWEQWHVNLVGQKKFTDWLKIKARVFYADHQDTLFFPKWNELSAYDNYSVGGELQSFLDFGRWSFVKFGASFQRDNCQQSEKVIDDGFWTDAGDYEADTYTFALEDEIKPLEWLAIVVGASYDYYDPREAGDMPVPDSIDSFNPQIGAVVTLTEMTSLHGSVGRKIRFPHLKELYSEMAGGNPDLDPQETITYEVGLTHAFTDTVTFSVSAFYNDIDNLIDQIDVMVDGEELGVYINIGEATTKGVEVALGADVTDDFWVGLNYTYMRTEDKDKGRELEGRPRHRVNLDMRYLFPFGLTTSMQLSYTNRQFYDDKYNGWTRSPDFFLLNARVEQRVGELWGVEGNAFFEINNLTDRDYYEVGRPTPGRNFLAGLSFTY

SEQ ID NO: 9593 - protein, 533 aa, Nostoc punctiforme
MSHLLWKTLVLSPVGLATTLLVITNGIDSVKADENRILEQVNIYSSEANNQNPMSQVTSVSQFSDVQPTDWAFQALQSLVERYGCIAGYPNGTYRGNRALTRYEFAAGLNACLDRVNELIATATSDLVTKQDLATLQRLQEEFSAELATLRGRVDAVEARTAELEANQFSTTTKLVGEAIFAVTDSFGDDDDNNTVFQNRVRLSLQTSFTGKDILYTRLASGNAVGLTLPNGTFEGTQTFNISPNTSNGVAIDWLSYYFPVGNSQVYIAATGGIHSDYVPTVNPYFEDFDGGNGALSTFASESPIYRIGGGAGAGVNLAFGSGNSSFKPSLTLGYLASEGNNPNPSAGLFEGNYAALAQLNLNVGDRLTLAATYVHGYHGANSALFDAGLVSSAVVGTAQANFVGGGNPYQSNSYGLAAAFKPSDRLSISGFVLYSDITDLVANNDGEVWSYGVGVALPDLGKRGNVLGLFAGTQPYLGSVSGDRPYHIEGFYKYRLTDNISITPGVIWLTNPGQVTNNNDAVIGTLRTTFTF

SEQ ID NO: 9594 - protein, 1086 aa, Nostoc punctiforme
MLAVTGVQAEVVVSTARTTPIQTSNATGTAADNVRIASGGSIAVTSGAAMTLDSNNTVDIDSGGSITMAKAADGATGVLVNGGNTGSVTMGGTINITDSQETADIKDTDGDGDLDGPFATGTGRYGVRVTGASPFVGNVLVESSGSISVEGNNSYGLAVEAPLTGKLQSLGTVRVVGDNSVGIRTTGPISGNVDLAGSVSATGAGASGVSIEGNVGGALKIHSAVTTTGYRYTSPPPVRPTTGTYDNASTIFLDELDADDLLQGGPAVRVAANVAGGVLLDTGPAYSSAGIDGDDDKDGVKNGDEDDDGDGVKNRDDADRDGDGVPDASETTASLTSVGGAPVLLIGSATNAVTLGAVGAGDAAYGLINRGSITGTGVYSGVESRALQLGVAGGQTVTVAGGVRNEGGIASTAVDANATAIWIGAGVTAPAISNTGNIQAVASGKQAHTATGVLIGAGANVGSLTNTGNIVASFGGNHGAATVIRDQSGTLTQLSNAGSIIGSLSADSTDTTAIDGTVTAIDLTANTSGVTVRQYGIPAAAGSTATDTDKDGVPDASEPVIVGAVKFGSGADAFNVENGTVIGDMSFGAGADRLSISGGAAVSGAVTDSDGALDINVSKGTLNATQTTATSISSLNVGAEGVLIVAVDPQGDRAGGFNVSGAATLATGAQLGVRFSSLLESPERFSVIKAGALNVGDINQSLLTDNSPYLYVVQAGVDQAAGEVYVDARRRTAQEADLIPVEASAFDAVYAALGSNETIRNLFLSQTNRDGFIDAYEQMLPDHSGGPLMSLSAGVDAVTRALTGRNASAAPGETSAWVQEINFYADKDKTDSYGFRSEGFGVAGGVEKGTGAGAFGLTAAFTSSDIKDPESEAEEVLSANLLELGLYWRAQGQYWTTWARAAGGYASFNADRSLVANGVYLNNKSDWHGWTAAAAGGASYERNYGRLNVRPEVYAEYFRLSEGARSESGGGSGFDLDIDSRDSHIFSAVAAMNVGYGFGKDGWIRPELRIGYRQNLSVDAGETIARFASGGPDFVLSPDGVEGGGLILGFRMNLGNDLGMLSLTGDAELLEDYVRYSLLLRASFRF

SEQ ID NO: 9595 - protein, 766 aa, Nostoc punctiforme
MSNFKNNKNRLYLGVAAGVVTATVASLSASPVRAQEAERRVLPPVSVDAPQQRARSATRTAQPRATPQRAARVAPRRAAEPPPPPAAPPTTMGSTRTIGAPAPAYAGGQVAQGGTLGLLGSTSVMNTPFSTVNFTSQLIQDQQARTAADTLINDSSVRLSTGSDGFDDTFVIRGFAVSATDVGLNGLYGLASSQRVPAQIIERIELLKGPGALINGIAPSGAIGGGINIVTKRATDEPFLRLTPFFMSAANYGLHLETSQRFGANKEWGVRFNGVGRNGEASIRDGNFQSGLGAVAIDYRGDRLRWTLDLFSQNDNTDNFRPQISLLPTATAIPAPPDARSNWYPDTRLRQKDNTAATALEYDLTNWLTAYAGVGYRDGSNYQTFPRSATAVDALGNFQVQNTYYDSYSKTLSGNVGFRSRFDTGFIGHKLNVAYTGFFQEAGNAYIQGGTTASNIYNPAPLPAVTLDRYSPRHASDSTLTSVAVVDTMSFLNESVLLTLGGRHQMVKQESYATTGTNIGALTSTYDASATTPLAGIVVKPWTNVSLYANYAEGLTRGTIVGGNFSNAGTILAPYKSKQQEAGVKVDWGTITTTAAVFQIARPSLITTAANAQAYDGEQRNRGLELNLYGLILPGLRGMASATFINPELTNPTDPTQRGNAAAGVPDKAFSAGLDWDTPWVRGLALNGRVIHTGSAYLTTANTLSFPGWTRLDIGARYTTTALTGKPVTFRANIENVTGETYWLTTGTYVTVGAPRTYLLSAAFDF

SEQ ID NO: 9596 - protein, 687 aa, Burkholderia phymatum
MTKVASSRSVLAAVAAALVMGGASLGPAPVLAQTQLLNVQDADIRVFIQDVAKSTGTTFIIDPRVKGTVTVASNGPLNRRELFEVFLATLRANNFVATPAGNGAYRIEPSENAARQPSAAGGQFATEVFRLRTLDAASAVEMLKPLVGPQGQVVANPRGAVVVVADYADNVRRIRGLLAQVDQDRAMVHTVTLTHSSAREIAQVLNDMLATPGAEGKSGRGAVTVVPVDSSNSVLLRGDSDAVQRLLPVIADLDRRAESSDDVRVVFLRHANAEQMLPVLQQLVGQATTSVTTSSSRGLSNARTATGASTATTAPSAPVAATPSANGPQATIARFPGANALIINAPPETQRTLAEVIRQLDVRREQVLVEAIVVEVTDGTAKQLGVQFLLGGTNGTIPFVATNYTNATPSLLPLVGAAATTTSGADTEALKSLRDAAVSSLLTASGVTSGVVGRSGDALFGAIINAVKKDTGSNLLSTPSIMTLDNEEARILVGQEVPITTGEVLGDSNANPFRTIQRQNVGIQLEVKPQINAGGGITLFLRQEVSSVAGPVSVGSSELIINKREIETTALVDDGDIVVLGGLLDQQETQSAQRTPGLGDVPGLGALFRSTARERKKTNLMVFIRPRIIRSSADARNLTAPRYDYMRNLPPMTTPDGDNSLDAVMRDYLNAARPVAAPTAAKPATTP

SEQ ID NO: 9597 - protein, 326 aa, Burkholderia phymatum
MKKTLLVTVILASLVPTAQATVNVYTDDAHQVDLYGRAYGAYIYQDGNDVKSDGRSDSYFRTGFKASSNLADDLTGLARIEMQFESRDNSDANSTSKTRLMYAGLKNDRGQLTFGRNYAADEIIADWADAGTTNYSGNPAIGNLNRQTNLLKLEMKVLDDALNLVAHIQPESSVDASSGNDSQSSYSLGGVYGFDFGLELGATYTGVMTDDYGANSDSDRSTFLTAVRYKYQGLTASIVGDITNNDSGVDDWTAYELSLAYTLDKLTGTFTYKQRDTDTISDNTVDQAAVGLAYKFNSNFRVVTEYVIEGVDAKEDQWHMAARYDF

SEQ ID NO: 9598 - protein, 238 aa, Burkholderia phymatum
MKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 9599 - protein, 184 aa, Burkholderia phymatum
MLTPGKVTDKALWIAMLGMLTALACAAPRADSLYVGAGAYFTDVELSVGGEDDITPAGFIGYQFLDSNVLMLSAEAGYYDLGAWSGTLDDVRYSVDASALTVAGVAYVPLGPFFEVYAKAGFAAVEVKSRFADIPRTDDDTETFIGAGVALDFFDTVDIYAEYLQFDNTINSQMVGVGIRFDFF

SEQ ID NO: 9600 - protein, 346 aa, Burkholderia phymatum
MMNKTLIALALMGTCGYANAADIDNTWYIGAGAGQSNYESVDAASHLGDDSDLAWNALVGYQLNKYLAFEAGWQDLGTNDDTHLWGGLDGSQEIDVDGFTLGVVGTLPLSEKWFLTGEAGAYQYHLAHQMSANKYVSATDTAPYFGAGVGYNITDSLAISAKYRRFANIDETAWNTANMDAQTVGLQLTYRFGVKAATTTAVVLPAVIEKQTKPMPRPEPKPEPKYEIHTEKSSVAVLFSFDSSELTSAAKAKLDQVIQLSKSKDQDVILLNGQSDNQGDSQYNLKLSEKRVQHVEAYLVSHGVEVKKIDTQAVGEQDAHANLRKDRALERRVIVTLTSQEKVLAS

SEQ ID NO: 9601 - protein, 174 aa, Burkholderia phymatum
MKRRSSFLVFLGLLLASPLALANDQHTVSFGYAQTHLSSLKNSDSKDLRGFNFKYRYEFNETWGMLGSFTATRNEMENYTWKEGKLHKNGSDSVDYGSLMFGPTYRFNDYVSLYGNAGIATMKFNKHSKEESFAYGAGVIFNPVKSISIDASWEASRFFAVDTNTFGVSVGYRF

SEQ ID NO: 9602 - protein, 916 aa, Burkholderia phymatum
MKKLILSSLVFACINTSVEALENDGSKPNDLTSPKEASQESQKNEAPKNEVQRNEAQKETPQSNQTPKEMKVKSISYVGLSYMSDMLANEIVKIRVGDIVDSKKIDTAVLALFNQGYFKDVYATFEGGILEFHFDEKARIAGVEIKGYGTEKEKDGLKSQMGIKKGDTFDEQKLEHAKTALKTALEGQGYYGSVVEVRTEKVSEGALLIVFDVNRGDSIYIKQSIYEGSAKLKRRMIESLSANKQRDFMGWMWGLNDGKLRLDQLEYDSMRIQDVYMRRGYLDAHISSPFLKTDFSTHDAKLHYKVKEGIQYRISDILIEIDNPVVPLKTLEKALKVKRKDVFNIEHLRADAQILKTEIADKGYAFAVVKPDLDKDEKNGLVKVIYRIEVGDMVYINDVIISGNQRTSDRIIRRELLLGPKDKYNLTKLRNSENSLRRLGFFSKVKIEEKRVNSSLMDLLVSVEEGRTGQLQFGLGYGSYGGLMLNGSVSERNLFGTGQSMSLYANIATGGGRSYPGMPKGAGRMFAGNLSLTNPRIFDSWYSSTINLYADYRISYQYIQQGGGFGVNVGRMLGNRTHVSLGYNLNVTKLLGFSSPLYNRYYSSVNEVVSPRQCSTPASVIINRLSGGKTPLQPESCSSPGAITTSPEIRGIWDRDYHTPITSSFTLDVSYDNTDDYYFPRNGVIFSSYATMSGLPSSGTLNSWNGLGGNVRNTKVYGKFAAYHHLQKYLLIDLIARFKTQGGYIFRYNTDDYLPLNSTFYMGGVTTVRGFRNGSVTPKDEFGLWLGGDGIFTASTELSYGVLKAAKMRLAWFFDFGFLTFKTPTRGSFFYNAPVTTANFKDYGVIGAGFERATWRASTGLQIEWISPMGPLVLIFPIAFFNQWGDGNGKKCKGLCFNPNMDDYTQHFEFSMGTRF

SEQ ID NO: 9603 - protein, 389 aa, Burkholderia phymatum
MKKSLLALAALGAFAGVAHAQSSVTLYGIIDEGFNINTNSGGKHLYNLSSGVMQGSRFGLRGTEDLGGGLKAIFVLENGFDVNNGKLGQGGLMFGRQAYVGLSSQFGTVTLGRQYDSVVDYVGPLEAGDQWGGYIAAHPGDIDNFNNAYRTNNTVKYTSADYGGLKFGGTYSFGGVAGNFSQNQIWSLGAGYNNGPLVLGVGYLNARTPAASGGLFNNGGTAATPAGAVTSPVYAGFASANTYQVIGAGGAYTFGAATLGLTYSNIRFANLGASYASPFKGQTATFNNAEVNFKYQLTPALLVGAAYDYTRGSEVNGNSRAQYHQGALGVDYFLSKRTDVYVIGVYQHATGETVNAAGAVVTATAGINGLSGSSNQNQLAARVGIRHKF

SEQ ID NO: 9604 - protein, 442 aa, Burkholderia phymatum
MPTRSTLRCRFLATAAPGLAPTKASLLASLLASILTCAAGPAAAEERSDKTTEAKPPVTLDGKGITLRFDDGSKFRIGGRLQGDFGTGRVQQRGFGTVFEEPAAIRRAWIETYYSLKDFEFAFQYDVNEPRVPVSDAIVAYKGFRDVIITQGNFKEPFSLDQLISDNVSQFTERSQADAFVPARNFGAAIGTHGANWTAVTGVFGGNINTGLQNNGIASTTRLTYTPWLSENKNDVLHLGLAGSYRSLDDDARSLSLSSRSEAFLFARPLVNTRTIRDATAIGRVGVEAAWQQGPFRLQGEYILTDIERRDGRPPLLFQGGYIQASVVLNDKGRPYRVAPTYGSEYGVFTGVTVEERQRVSRGGTGLFELGVRYSAIDLESREVRGGVEHDFTAGVNWYPEPNIRFVFDYIRSHAEPSAESLNFGRRTVDADVFIGRAQLYW

SEQ ID NO: 9605 - protein, 633 aa, Burkholderia phymatum
MKLQNSFRDYTAESALFVRRALVAFLGILLLTGVLIANLYNLQIVRFTDYQTRSNENRIKLVPIAPSRGIIYDRNGIPLALNRTIYQIEMMPEKVDNVQQTLDALRSVVDLTDDDIAAFRKERARSHRFTSIPVKTNLTEVQVARFAVNQYRFPGVEVKGYKRRYYPYGSALTHVIGYVSKINDKDVERLNNDGKLANYAATHDIGKLGIERYYEDVLHGQTGYEEVEVNNRGRVIRQLKEVPPQAGHDIYLTLDLKLQQYIETLLAGSRAAVVVTDPRTGGVLALVSTPSYDPNLFVDGISSKDYSALLNDPNTPLVNRATQGVYPPASTVKPYVAVSALSAGVITRNTTLFDPGWWQLPGSEKRYRDWKKWGHGRLNVTRSLEESADTFFYQVAYDMGIDRLSEWMGKFGYGHYTGIDLAEERSGNMPTREWKQKRFKKPWYQGDTIPVGIGQGYWTATPIQMSKALMILINDGIVKVPHLLMSTAEDGKQVPWVQPHEPPVGDIHSGYWELAKDGMYGVANRPNGTAHKYFASAPYKIAAKSGTAQVFGLKANETYNAHKIAERLRDHKLMTAFAPYNNPQVAVAMILENGGAGPAVGTLMRQILDHIMLGDNNTDLPAENPAVAAAEDH

SEQ ID NO: 9606 - protein, 205 aa, Burkholderia phymatum
MNTTLKFARTSMLAAPVALAAGMVSAGGMSEPVAAPAPVVVAPAPVAVGSDWTGFYAGAQLGYGVVEADALSDDGEDLTYGAHAGYLYDFGSWVLGGELDLDGTEISQDGIDVDTVTRAKLRLGYDAGDFLPYITGGVAQLRTSSDDDTFDGDDTGGFAGLGLEYRVSPTIRVGGEVLQHQFEDYNGSGEDIDARTIAARVSFQF

SEQ ID NO: 9607 - protein, 721 aa, Burkholderia phymatum
MNTTTPFKTSSIALAIMATFTTPLVAAEQSSIENAQLETTQLETITVLGKVYRNTATKTALEPEETPQGVTIIDKELLDQRGVKSVNEALRYAPGVVTEQKGAAVTMYDNFSIRGFETNNQNYYDGLILPYLAGWNLHPQIDPVAIQQIEVFKGPTSVLYGTMPPGGMVNIIAKSPQQEQSTSVGLATGSRHLVQASLDSAGQIGDSNLSYRLVAMARKQDSQVNGADEERYLIAPSLDWQVTDRTLINVNLYYQNDPAMGINSSMPVEVVKRQSPSVSMGDTNWSTFERDILMLGYKLNHEFNDNWSFLQNARYTDASLYQENTYHLDTGFTAATGALSRNIYTTDESYKSVVIDNQLSGLVTMGNWQHNLLVGVDYQDLDGDSSYKEFAGNAAFYTFNAYQPNNNLLDKSQLNEVYSERHDIGFEQLGVYFQDQIRHGQLILLAGGRYDLFKSHDDKTSTAPTYDGKETSDHNQFSYRVGALYELGNGLSPFANYATSFEPAAGTDINGKSLKPQTGEQIEVGFKYMSADMANTLTASYFNITKFDSIAADPNDPTFRAKIQLGEVTSQGVELEGQAYLADNWDVLASYTYLDMEVKKATDATLVGTTPIYVPKHSANLWTNYYLTSGALSGARIGGGVRYVGEMEMDATNTQGKVPSYTVADLSLGYDLGSASDSLNGAQVNLVVNNLFNEQYYSCYNQTNCWFGAEQTVELNVNYGF

SEQ ID NO: 9608 - protein, 66 aa, Burkholderia phymatum
MCNQLKNLTIRAGVYNLTNRKYITWDSARSIRSFGTSNVIDQSTGQGINRFYAPGRNYKMSVQFEF

SEQ ID NO: 9609 - protein, 861 aa, Burkholderia phymatum
MRNYRVVLCWRAAVGCVVRRVRPSVGCCLERVLSSPAGKERPGISWPQGACRARDGPFSGAQAWFRPSGSGNNTLLYTQYINLTIVIMRSFFVGRSIAVALLISMFSFSFTAGALAENRSISGIVSGASDGEPLVGASVQVKGTGIGTVTDVQGEYRLDIPEDADAVTFSSIGYEPRTVAPGTGSILNVSLNGHSYSTGEIVVYSTRSMAKLKNIPRKVEIVSEKDIEALDPVNATDLLKKTSGVDIIEYPGVLSGVSIRGFSPDFSGIDQNVTYLIDGRPAGATNLATIDMNNIERVEVIKGPSSALYGSQGMGGSINFITRKSAGALSGKASLGYSSFSTLDGSVRVGGSLSERFDVDLGVRSYNQNEDYTVGSNTLISDPDPEVLEQDIDTMRNSTYATQSGNLRIGYQLNDEVRIDARGEIYQAHSVKSPGSIWGVYGHSEKDIDRQTLDVTMTADWGTHALRFVPHWSLEKSVSYKKDDEGLNYRSSLSEIEWLGFQLQDRIRVGRQTFTGGVDYTVIDVFSRSFADSETEKAPSRPNQQQSSLGVFGEVGISLFDETVIANIGGRYDITSYQLKETPLFTTVETESEEYDNFNPSVSVQYRFLPQCKIHASIGRAFVAPNPYEKAGFYVDDDGMETRGNPDLEPETSVTWDAGLTYESDNGGFRTDVTCFSTDWENFIQRTSAVDEFGEEYKTFENLNSAEMNGIELECSYDFGAAHDERYSLRLFTNFTHLFRARSINDDGSEGDMLYVRRNRGSMGLEYDDFRFFSARLTARYIGDRFEQNWIGRYDEARPTLKDPVIEIPASLIFDMSMGFRIDDQNDVSLIAKNILDENYTEKDGYNMPGRSLGVRYSVEF

SEQ ID NO: 9610 - protein, 394 aa, Burkholderia phymatum
MRNYPLKAVCAVLMLGLSACSSLPTSGPTDSAVLEINQGADASELAAKVNVIELNESLVQQIYAAQQSQRFSGFADVRGNGGYAGAVNVGDVLEISIWEAPPAVLFGTTFSSEGQGSGHVTQLPSQIVNKNGTVTVPFVGNISVAGKTPEAIQAQIVASLSRKANQPQAVVKIANNNSSDVTVIRQGSAVRMPLTANDERVLDAVAAIGGSTGNIEDVTVQLTRGNQVKTLAFETLIADPKQNIVLRAGDVVSLLNTPYKFTGLGAVGNNQQLRFSSSGITLAEAIGKMGGLIDTRSDPRGVFVFRYMPFAQLDSKAQQEWAAKGYGNGMEVPTVYHANLLQPETMFLLQRFPIQDKDIVYVSNAPLSEFQKFLRIIFSITSPVTSTTNTIRSY

SEQ ID NO: 9611 - protein, 702 aa, Burkholderia phymatum
MKRINLLFMSLLCVWISATAQVGQQSQEPVDSIKNIGYMDSLFQELPEVMIIGERPIVKAEQGKLVYDVPRLVGNLPVDNAYDVVKNLPGIVNMNNSLMLGGQEVTVVINGKVTTLSAEQLDALLKSIPVSRIEKAEVMYSAPARYQVRGPMINLILAPGTGQASSLQGELYTAFNQHHYESLAERGSLLYSGRKFSADLLYSYSYDRDRRITEKEALHTLADGSAHQMDMDEIMTSRTNSHQIRLGMDYSLAEDHLLSLVYTTAFTDSKHYSIATGAQNSVTDSQGDSQLHNAKLDYQTPFGLKAGVAFTSYHSPGSQLLYSTMGTETMNFLSRDKQQINQWRFYAGQEHTLGKGWGLNYGMAYTTALDHSYQKYYDPETDHLLPDNNMASRRREQTLNVYAGLNKSFGDKLSADVSLAAEQYHTDIWNGWSLYPVANLTYMPAAGHVLQLSLSSDKEYPEYWSVQNSISYMGAYSEIQGNPYLKPATNYETSFTYILKSKYVFSAFYSYTKNNEMQTLYQSPERLVEIYKLFNFDFSSQAGLMMTVPFKVKKWLDSRITAIGFRYRQKDSDFWDIPFDRKLYTFVLTMNNTFTLSTKPDLKFTLTGFYQNRAIQGIFDLPRSGNLDAALRYTFAKGKAQLTLKCDDIFNTSTVSTQVRYGLQNVKNHYMRTTRTFGVSFNYKFGGYKEKKREEVDTSRFK

SEQ ID NO: 9612 - protein, 997 aa, Burkholderia phymatum
MKASTIGMSMRKTKLYLALASLILATPAHSYETITVGNFEAQLLAPGESAYAIGAKASGAGYTEDYRETVTGAEAWTQGHRDAISRSLQTLEQSFAMGNPNRKMQIAFTLEKGEYLGMSLGTLIFDQAQQNIIATGELLLRNNIPTNNVLGSVDDIIIMFTSVPLHYGPEAPGHGQYDFQATVTHEILHAMGIMNGNARDGGYPNGMTRWDSLLKDVYGGTPAPGNPLPISTIGKLGTVFWTGAAANATYGGAVPIQTFTNAYREGSSLAHPAPPGELMSYMGSPLDAPRAPNKLLLDMYRDMGWNINDAYYNSFGPTYYSNASHISNTNDFATSHSYTYAMYVNGNYNLIDQSGNLKTTKEQSNALYVYGNGNKIRVNGTQSADANYSHALYAFGIKNQIFIEGEGTLTAKGAGSVGLLLFGFDNSIFHSGTILASDEATAIRIDNHRATWGYRLNTSLHLQTGSKIVGDIINTDSTKAADMTFGRKYASDGSYSPDPNFNFSYNDEIRGDWNYDFHSGTVTFANTLNQHEGTILTGNGSIIGDVDSAGIIAPGNSIGKLTINGNLSQTSSSDLQIEFGDGGYDQLVVSGTAHLDGSLSLIPIGYLTPGTHQFINAGALAGNFATVNNFSSSILQTSASSFNPSNFNLVRNSYASVSESQQQSLASSFDRARPTASGDMADTLNLMDLMNLTDIRQAADDFSPYFYNSVTTAILENIRTRSTFLQNKIRGDETDRQSPLWFSGYGGTTQYDKTVTSNDFKTKYSGFMLGFDRQFASGFQLGAAGAFTDFSFKEKATTSKARGSVYDGYLYGSWSPQANNAFYLQSTLGIGLTDSKTNRNIPFLDRTATSDHDAIHYSAFLGGGYKQQIGNWSLEPRAGLEYINLDEDGCTEYGAGAASLAINSKDSDALVSSLGVEISRTIELNNGSLVPSFRADWFHNFSAKGENTIATLQSGESFSVDGRTASENALELALGLRVLVSNKLHGYFEYQYTFADN

SEQ ID NO: 9613 - protein, 321 aa, Burkholderia phymatum
MNKKVLALAVAAITSAGAVNAAELYKDEAQSIEMGGRAEARLAMKDGDAADNTRIRLNFKGTTQISDGLYGVGFWEGEFTTNDAVNPNGNLENRYTYAGIGGNFGEVTYGKNDGALGVITDFTDIMAYHGNSAAYKLAVADREDNAIAYKGQFGDFAFKANYRFDDAAANQESNDGFSTSGIYAFGDSGFKLGAGYADQGTDNEAMVAGSMTMGDFYFAGTFTTGEVVDLDYTGFEVAGAYTMGKTVFTATYNNADHDTNALTVANNENADNFAVDATYFFNANFRTYISYNLNLLDDDALKGITKAMTEDEVALGMRYDF

SEQ ID NO: 9614 - protein, 653 aa, Burkholderia phymatum
MNHPSRIATLTLVTAAVSTPVAHAAESDVALNDVVVTAAGYAQQVTSAPASISVISREQLENKAYRDITDALRDVPGVIVTGGGRGDNGADISMRGMPAQYTLILVDGRRQSSRESRPNGSAGFEQDWLPPLQAIERIEVIRGPMSTLYGSDAIGGVINVITRKVADEWHGNVRAEATLQEDSDSGNANQGQLYVSGPLADDLLGLQVYGQYQKREEDDIEEGYEDKDLQSLTAKFSLTPSEHHDVGLEVGKETQDRAAHVGKSAPAEGCRGGCTDSHSTHDREHYALTHTGRWGFATSNSYVQRESTQNKARDMEITNTVANTQWVMPLSRHIVTLGANYEKEELDDRTSNQISDLTQVSNDQWALFVEDEWLLTQDVSLTGGVRLDDNENYGSHVSPRLYGVWQAAPRWTLKGGVSTGYRAPGLREITPGWGQISRGGNVYGNPDLEPETSLNKELALLYSAPSGLNASMTLFHNDFEDKITRVACPDSVCAAGPNQFGADPTYRINVDEAVTRGVELSLSSPLTETLSLSTSYTYTDSEQKSGEYEGNPLTKLPEHQFSGTLDWTPVARLNAWARLTYRGKESQPVEGPSSSSIRAPSYTFVDSGGAWRLTERAKLMVGVYNMFDEEIDYDEYGYVEDGRRYWVGASLDF

SEQ ID NO: 9615 - protein, 906 aa, Burkholderia phymatum
MKPTALGSAIRSIVWAEVALTAALGTSAYAQTTPVDGSVAAEQTGSTAAAAPAPASGTAAGGQTVKKLDKFEVTGSLIRTSDKVGHTEVQVITAKEIQQSGYTTVADFLRSTSANSASSWGQTTMNSSAPGGAGMALRGLSEKYTLVLVDGQRVANYAQSVNFTDTFFDVNAIPLNMVERVEIVKTGAVSVYGSDAIAGVVNIITKKNFQGLQIDGQLGKAQHPGDGQGNFSVLAGFGDLNSDRFNVTAAASYYRDSGSTLGDRDMTSAQDFTQYPGGLAAPLGPNQQSYWSLADGSRVPLSPCPPGSKTSATNCTYNPAASTSLVPSTTRLNAKVRATFKIDDNTQAYAGFWVSRDETVQLQGPASISSTTNVYNPSTGSVSPLPRTVPVSNPYNPFGVPTAINLTFPGNVVGADTVSTFWMANTGVKGSFDTGRFGAWDWSADYGHSQSTVDTTYRNRINVAGLENMLANGTYNFSNPAATPNGLNGVFTDDDQQAISKVDSVTAKASTSNLFTLPGGPVGLGLGTEFRHESSTINPQTLASQGVSAPANVQTVEGSRNVAAAFYQVDIPILRNLTFTQAGRYDHYSDFGGAFSPSFALRFQPVQMLTTYASYSRGFRAPTLVENSQAVYLSHQNLVDPNDPSGVPTKHFTTEQVAGNPNLQPEHTKNYNIGFQLSPDAMTDIGAAFYKVRIDGVIGTDDPNAVLVANDPSRVVRNADGSVRYLVQHFVNLGALDTDGFDLNFRKALRTKYGTFTLAGDWTYVWHFKLHSPGTAPQDFAGNNLALLQPFGASNPRWKGNTSVSWDYRQLTTTLTWQYTGPYTNAVAAEFGDGGTGSVASYSQFNLMFNYRGFKHWTIYGGITNLFDKKPPFDVEWQAVPDITGYDQSLYTNLGRFFQVGATYRF

SEQ ID NO: 9616 - protein, 874 aa, Burkholderia phymatum
MYRTTLNLLAGAIALGLTAGAAGAAETADTGKDSTTLGTVLVTGSNIKRSDTAGPNPVQIVSREQIEQTGRSTLTDVLRNLSANAGNSFDEQYTGSFAAGSASIGLRGLSPKNTLVLVNGYRVSNFGFALNTQDTFVDLNALPISAVERIEVLKDGASAVYGSDAIAGVINIILRKNFQGVEVGGGFGTATQGGLNERKANLLAGFGDLEQQGWNVLFGLDLLKRDRLDGDDRAYTRSGDFRDKPGGRLAGWSTAGGNWLSNPRAPQPFANCPDGSQLRPYSDFGSTLPGQACAFNAQPFKTLQPGAERLQASLSATYRFNDSVEAFADVLYSHNKADQIFSAPLTVGPGLRAYNPATGTLIDVPAVLPVGHPNNPGSTPLPFEYTFFDLGPRLKDNTQVFYRALAGVRGSGERWDWEVAALTSQSAQREYVDNFVNRYAFEQILRDGSYNFLNPSSTPGALDALRLQTKRPGWYKLHALNVKASTTLWELPAGAIGFAWGAEFRKESLDARTSAQVLSGTELRPAINVVNGERQVSAAYAELSVPLHRTLELQVAGRGDHYDDFGKAFSPKVALRWQPLDSLLLRGSFSRGFRAPSLPEIAPGQTVSYGSVIDPFDPLQPGGSRGVTNIRTGNPDLKAERSRNFNVGAVWSPDGDTSIGLDWYRIEQDNLVKPDSAQFIVDNPTLFPGRVQRENGRIQFITNQYANQGELTTSGLDLDASRTFRTDGWGNFTVAGSWTHLLSFKQPLVAGQAPYDGAGNNRHGALPRTRGTTSLNWAVGDWSSTLSLQYVSGYDQRVATVTSNPGLRDRIKPYHQLDLYVAYEGIPNTTLSLSVLNLTDKDPPFDPAGGSNGFDISQYNLRGQFVSLGARYRF

SEQ ID NO: 9617 - protein, 359 aa, Burkholderia phymatum
MKKTFISASVASVLALASFGALAEGPSFYGRLELAVTNTETGATLQSGTNGLNSNYADENNAGTYLENNFSLLGVKGTEKIADGYDVVYQMEFQVESTSGSGDVFKARNTYLGLKTNAGTVLVGRNDTVFKQAEGGVDIFGNTNADIDRLVSAQTRSADGVWYFSPKLGGLVTLNANYLFDDNNDEKIDGKPAPDTNESLYALSATLGDSKFKEQNYYVAVAYNKGIAGVDAYRGVAQAKLGQFKLGGLFQNSESVTDSAIDGNTYFVNVSYDLNGVNLKAEYGYDEAGFGKYYSTLGKAGADDISVNNINVGADYRLSKSTMVYGQYSMYKGDYKDTTGAKIDLQDDNVFSVGVRYDF

SEQ ID NO: 9618 - protein, 90 aa, Burkholderia phymatum
MDCRYLRYYNTQKGFAGYKGHVAGGTIGFDIGSDNYKDLVGIAYTKLDSKFKSNGSRSNTNIDSHIVTLYGQKELPKNFMIQAWYKIRPL

SEQ ID NO: 9619 - protein, 390 aa, Burkholderia phymatum
MKKILIASTALVAAGMITAGSASASEKIKLNLGGYSKWWVVGAWQDDSFEAATNTGTAGQGNANSVDVKGDNEIWFSGSTKLDNGLEVGINIELEAGGNTDSAGGGDQIDKSYVYVAGGFGKVIVGTESNGTVLMHTMAPDAAGNTGADGILTGGLAIARPSNVTAKVTTEIDTDAEADKITYVAPSFYGFTVGGSYVPNTAEDNQNVFNGTTTQTGSAANEIYGVAAMYAGTIVGVGVKASAGWVNYDVAQSTDRSNEYAFGTQLSYAGFTLGGSYRMVRENASGGVNSVANGNNASGDTWDIGLMYETGPWAVGAFYLNSTSNGVIATQGEDEFTVYQVSGKYNMGAGVDLLATIGHAEYDDELAKASNADANHNEGWAVMTGLSLQF

SEQ ID NO: 9620 - protein, 386 aa, Burkholderia phymatum
MKRIGVALPAIMIATAVHAQSSVTLYGKIEDGFNYTTNARGNDGYQMQSGYDYGSRWGLKGTEDLGAGYHAVFQLESGFDVNTGKMSQGGREFGRQAYVGIASDQYGTLTVGRQYDPSVDMFSPMTANGNWTGYLFSHPYDNDNTDYSFRVNNAIKYVTPTIHGFTAEGMYAFSNQAGGFSNNRLYGFGAQYQNGGLQIGASYLKLNNASSATVASANSSGAVTSDNTFNARSQQNIGIGINYTIGKALVGFAYSHVDVYDPTANAYFTGTTQPAGGTWNAWKFDNFEVSGLYHFTPALYLGACYTYTQASLSSTVGKFDPKWHQLSLKLNYDLSTRTSVFLEGAYQHAVSANTGTDFDFANIPGSADVSSGRNQMVYRLALLHMF

SEQ ID NO: 9621 - protein, 318 aa, Burkholderia phymatum
MSANAIQKKDNENLSALQQHAFAYVGAKLSVNHYQNACQSWAIDCDATDIAGGFYAGYQFNKYFALEAAYLNLGKVDAIYPINEAEKNFTGSMQGIEISALALYPLSNDFNAFAKAGVFNWQAKSEGGPLTQKDYGLSPTIGLGLSYQISKQWQARLEYQYFANIGSAEIGGANAHLSSLGISYQFKHEKRILSKPAPLEIVYLETIQSRILFDFAQTDLLLEHDLDIAITRLTTYKKATVVLTGYTDNTGKETFNLQLSKQRVQSIKKTLLDRGVQASQITEVYKGESDPIIGNDSREHRHLNRRVDILLPALNSNQ

SEQ ID NO: 9622 - protein, 798 aa, Burkholderia phymatum
MTTQQQAIFSFSAIALALSSSVAAQQNESANSKNGDQFEKIIVTGVPQKTTVMASSVSVSNISLDEIAISTPRSTAEAFRILPGIRSEATGGEGNANIAVRGLPVASGGAKFLQLQEDGLPVLQFGDIAFGNADIFMRLDNTVQSIESIRGGSASTLASDAPGGIINFISKTGESESGSISTTFGLDYDEYRTDFEYGGDLSDSMRFHVGGFLRQGEGPRDTGYTSNKGGQIKANITKEFKTGFIRVYYKHLDDKSVGYLPMPMHSDGSSLAGFDALSDTPHSAYFINTLSLGKNNEKRIGDMRDGMNPSVDSIGFVANFDLGNDWNIENRFKKSSVSGQFLSPFPAEVADRQSIATSIGGDNAILTYANGPSAGNTFNGDLAMRIHTFDVSMNDFGSIMNDLKLSKSLNENTTLTLGYFASSQSIDMSWLWNSYLMEVKGDNAALLNVVAEDGTSFSDNGLYAYGTPYWGNCCQRNYDVEYETRAPYLALSTRFDNVSIDASVRRDSGDATGTYAGAVTSTVDMNGDGIISKPEEAVAGIDNSHASIVNYDWSYNSYSLGANYQVTADQALFARLSKGGRANADRLLFGKVNADGSVSAQDAVDEVKQYELGIKQRFDSFKIFATAFFATTQEQNFEATSQRFFDREYEAKGLELEATYFIDSFDFRGNVTWTDATINKDALSPELEGNTPRRQADMIYSLMGRYNFAQGAVGVNLIGSTAAYAQDNNDLKFDGYTQVNAFASYDLSENLNLSLNVNNLFNTVGITEAEEGSIPGNDIIRARTLNGRTTSLTLKYSF

SEQ ID NO: 9623 - protein, 159 aa, Burkholderia phymatum
MKRIAFVGSVGAGKTTLFNALQGNYTLARKTQAVEFNDKGDIDTPGEYFNHPRWYHALITTLQDVDMLIYVHGANDPESRLPAGLLDIGVSKRQIAVISKTDMPDADVAATRKLLLETGFEEPMFELNSHDPQSVQQLVDYLASLTKQEEAGEKTHHSE

SEQ ID NO: 9624 - protein, 378 aa, Burkholderia phymatum
MKKITLALLTLPLLASAAHAQSSVTLYGFVDAGLVYVNNQSGHSNVQMVTGQTNGSRWGLRGSEDLGGGLKAIFTLENGFDPSNGKLLQNGREFGRQAFVGLSSDTWGAVTLGRQYDPMTELIGGIAATSMWAWLGTHPGDFDDLNSTFRVNNAMKYLSPTFYGLQASGMFAPGGVAGNFASSRIYTLGLKYENGPLSAALAYDNINNPSVSVLDSALSPGQAGYVTPGRSPVTSGYVSANVWQIFGAAASYRIGQGMVGIVYTNARFQDIRRTASTPNTGTAAFNSYEINGRYSITPALLIGASFDYTTARDAKYEQIDFGPNYSLSKRTDLNLVGVWQHASGVDSTGRPAVAAITTLGQSSTPTQVAVKLSLRHRF

SEQ ID NO: 9625 - protein, 214 aa, Burkholderia phymatum
MKTLSLRTRVTCSAIAACAMLGAFATPAAAADDAQGNWMVRLRGTYLDMANSSDPVGGVGPSDRITVNNKWIPEFDVTYFFTPNIAAELVLTVPQKQDVYLDGNKVGTFKHLPPTLLVQYHFIPNGTFRPYIGAGLNFTRIWGADIANNSLQLDSWSVGPALQIGMDYKLTKNWFLNADIKKIWLSSDVKAGDVKVSKVNLDPWLFSMGVGYRF

SEQ ID NO: 9626 - protein, 727 aa, Burkholderia phymatum
MKRVNRLSVLLASAATMTSVNAAQAGNEGVYELGTIHVTAAGANSSEFNNFGGSTISNQQTERFDKHTLDRAIDLVPGVAAGTTGSQRNETNIYVHGFDRLQVPLSIDGVRIYLPADNRIDFSRFLTDDISEIQIAKGYVSVLDGPGGLGGAINLVTKKPVRPIEGEWRSQAEFGNGGRFDGFRNYGRVGGKQNDYYFQASASWQKIDGWELPSSFTPTSIENGGRRDFSSSNDWSVNLKAGWTPNPEDEYSINFIRQNGEKGAPYNVEPTASQKYWSWPYWNVQILSAATKTAIGDDEYVKTRTFWETFDNAIDMWDDAAQTLRYSSSASRSIYQDWAVGNSIEVGKDFGRFDTLKFATHVRRDNHSEWNELYTDRYGLNGTTTPKSKTCATTKTANINCFDEPAQTSTEDTYSVATENTVHFGPDIDWVQGVSYDWRHLSKAEEYVLGQVNKSVYYEPYWINYRLTDSSALNWQTAAVWRYSETAKLFANISDRTRFPTLFERFSSRFGTGASNPDLAPERAINYQIGWTNAFAPKSQVSILGYYATVENMMQSVATGKSYTDPITGKVSAITQYQNVGDGHRYGVDFAVDYAFTPTLIAGGNISYIHNVLTNPIDPTIEQTGIPTVKGMVYATYSPIEGLSLTPNVTYADERWSQKTEVINNKTVSSYVKTGAYVLANFATEYKVRENFTVSGGVKNIFDRNYQLAWGYPEPGRTFYVGFKGTF

SEQ ID NO: 9627 - protein, 279 aa, Burkholderia phymatum
MKTIRLTLTLMLAALASFALPAHAQKKGDNVVSAGWFHIQTHGQSAPLTTTLLDVPINYPLGLPSSFTAPGSSISSSNANTLGLTFSHFVSDHIAITAVGGIPPEFKLYGHGELIPPGPAGALGRQSLGDPSLNPIVTKARQWSPAAMVQYHFLDPGTRFRPFLGLGVSYNFFTNIEVNPAFASSVNNNLGAILAAGAGIPGPTSVSADASSSWAPVFNIGGTYNFDEHWGLTAAVTYIPLKTTSTMTIKAADGTVLSTSKTKLEPNPLVFFLAASYKF

SEQ ID NO: 9628 - protein, 351 aa, Burkholderia phymatum
MSMNTNKNLISIALLSTLSITSLNALADSPTAYGRLDMTLTNSEHGFTTQNRKEGTVLENNFSHIGVKGSEKINDNFQLIYKMEVQVNGATNEGDDKLFSARNTYLGVESSAGTILIGRNDTVMKTSKGSVEAFALTNAAYNRMIAGQDRKADGITYYSSTIAGLFTVNGTYLMDDNYEESDETQYALSVVAGDKNLSKNRYYLAGAYNTIGGVDAYRGVGQIKMGQFKVGGLYQHSESQSYDRKEGDSYFVTVAYDLNGVNLKVEYGRDEAGFGKYFKYNSAVASSTDYKQATDVGITSLVFGADYQLSKSTMLQAHYAMYDGEYQIAKSGTVIDLEDDNIATVGVRFNF

SEQ ID NO: 9629 - protein, 396 aa, Burkholderia phymatum
MKKSLLALAALGAFAGVAHAQSSVTLYGIVDAGITFTNNVGLGSKAPGGYQQYALTSGVLQGSRFGLRGTEDLGGGLKALFVLENGFNVNNGTLGQGGLMFGRQAYVGLSSQFGTVTMGRQYDSVVDYVGPFEAGDQWGGYLAAHPGDIDNFNNAYRTNNTVKFTSTNYNGLTFGGTYSFGGQAGNFTANQIWSLGAGYANGPLQLGVGYLNARTPAASGGIFNNGGTTTAANAAVTTPIYQGFASANTYQVIGAGGAYTFGAATIGLTYSNIQFGNLGKTFASPFTGQKATFNNGEINFKYQLTPALLVGAAYDYTRGQQIEGNSRAQYHQGALGVDYFLSKRTDVYLIGVYQHALGETVNTAGQVVAATAGINGLTGSSTTNQVAARVGIRHKF

SEQ ID NO: 9630 - protein, 179 aa, Burkholderia phymatum
MKKLMYSLAMLTCVSSLVAEDIAINEKIIGVEIGSAQIEADTYGPFGEESHRSAYNVEYGLRLGAQNDTWRTLLIVNYFDSTDDDQKYYRGLGTFDYLLMQDSSFKPFIGVNIGYMNYKTSNPNGNNDENSFIYGGQAGVLFRVADEIELDLSYRYSLSSSEYVNNTGSILFGLNYIFK

SEQ ID NO: 9631 - protein, 436 aa, Burkholderia phymatum
MEDACTALSLCPKKPFCYITSGFIRSSRGYRHQKQPSARHNKFVILGDLLMKKSLLALVALSAFAGAAHAQSSVTLYGIIDEGFNINTNAGGKHLYNLSSGVLQGSRWGLRGTEDLGGGLKALFVLENGFDVNSGKLNQGGLEFGRQAYVGLSSSFGTVTLGRQYDSVVDFVGPLEAGDQWGGYIAAHPGDLDNFNNAYRVNNAVKFTSANYGGFTFGGLYSFGGVAGDFSRNQTWSLGAGYTNGPLVLGVGYLNARTPSTAGGLFGNNTTSSSPAAVTTPVYAGYASAHTYQVIGAGGAYSFGAATVGVTYSNIKFMNFASTVFPNQTATFNNAEINFKYQLTPTLLAGAAYDYTQGSKIAGASAAKYHQGSVGVDYFLSKRTDVYAIGVYQHASGNVIEADGNTVGPATAAINGLTPSSNRNQFTARVGIRHKF

SEQ ID NO: 9632 - protein, 653 aa, Burkholderia phymatum
MNKKIIAMSAMMVAAVSGIAQVDSTATKLDQVLISADSKFELTRKDSGKPVIKITRADIEAQSAASLADLLNQYAGIEMNGARSNAGQNLGYFVRGGSTRQVAFLINGAQVNDASNISNEFDIRLVDLNQIEEIEILKGAASTLYGANASTAVINIKLRKSPETGVRVTVASFIGTNKSVEQANNGPDEFTNSVQLQGTAKNGLTYGLGFNHQATNGGISAAEAADGASPNESDDFNRVNLLGRIGYDNKKNFKLSSYVSFDEYTAEFDDFSLVDANNETYSRQVRWGTNVNWKYSTKGEIVYTDVSTHTRRDNRSSFPSLYNADGYSLDLYNKYTFDLSETSSLKTIVGFNFRTDRYEDFSIPFGSSSFEQNADKDDVNAQIYDPYLNVVYISDFGLNVNAGARYNKHSNYDGQLVYNLNPSYRFNVGSSSFKVYGSYSTAYITPSLFQLYAAGFGNEELNPEENTTMEAGISWTKGKSTITVSAFQRDENNLVQFVTIDPVNFISQYQNVDEELTAKGVEVSGQTTLFDKLMLTANYSFTERNDQSLLRRIPKHKVNASARVQAISRGFVTLRYQYNDDRGDSFFNSNTFTNDAVVLSSYHTLDLDLTYGLKDIPATFFAGINNVTDTDFQELFGYQTRGRTYKIGMRYQF

SEQ ID NO: 9633 - protein, 996 aa, Burkholderia phymatum
MSSRSLHRTRRHRLSAALLAVLVAPAGHALAQSENGVAPDTTDLDKVTVTGSRIARTGFVTPSPVTAITAEEIRATGATTISDLMARMPALAPSYTLGNSTRFIGTAGLGLLDLRGMGVDRTLVLVNGRRHVGSSPGSTAVDVNTIPVEWVERVEVITGGASAVYGADAVAGVVNFILKKSFTGFETRAQTGLADEGNYNRSFASFSAGTDFAGGRGNIAVSGEYSKQDRFGRGNRAIGREYLVTVPNPAYDPTRPPSERNPQNVLSGPGGNHSTSYGGTFNLGTFDFRNPASYGNRYLFNEDGTFRRNRYDGTVVSNTSCVDCDFADLNAVADLQPGFDRKSVNTMVNFELSENHRLFFEGKYSETDSEFFGQPAFDSSLRVRRQNPYVSPELGALMDSRGATQILMNRFNVDAGRRGENIERKTYRAVLGAEGNFTDNWTYDVSANYGKTTVDRQNLNNRINERWQAGIDAARDASGNIVCRTTLDPTAINPNTNRVYSALAREGCVPFSVFGNGAVSPEAAAWFNTTARSQAKIQQTVFSASVANSNLLSLPAGDIGIAGGVEYRKEQSEEITDPLAASGVTFLNAIPNSGGEYTVREVFVESTIPLLAGLPGVDRLALDLAGRYSDYSSIGSTKTWNIGLDWTIIPSLRLRGTLAQAVRAPSIGELYDSQSENFATINDPCNYLSSNSNRPGTAGDVALRQANCSALGVPVGWIDTYTANRPGVSGGNPELKPERARSLSYGLVWQPEFFEGFGMSVDYWRIDLQDAIGSVTAETNATRCVDNPGGINNSFCGFVQRAPLGGFTDPQGRIYPEHSIIGWQALNENLARSRRVGVDLEMDYRFQLGEGNTVLRLVGTRLIQSREWVFQDFPEEYDEYVTYVTDPRWRAQFQTKYNWNEWRASWDMNYVDGNLRVTPESYNSNPGSASPIKNGSYTYHNFQFGYQFPGSKIDVYLGIDNAFDKDPPRNYFGSDFTSALYDNVGRFFYLGTTVKF

SEQ ID NO: 9634 - protein, 345 aa, Burkholderia phymatum
MKRSTRIQTIASLAALGWAGAAQAQSAAAQDPALDEIIVTAQKRSESVQDVPLAVSAVGGATLDRLGVGNPLQLGATVPNFNLQTNSGVTYIYLRGVGNNFLGLGIDSNVAYHANGVYIARPRAQVSSYFDVDRIEVVRGPQGDLYGRNATGGSINVITRKPTDAFSANATLSVGNYGLVQGEAGVGGAIVPGKVAVRAAGFFVDRGGYGKNEATGKDVDNRKEQAGRLTVELTPSEPLTIEIIADYFHANDAWGVVHQAGSGIPGALTLAESLGNFPSKIRNVVSGVDPNRKIRAWGVQGTATLDLADNMSLRSIAIAGSFCPCRADGRVSLSLASILRRSFSA

SEQ ID NO: 9635 - protein, 391 aa, Burkholderia phymatum
MKKSLLALAALGVFTGAHAQSSVTLYGVVDAGIAYTNNVGGQHNFFTSSGNLQGSRWGLRGKEDLGSGLTALFVLENGFNVFNGTLGQGGDMFGRQAYVGLSSSQFGTVTLGRQYDSVVDYTGPLEVGSQWGSYFAAHPADLDNMNNTNRVNNAIKFTSANYAGFTFGGLYSLGGNAGQFNRNQIWSVGAGYANGPLQLGAGYLNVKDPNYSFWGNNANSRSTTTTPSASNFPSSRVISGFASAHTLEVIAVAGAYTFGAATIGATYSNTQYKDVGTESGAGLNPVGYKGGSGKFHNAELNFKYQLTPSLLLGAAYDYTKGYGLSDAKYHQAMLGADYFLSKRTDVYVDGVYQHASGTDSTQHAAVANINQLSPSSTSNQVAAVVGIRHKF

SEQ ID NO: 9636 - protein, 284 aa, Burkholderia phymatum
MKMRYLSVLFGITLGSSSVVNAADVVVINKTEEEAPASSSVFTPADLSWTGVYLGGQISGFSSKVDIDRYSDNTWSSVEKSLLPEISGFSGGLYVGSNIDLGEGFILGVETDALWSNTGDKKTLPTKKVGAAHRLEAAERNREDEVVQERRVAAANNSAKAPEANVRMTGEYALRQQWIGATRARVGFAVERFMPYVTGGLAYGQLRGVNLLALATNNTENSEKEEKLMVGYAVGAGLDFAVSSNIFLRTEYRFSDLGKKKFANEKIEVNYKINDFRVGVAYKF

SEQ ID NO: 9637 - protein, 277 aa, Burkholderia phymatum
MKRALCLILGLFCALNAKGFKDVLTKGDYTFFNKKVVSPIKRYADRSAFYLGLGYQLGSIQRNSSNLNLFQNFTKTQIIFSDGLSPVFKNSYVSNGLGVQVGHKWVGKHEETKWFGFRWGLFYDLSASLYGLKESQSILISTYGTYMDLLFNAYNGDKFFAGFNLGIAFAGVYNKLSDALLYQTLLQDAFGGKVDPNGFQFLVDLGVRLGNERNQFGFGIKIPTYYFNHYYSMNNISNNSGDVLKVLRFLEYGINSVLYRVDFRRNYSVYFNYAYSF

SEQ ID NO: 9638 - protein, 707 aa, Burkholderia phymatum
MQRRRYAVRPHLGWGLVGMALFGAPELAAADEAPTFALEEAVVRAQAGERLRARSATSATLTDTPLKDVPQSVGVVTRAALDDFGATRLDTALDWVSGISRQNNLGGIADNFAIRGFAGDLNTGSDYLVNGFSANRANSVPVDTINIARIDVLKGPSAALYGRSDPGGIVNIVTRTPQFKPSREITLAAGSHDQYRLATELTGPLSERFAYRLGVAAENNHSFRDFSTSRRYAIAPSFTWLPTDDTVVTYAFEAAQLKAPFDRGVVAINKQLGALPNSRFLGEPGDGDTTVRTQSHQLTVEHQLGSGWKVDAGLSYRTSHLFGKSSDASRLLDDGRTLWRQARERDYRANDLAGRVDVQGDVTSGPVKHTLVAGADFYDFRYDTVMYRANPSASAPYAIDIFDPVYGQPRPAMRLNSSTRESQRGFGAFVQDQVTLTPHWKLLAGVRADRFLQHADNRLTGVRVAQQQTAYSPRLGLVYQPTQTLSLYANTSRSFRPNTGVGAQGNAFAPERGRGYEVGAKLETADGRFGGTLALYSIDKANVLTGDPRDPAFQRTAGAVRSRGVELDVSGQLTANLKVLGTYAYTDARVTADTVLPSGAPLSNIPRHSASVLGLYEFGAGSLGRAGVGGGVIYVGERAGNSTDNGFKLPAYATVRLNGYVQPTRALRLSLTIDNLFDKRYYASSYNELWVAPGAERQVTLAATYTF

SEQ ID NO: 9639 - protein, 682 aa, Burkholderia phymatum
MKKSLLMACSAALALHAQVFQLGEVEIIANKDGSKSSDNNVAVITQEDMQRNEIKRLSEVAQMTPGVYVDKKGPRAEQNFYVRGFDARRVPLFIDGIPVYIPYDGNVDFGRFTTFDLSRIDISKGSSSVLYGMNTMGGAINLITKKPTKELEGSIGYGFETGKNAKTYGNNIDFNIGSKQELFYVQAGGSYMEDMGQQLSHKFTTDVNKNEDGGRRENSVQRDKKFNIKFGFTPNDTDEYAISYINQKGEKEQPYYAGRYLGYNQASRYWDWPKWDRESLYFLSHTDFGAVYLNTKIFHDTFKNTLYSFNNKEKTIWELDRNNKISSNSRSNYKDTAYGFGMEVGGDIGDNDTLKFATNYKHDKHKGAKYQEPEELMKDKSYSFGLENTYRFSNMTRLIVGASYEVRDGISAKAWATYPVPNSNNTVQRMENYDTSKEHAFNYQAAIKHSFDGSDELSISYAKKSYFPSMKERYSTRFNRYISNPYLKPEIANHYELGYQRNFSDTLRLETAVFYSKVKDAIGDINTGLYAGTGRRRTELKKSVNIEKAEYKGFELGATYFATSNLELGGNYTYMSAKYKNTDDSRVYDIPKHKGFAYVDFKFMPKFSVYMSQELVSSRWSNSKEVTKLGGFGVTNLKFTYKPTENLSIDAGVLNLFDRNYEYREGYPEEGRVFFSNVRYKF

SEQ ID NO: 9640 - protein, 2715 aa, Burkholderia phymatum
MKYGLLLILIGSLASPLSASTIDFESGVSGAGTQTITTTVDGITLTAVSNDDTWIVAHNSGNAGTIANVAAVDQSTGASLITISFSAPVNLTSIHTSDISQTINSLTFTPTDGSGNSAFTDNNGGSTWGNNVNGNNISFTSWSNPSSSFTITGSTSAGNVMLLIMDNIIFTAAPTNTAPTLTNINGDSFTYTEGDGTQIIDQGTVASVSDADGGNFDGGNLTLTITSGEDAAEDILSIDTNGTVSLAGTTAGSNVAITGPGTIGTLANNIAAGNDFVINLNASATPAHVQTLVQALTYQNSDTDNPTAGARNVRLTINDGDGGTSSNADITVTVAAVNDNPTLLNLAGDNLNYSEGDGKQNIDISANATVTDVDSVNLSSGTLTVTIPTNKDASEDILGFDNTVTTTGLASASITISATNIGTLTNAISEGNDLIVTFNSNATPALVQSLIRAITYENSDNLTPTENTRTVRAVLTDGDGGSSGNIDTSVVVSQVNDLPVSSNNTLTPNEGDVLTIAASDFAFSDPEGDTLNHITIITAPVNGSLWLDLDASGSINNAESTLTNSATVTKANLDANQLKYIPNGDTSSSFTFSVNDGISDSISSYTISLTVNAQPTVTVNQGSGQNDPTNNATVVFDVIFNESISGFDVTDINLSGGVTASVTSVSASSGTSFTVITNISANEGDIIAQVLAGGVTDAFGATNQASTSTDNNIKYDITAPATPTALDMSTSSDTGSSDSDDITSDQTPEVSGNGETGATLTLFSDTDDDGVLDGGEVSITTSVSSGAWSTSMPSLTSTNHSLKAFQTDAAGNDSPVSTALSIEVDTNAPSGHSVSITQNPVNSSNEDAVSFTFTAGEIASLYAYTISSSGGGTAVTGNGSLATATDTIDNIDVSSLGDGTLTLSLVLTDIAGNSASAVNDSSTKDSTAPTGHSVSIDQGIILESNDNAVSFTFTGAEVGANFSYTLSSGGDSVNGSGTIASASDQISNIDVTSLSDGTLTLSVVVTDINGNSATAVTDTVTKDALGPVVQSVTLNTGHLKAGETITATVQLDDTVILSGTNATATLLIGGASRTAVYTSGHSSSNLTFSYDVISGDNDSDGVTVTSVQSNSDTAQDANGNLADFSFTALTEANLLIDTQAPAPATPQQSSQTLNADSISLTQTDYPEDGITIVALSDSDANGIADSNTPLASSSTNSGSWSLTLNLNQDSDNHFVLRSQDTAGNISDMAIGSFLEDSIAPDNAVILSPTSPIYQSTTAITIEGSQSENGISVGLYQDADNNGIADNNTEIASSTVTANSWNISLTLTDNTETNYVVIAKDSAGNSAQAVDLVSLTHDNIAPSADITSVTSVDTTPSLTGSVTDAGGIASLSFTLEADDSTIFGPFDVDSFSDIYNGNWLDNELADSLNEGSYDAHLSPVDLAGNTQVITISNAVTIDTSAPANYEVEIEQAYIDANNESALSFIITGGVSGESYVYQISDGSNSITGSGSISSDPQTVNGVDVSSLNEGTLTLTLSLTDEAGNQGAEATDGVHKAYNFTPVITGVPASSVDEDSLYSFTPTLLDTDNGDTHHFTISNKPSWASFNSANGNLSGTPTNDDVGINSNIIISVTDSTAASASLPAFSIEVLNINDTPTLSSTQFEALEDTELVFSLDAKDDEGDELTISLVNQPQQGSLDTSGAKWTYQANENFHGDDNFTVTVSDQQSSSNPIKVSIKILPVNDAPKAQDDTFELDYTPSGEYRLPVLANDEDIDEDTLSLISAESSLGNVEIENEQLLLTLSSGMTGDINLSYLIVDPDGESSQAQVNLQITPNNEALPTLTVPEAVSVQAQGLFTRVDLGVATAFDSEGEPLPVSLKYGQPLFQPGRHLVYWETTDNNGNTKIASQQVDVYPLVNFHKDQFVVEGGTASVTLSLNGDSPQYPVMIDFSVAGDAKLNEDYSLSSQQAIIRSGRDVTLEIEIFEDGIDEQDEKLKLVLDEAVNSGYKPSHTMHIVNRNIAPEISLAITQAKEPRLLISQDGGEVTLTASYSDSNPHDQLTINWELSHLVLEDLDTSEGIIRFDPTNVELGDYTIKVQVSDGQKRTQVTRRLTLVANLPLLDNTDSDGDMIPDNVEGFGDDDLDGIANFQDALPSCNVQPENEDEQVQYLIEGEAGVCIKLGSLAVGGERNTLLLDKEDPLPQDSEFSFTGGVFDFIASGLPIQGNQYRIVLPLTKAIPSGAVYRKYNESQGWYEFVEDDSNHIHSTSGEPGFCPSPGASSWQTGLIEGAWCIQLTIVDGGPNDDDGEANFHISDPGGVATLTTTNLSPNAADDVVELIETSLLLLDPTLNDSDPEGDLIELQSVQGRLGAASINHTGLLQYQAPVGYLGDDEVLYTVVDAQGNSATARVLITVKANEAPVTNEDHASTDDKTSIIVDVLANDIDDQEITLSFVTAKVGQVSITSDNKIQYIPQLGFEGEDRVLYGIEDQLGAEMEGVLTVTVDAYQEIKINNESSGGSVSVFTAALLLVLGLIRRGKQIAQILLASLVLCSTAQATWFADIQTGYSRTSAEVDINKLEAAGMQVSQFSSDNSDWSWGLGFGYQFNPNWHINLGYQHLGDYQFTAKGIALDPAPSIKIAENLGPRSATGIDLGISYLWQFSEPVGLKLGGGVWFWQSDFNSLINQELVESDENGSDLFSDVSLYWKINPQWQLALGWQHFVIKDDKIDNGFMRLSYQF

SEQ ID NO: 9641 - protein, 385 aa, Burkholderia phymatum
MKKNRIAAAAFTALASLAASPAFAQSSVTLYGVLDEGIDYTNNAGHGAVWEMASGYAQGSRWGMKGSEDLGGGLKAVFQLENGFDVSSGRLGQGGRMFGRQAYVGLSDGRFGTVTLGRQYDSVVDYLAQTTANGNWAGYLFAHPYDNDNTDNSFRLGNSVKYASPEMAGFQFGGAYAFSNDTNFANNRAYSFGGQYANGGLLIAAAYMQADNPGVGSTGAITANDASFIAGRMRVYGGGINYTFGSATAGFAYTNSNYKNPTGNGYIGIPLAAPGVTLNTLKYQNFELNGKYQFTPAFFVGAQYVYTMENYDASSGSVKPKIHSVGLMADYDLSRRIDVYVQGEYQKVAGDSTHSILDDAFIPGVQAPSSTGTQVAVRVALRHKF

SEQ ID NO: 9642 - protein, 776 aa, Burkholderia phymatum
MNEKVKYNNYSNSIIVLSLLFNAPVFSEESDKKEKSQTLEVITVTAQKRVESLQETPIAVTAFTADGLEKMQVGNIAEIENFTPNLVFDTSSPIGGSSTSAAVFIRGIGNTDFSLTTDPGVGTYIDGVYVSRSIGGVLDLLDVERIEVLRGPQGTLFGRNSIGGAINITTRKPYDELAGRLDLTLGSFNRTDVRGSIDIPFTDELLSTFAFSSKRRDGFVERPLIGDELGNEDQLAFRGALYYEPNDEWNFQLSFDHSDIDEESAANVAVGFTPGAGTIGWALATYPTLSPDAAIVAGLKDLDKYITKDDKDVSYGTYNNGSSATVDGASFVANTHQDNFDLKYTAAYRRTKAAFHADADNTPFQITEISNPDYYHKQISHELQFLGTAMDDQIKYIAGVYYFDESGTDNVFVPLHLPTPDLSAGFPAGLNNYADVENSSLAEYLQATWDINDTFSVTAGVRHTLDKKQFDYTQYLAADIQGNPLPFFPGAVDETGTFRPGLSPLVGNGSGSISDNFEQTTFKLGVDAILDDGTLLYYSFSQGFKSGGFVLRYVESVAAPRTFEPETLDAHEIGIKWQSDNERIRVNGAVFYSDYQDAQVTFFDKLGGPITANAGEIDIKGVELEITALITDDLILDIGYGYIDAAYNNINPVEGLSLTLDKSAKLVNTPENSLHIGLDYSLYFDESDIAFRVDYAYTDDVFNDSQNSKFLFQEAHDMFNASIRYNLNESVGFVAFVNNLTDKRVIKSGNSNFGLGFHSASYNKPREFGLAVKYTF

SEQ ID NO: 9643 - protein, 359 aa, Burkholderia phymatum
MSFNIAKRTLLSSIIAASSVSTLALAQQQEGFTITPSIGYYNMDSDRDIKDDKAYSLGLGYQFNNPWAVEFVYLNADSKQAGNNVDVDQYRLDGLYHLPTISNVNLTPYLAAGVGTTDFSNASGHDNVQVNAGGGLKYALNDTVSLRADFRLVNDVEDHHLDNVTSLGVQMTFGGSSRNSTSNDDDYTPVEQTSYTQVEPAAQPQQATQPEVISSEPAEQVQEEPITASPMAEETTQQPEIVAEPPGKINIQFGLNKTNVEQKFYPEIEKIAIFLKENPGSTVMIEGHTDNSGAASYNQKLSEKRAKAIAEVLTNTFEISATRVEAIGYGEERPFVENDTEAHREANRRVVAIISTSEV

SEQ ID NO: 9644 - protein, 634 aa, Burkholderia phymatum
MKRSRQKYAVALGLILAVCGSAMAEEKTTQLGEVVVTATRDEVPIEQVGSSITVVTAKEIEQQQKRTVADALRMVPGLDLVRTDSFGGTTAVFMRGAKSEHTLVLIDGIQINDPSSTGGGYNFSNLTTDNIERIEILRGPQSTLYGSHAIGGVINIITKRGDGKLKGFLSAEGGSFATARESAGLNGGNDLLQYSLSVSRLDTGGVSAAGERYGNVERDGYQNTAVAGRLGITPTTNSEIDLTLRYDRSRTSVDNGGGAGKDDPNHVMKSDELFFRTQGWLSLFNGLWDQKLGVSFSDISWRDDNDRDSAHPNDLLRSSFHGQSVKLDWQHTLKLHKTTTLVVGAETTEENGKSDYYSESMFGPYTSTWDERFARTTGVYLQDQLNLFDAWFSTLGVRVDDHSKFGTEATYRFTTAYLIKQTDTRLKGSYGTGFKAPSLYQLYSSYGSPDLKPDKSIGWDVGVEQGLPFMKTTLGATWFRNEYSQMIDFDMTTWKYTNVAKAHTHGLELTAALQPVDDLTLKAAYTYLETRDDISGKQLVRRPKNKASFDINYSFLKKANINLGVIYVGTRYADTANTQKMKDYMLVNLAGSYDLTKNLQLFGRVDNLFDRQYEEVAGYGTPGIGAYGGVKVSF

SEQ ID NO: 9645 - protein, 369 aa, Burkholderia phymatum
MKKTLIAFAALSAIAGMAQAQSSVTLYGLVDAYVGQTSKEVTSTIPGVASAKLKQTAVNGSGQNNSRWGLKGTEDLGGGMKALFVLEGGFQPDTGANATISNQGGGLFGRQAWVGLSSGFGTVSLGRQYTAYDALRGATNMIYDSNFATTSTVWGTGIADYQNRASNSVAYTSPDFAGFSGSVVYGAGENKTATTDAESNTSLMIKYANGPLLVGFAHQREKQVASTVGNYFGSGATVGVAAGPVAFSSTRKYNLLGASYDFGVAKVTGQYNEAKGEIGLTTSAKDKEFDVGVSVPFGAAAVAAGYSRSKSDASNNTHNKGTGVSLLGTYALSKRTNLYTGFLVTKVQSSNAATETKASTFGLGVKHLF

SEQ ID NO: 9646 - protein, 1036 aa, Burkholderia phymatum
MKVKLFFACAIFLVFSGLSYAQQTKTISGTITGADQVPLPGAEVKVDGKEIFDVTDFDGNFTLENVEVGDVFRVTFLGFSPQNVEITSSSNYSVILEEDAGQLDEVLVVGYGSQSRSDITGAIASVKSEDIVKQPALTATQAVQGKVAGVNIIANDAPGSTPTVLVRGLGTAEGGRDPFYVVDGQPVQDIKNISPNDIESIEFLKGASYANIYGIRAANGVILITTKRGKGKPTFSFDTYYGIRTVLNQVEMASASQYIEYFNEESAASGGFQLQQNQPFETDWYDELLQNGTITNNSFSVSGSGENIDYFLSYNYYDEEGILEESNYSRGTIRNNNTYHLFDDRFRIIQNLNISYTDESPKPFGSFSNAYRQSPLVPVFYPNGRYGQSYVNQTTGIVNYIGEEGESVGRLNSHGNPVADVFFADDEINTTTLQGQITAELDLTDYLTLTTRFGATQFYYKRYSYNPTRERWLNADPRRTLEQFQQGRIDEDGDGSISTEFANNSYEVRDENFFRWNLEGFLTFEKSFGNHNIDATVGVSRENFGGREFLEAQAFDVFEERRLREISRRTANFFDNTVTQEFSQSTNLQSYFARMEYNFDKKYYLRAVVRRDGSSNFITGDNYFATFPAFSVGWTVTNEEFLKNNDVLNYFKLFAGWGEIGNANVPINIQQVNSGEGSRNTNYVFGPSQSLILGAAFGSPVETLEWETTEEWEVGFDYSLFDRRLSGTIDYYQRTNTNAIIEVTPLLNSAAEGNFLAQAAEVVNEGFEFLVNWSDDINDDFSYNIGVNLSTNENTVQNVREAFDGQIGGSLGNGQITKRLKEGEPLFAWWMYEADGVWQTQQEIDNNASVGNAAPGHLRYVDQNDDGVIDDRDKKYFGSYIPTLNYGVSLGASYKKFDFSVDGYGVGGNKVYNGLKNTRLGGENISEEVFNNRWTGPGSTNSAPGADRDALASSYYLEDGDFFRINNMTVGYTLKDMSIVNSARIYFTLQNPFMFTDYSGFTPELNQNGNPKQTTGIELSAYPTTRSFIIGANFQL

SEQ ID NO: 9647 - protein, 700 aa, Burkholderia phymatum
MKGRRAHYLAAAAPLVLVLAGTSAGATDTLTSPQVSSLTVVAPQDDAYKVERTGTATRTDTPLANVPQSVTIITDEAIRDQSMRSIADVVRYVPGVTSGQGEGHRDAPTLRGNSTTADFFVDGVRDDVQYFRDLYNVERVEVLKGANAMIFGRGGGGGIINRVMKKANWATERQAAVELGSYSLRRFTADVGQPLAGGFSGRIVGVHENAESYRDFVEVERWGLNPSIGWRDDRLTVVASYEHFEDDRTVDRGIPSQAGRPSAARRSAFFGDPDQSFAATRVDLLNLAVEYQLTPDLVVRNRTLWGDYDKFYQNVYPSGAVGSNGMVNLAAYNSRSDRENLFNQTDLVLKADVAGLNHTLLMGAELGRQVSDNVRLTGFFNSTSLNMPVSLASPTRGGVPIAYRPNGSDANNHVVANAAALYMQDQVEITPELQLVLGLRYDSFDLDYRDNRSPARFSRKDKLWSPRFGLVYKPVGALSLYASYSVSYLPSSGEQFSSLTASTAGFEPEEFKNYEVGLKWQPSPVVILTAALYQLDRTNTTSPDPANPNRLLLTGEQRSQGFEASITGQVTSRWQVLGGYAYQEAEITRTTAAAPRGRQVPLVPEHSFSLWNKVELTPMFSVGLGVIHQTDVYTSISNAVKLPSFTRADAALFVRLQERLEAQLNVENVFDKDYFPTSHGDNNILPGAPRSVRVGLRTSF

SEQ ID NO: 9648 - protein, 703 aa, Burkholderia phymatum
MVVKNSRWATGLAVALMGLPCVGNVSAQEVDLPATTASGQRQASGYRARESSLATRTDADLMEIPFAVSSVNAELIRTVAAGRGDDLYDWVAGVARQNSFGGLWDHYAVRGFAGDGNWAGTDYLLNGFSWNRGNSVPRDTATLERMEVLKGPASALYGRGDPGGIISYTTKQPQFKSANTVSVSAGSYGATRETLDSTGPLSDTLAYRLNLMHEDNGSFRDTVSSKRYLVAPGFTWKAGPDTIVHYEMEAARQSAPLDRGVVAVNNQLGAIPASRFLGEPRDGDYEVRNLGHQLTVDHHIDADWSVNAGVAQRETDLYGRSSEALALQADGRTLWRRYRHVDFHTNDLQGRLELTGKLQTGAVGHTLVMGADAYRFTYDQLVERSTPTAAAPYAIDIFNPVYGQATPALRTVTNALERDEGQGAYVQDTLALGERWKVIAGLRWDGYRQSIEDRKSGTTTSQQQTAFSPRLGVVYQWSPAFSVYANTAYSFRPNSGTDVNGNAFDPEKGRGYEVGAKWAGPGWLATVAAFSVTKRNVLSADPANDGFSRAAGEVRSRGVELEWNGELGGGFRGIANLAYVDAEVTRDTVLTPGARLVNIPRVNGSAMLMYEFAPCFAQKAGVGAGVVYVGRRAGNTADTQDGFQLPAYATVQLNGYVQIDKHLRASVVLNNLFNRTYYASSYNSVWVTPGAPRSILGTLSYSF

SEQ ID NO: 9649 - protein, 367 aa, Yersinia pseudotuberculosis
MMKRNILAVVIPALLAAGAANAAEIYNKDGNKLDLYGKVDARHQFSKNTGEDGDESYVRFGFKGQTQITDQLTGYGQWEYNVQADVSEAEGTSGSKTRVGFAGLKFADYGAFDYGRNYGVGYDPLAWTDILPVFGGDSGYSDNGMVGRSNGLATYRNSNFFGLVDGLDFALQYQGKNEESENGRQIKKANGDGWGTSVTYTTPVGVAVSAAYTKSDRTNGQRDAYFANGSKTAETWSTAVKYDANNVYLAAMYGETRNNTYIDGTFGDTKLNGAVNKEQKFEAVAQYQFDFGLRPSLGYVQSVGKKIENVGKQDLYKYIDVATYYYFNKNMSTYVDYKINLLDANDFTRATGTSTDNTVGVGLVYQF

SEQ ID NO: 9650 - protein, 830 aa, Yersinia pseudotuberculosis
MDNIIRDKKTIISVNKITTCILFALVTQSYSGQLAANTATIPTNNNDMALDKLNVEGKGNAHDSDWIYDEPRSVSEITREQLDNRPARHAADILEQTPGVYSSVSQQDPGLSINIRGIQDYGRVNMNIDGMRQNFMKSGHGQRNGSMYIDPEILSNVVIERGIFNGIGGAGAIGGIATFNTINASDFLAPDKELGGHIRAMTGDNGTRFIGSGALALGNSNGDILLAVSERNLKDYWPGKKGVLAGLRLYSPTRNVGDDLKNTKTLFTGYKMRSQLAKVGWNFEAGQRLEFSYLQTQIASPNASMLSEVLALSPSGKEITKIGWRNTSFTNVENRNIALDYRLNPEHISWLDATAKIYYVDTNDETDNANSLFKEYFWTQTRLKTRGLQLQNTNTFTPSDAHQIRLKYGLEWFSDKSEGYSTRKLIERTTPPGKRAITSTFAQLNYEYDDWLRLEGGLRYDQFRLKGNTWLHTRSFLQPYTFENPCDRRIHEQSEKPGSRCSSRRPATMRWDVDRREQQLSPTLAMGVKPGLEWLEFFGSYGKSWRPPAMTEVLATGTAHGYSWVLPNPFVAAERARTWEAGFNIQQSNLFIEDDHFAAKVAYFDTRIANYINLELGKAKPKFGGDSFTDVAYVNNLLKTRFRGLEYQLSYDAGTFYTNINYTRMIGVNNVCSPYAWLGGLQSVKYKYVGKVEQIYAVENEVANNYVTCMNANVLFGSSAYLPGDRGSLTLGSRIFDRRLDFGTVIRYNKGYQDRSAQDENGNPLTAYVADWPKYIVYDLYASYKVTNNLILRSSIENITNRAYLVNYGDTLSFAPSRGRTIQGGFEYKF

SEQ ID NO: 9651 - protein, 753 aa, Yersinia pseudotuberculosis
MRILEKNHGKSRVRFNCTHTIKPAAWVLAANVSLLGCAYAATDENNSQKKERENNPANTTITVTASPLRHAGVTEDSGSYNTSSMSTATGLNISARETPQSVSVMTKQRMRDQNLNSVESAVNNITGISVRQFDSDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLGLGWNRQRQNIDNDYYLATCNATRTCPDLGDFTLPGWQYPKPVWSDKRAYGSKGRSDQSSQYVVTQLSLIDPLTLILGGRLTTWETRGDNFGTPQNARYKNEFVPYSGLTYDINHDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLNDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 9652 - protein, 768 aa, Yersinia pseudotuberculosis
MGINTMNQSLSINTEPKRSAPRLLCVMIGVALGSLSASSWSAAVANSTKTASAVAETNSAESSNKADTITVVGTPDTFRAGGNDLIPTYLDGQVANGGRIGFLGQQDARNVPFNIIGYTSKMIEDQQAATIADVVKNDASVQNVRGYGNPSQNYRIRGFNLDGDDISFGGLFGVLPRQIVSTSMVERVEVFKGANAFINGISPSGSGVGGMINLEPKRAGDTPLTRVTVDYGSAAQVGGGLDVGRRYGDNDQYGVRVNVLHREGETAIKDEKNRLTAVSTGLDYRSDRARTSLDVGYQKQTIHHMRTTVGVGAVTVIPEPPSTTLNYGQPWVYTDLETTFGMLRSEYDVSQNWTVYGSIGASHNEETGQYGSPILTDNSGNATISRLYVPYISESIAGLGGIRGHFDTGFITHKVNLGYATNYRTTKSAFNMSESINTNIYNPGVIPFPPTSTNPNFYSPNQDPTLTSQVRASGFSLSDTLSMMDDKVQLMLGVRRQDVTIRNFNNGVPNSAGSLDAMKVTPIYGVLVRPWEKVSLYANHIEALGPGKSAPYSYSNASGVTTPVANAGQIPGIVHSKQNEVGVKFDNQRYGGTLALFEITRPTGTVDPATNTYGFYGEQRNRGVELNVFGEPVLGTRLLGSAVWLDPKLTKTQNGTNNGNYAVGVARYQLVFGGEYDIPSVEGLTATGTLTRSGSQYANDANTLKIKPWTRLDLGVRYTMPMKETNLIWRANLENVTNERYWESIEDSGVYLYQGDPRTLKLSVSMDF

SEQ ID NO: 9653 - protein, 714 aa, Yersinia pseudotuberculosis
MNKINMFMLSTFMRSMFMRSTLIPSTFILSTLLLPAVVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGTRYVGKRAGDAANSFWLDNYTVADAFVAWKMPLSGYQLKWQLNVKNLFDKTYYPSSANNLRIAIGEPRQVVLQGSIDF

SEQ ID NO: 9654 - protein, 183 aa, Yersinia pseudotuberculosis
MKNKTTLAAFITAFLLSSSAAYAAGDRTISLGYAQGDVRLGDGNRKDIRLDDDLKGINVKYLHKLSEMFGAIGSFTYTDLNYDYLNNNVKIGDASFDYYSLMVGPSVHFNEFFSMYALLGIGHGKAKTSVLGYGKKEEQDSLAYGVGMQFNPLNNIAIDASYEYTKLKDANIGTWVLGIGYRF

SEQ ID NO: 9655 - protein, 726 aa, Yersinia pseudotuberculosis
MKHKHLWVLNPCLLVMLTPAAWAEDQLVVSANRSHRSVAEMAQTTWVIEGQELEQQVQGGLEIKDILAQLIPGIDVSSQGRTNYGMNMRGRSIMVMIDGVRLNSSRSDSRQLDSIDPFNIAHIEVISGATSLYGGGSTGGLINIVTKKGQEGKQVELQIGGKTGFNSHNDHDENISAAMSGGTERAFGRFSVSYQRYGGWYDGKGNEVLIDNTQTGLQYSNRLDVMGTGTLNIDENQQLQLTTQYFNSESDGKHGLYLGQNFSAVTGTGQASNSAALNSDRIPGTERHLINLQYSNTDFWGQDLVAQVYYRDESLTFYPFPTLKDGKVSTIGASQQKTDFYGSKLTLNSEPIDSLTLTYGIDLEHESFNANQQFFNLAKAQQSGGMTLENAYNVGRYPSYTTTNLAPFLQTRYDINPIFTLSGGVRYQYTENKVDDFVGYAQQQAIASGSATSADPVPGGKTDYNNFLFNAGLLAHLTESQQTWFNFSQGFEIPDLAKYYGSGSYTLVNGHYQLQNSVNVNDSKLEGIKVDSYELGWRYTGDNLRTQMAGYYSLSDQTISINKTDMTINVLPDKRRIYGVEGAVDYFFDNSEWSAGATFNLIKSETKVSGKWQKLTIDAASPSKATAYIGWAPGDWNLRVQSQQTFDVSDSKGDKIDGYNTIDFLSSYALPVGKLSFSIENLLDKEYTTVWGQRAPILYSPTYGSPNLYSYKGRGRTFGVNYSVLF

SEQ ID NO: 9656 - protein, 1256 aa, Yersinia pseudotuberculosis
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYANTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGTGDAVFDLTRIDNREEAILDGDPNRITGFGTLTKTNSSIWTLTGSNMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 9657 - protein, 1254 aa, Yersinia pseudotuberculosis
MYIQFREPISTSPAQPDAGHRHLFSCAPAAAINPITLAIIVAFSALVLPQTARASCNSSGGGTYVCEGENHAGIILSGTDIAVETQPGFSITEPGGADPALSLIGSGAISYLDTNRSALDTTGADSLYIQNDTSMAGQSTSINIQSNSSIGSGININNRSGADAAIQIDLSGTLSGNQNGSAALSIHSSAEGNSAFILNLDALSGSMGLQSYNDSRSGIATTNINIVNDINVEYSGASINNTGNGETSIINFNSKNITTEFDGLNVYNTNYAGAAITNINIDGDIRSANSQAATFYNSAYEGPSSLRLRANHVTGEYAGLYISNDSRKSSAITDILLTGDLTSTSGAGLVFNSYVEEDDIGASIKLNNIYSYYEALSLSANTLNGDMQFDLDISGDIVNEYGTGILMMGMASEGNSTIIINANNINSGSQSLKVNNYSHLGTAVSDITATGHLVSEQGVGAIFSTYVSQGDAIAVINLNDITAAGSSVEIDTIASEGNSITYLTVTGQINASNGEGITLSSQATDGSTLVNIDVNNIASEYDAIYLHNSVTGVDNGTSTIDLITRGALVSQQGYGINIETNTADTYVTVGGLVHGGNGTAIGIHRLENVQTSATLELQSGYALEGVTQALVFTGSYAEINDAALDLANSHLVLGGTGDAVFDLTRIDNREEAILDGDPNRITGFGTLTKTNNSIWTLTGSNMADGDANAFLSANIAGGILVLDNATLGLTPATTILNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTRNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDKRQSVGLGAGGTYEWQNGRYAVYGNVNLLGATRNVSDNYAVGGTIGARVSW

SEQ ID NO: 9658 - protein, 690 aa, Yersinia pseudotuberculosis
MMVFYRKFFTVTVLISLPCLAWSQSHNNSKDELDTITVVAQKINQQQQKTPISISVLTGFDLERENIENIYESIMRIPNVYMVKAGNPSDAGFFTMRGTTPGMEGIQSVGFFIDGVYANTFDTELLDVDRIEVLRGPQATLYGRNTESGVINVITKDPEFSPEYKIGLSYGNYNRTQVTTVLGGSINDSEQFSYRAALKYLYGNGYFKRDYDGKNNVDNLNDFSGRFKLRWQPMDDGWDVMTTFDIQNRRNGNTSFTALDKIKSGQKYVDSNYIGKSDVDAYKGQVNAVYTFDDIDFTSVSAYVDERKVDNQDLDFTRLSISELLMNRKTKQFSQEFRLNSKYSGPFNWLIGSYYFYQDDENEIDFRYLPYNLAQLRKSDIKTNNYAVFGNVNYYLLNDVELVAGARYDYEKKKLNFLMDNGFNPYQPYSHDNNSNSFGAFLPKVGLNYYITGDAMLYTSIARGYKSGGFNTLGPQSSRAYNAEYMTTYEAGVKTEWFDRTVRWNTSLFWNDMKDQQVEVAYYPISYSVNSGKSLSRGLESELAWRITRGLTVSANVGYTDAYFKNFPTEIKVDNNYIPVNYKGNRPANSPGYTYSIGADYNFLNGYFVNATYNVKGSTYLDNANSKKQPAYGLLDLTAGYENKDYGVNVWIKNILDETYVTRAFKMDDGIWYGRAGEPINFGVNFNVKF

SEQ ID NO: 9659 - protein, 3706 aa, Yersinia pseudotuberculosis
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASSIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLNASNLIINVANTLGTALQITDGIDNTTTIGNEIQLNAENATAINFLGSSSKTLNNKGTIKGSVIFAGVADHIINNNGTLDGTLTTGAGNDTLVLDSSSQSNDVINLGDGNNSVTIQNGATVSSIITGNGNDTFTINGMSVGSRTYLGSLDAGTGLNTLNFNASTDELAAATSLQGFTNINLVDSHITLVSDDNIGSGMVNIDSSSELLFGSTFDGILHATLGTGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDVDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTAGGSSTVAGGLTGAGTLNINGGNLAVSAANSGLSGQTHIADVASVTLTDTGTLGTSAVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNTVKVDIADATLNLNDIALFDHVLTGNGTLNVAKNLASTAFDFGSTVGGAFSGIVNLTNTTFALSADNAAALARATLKLSDDSVTTVGTTDRTLHGLDLNGGTLIFDGSPPQSQANGVVTVTDLALNSGTVSITGVGNWENESPVTSPNVSILEQDRAGTTLELINATNVTGDVDALGLMINGTAITADSQGVQSAIQQGGTTVANAIHNYGLASSNGNGGSGLYVNYTLSALELLADGANALLLATESGLTANRVLNAELFGVGGLVVDAQNGALTLANGSNRYEGTTTVTAGELILGANGAFGQTSLLDIASGASVNINGYRQTVGAVTNTGTVTLGSGGVLTSGLLTNGGGLDLTGGTLNLTAGGASTVAGGLTGAGTLNINGGNLSVSATNSGLSGQTHIADVASVTLTGTGTLGTSAVEVLGTLNLNGANAAMTNVLSGGGVINTNAAVTLSGNNSFSGAHQIGTDGALTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVGNAVTIDIADATLNLNDIALFDHVLTGNGTLNVAKNLASTAFDFGSTVGGAFSGIVNLTNTTFALSADNAAALARATLKLSDDSVTTVGTTDRTLHGLDLNGGTLIFDGSPPQSQANGVVTVTDLALNSGTISITGAGNWENEHPVTPPNVSLLEQDRGDILLQLIDAANVTGNANDLELMINGTTISAGQGVQSTVQQGGYTVANATHNYGLTSNGGSGLYVNYTLSALELLADGANALLLATESGLTANRELNAELSGVGGFVVDAQNGALTLANGNNRYEGTTTVTAGELILGANGAFGQTSLLNIASGASANINGYRQTVGAVTNSGAVTLGNGGELTSTDTLINTGMINVTDGILNLENGGASSISGGLTGNGILNIKGGDFTISIDNNGLAGQTNISNGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFANSVTGSGVLQVTDDAEVTLTSSNGVSNAVTIDIADATLNLDDIALFNHTLTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALRVSFASNMANLTSNVLITANGSLGGYGQVTGNVENHGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTQADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNNVSGQDLAAEKYDSKGFTASVEGGYAFKVGESVSQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQINNQLNLWGNIGQQVGNKGYSETSVVLGVKYNF

SEQ ID NO: 9660 - protein, 1285 aa, Yersinia pseudotuberculosis
MHIQFREPISTSPAQPDAGRQHLFSRVPAAVMNPITLAIIVAFSPLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETSIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNYNYNYNYNYNYNYNYNDNYATGVDDGTGADNGTSTIDLITRGALVSQQGYGINIETNTADTYVTVGGLVHGGNGTAIGIHRLENVQKSATLELQSGYALEGVTQALVFTGSYAEINDAALDLANSHLVLGGAGDAAFDLTRIDNREEAILDGDPNRITGFGTLTKTNNSIWTLTGSNMADGDANAFLSANIAGGILVLDNATLGLTPDAGALTGPTVNRLSAADIAADPTLVATETGALTLGEGGALSSLGDSVLSGNLISAGGILLSNHYTGGNGTATDDRLTVTGTYLGENNGSGEGAWLTLDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 9661 - protein, 315 aa, Yersinia pseudotuberculosis
MKNIAMALAATLGIIPALSSAAEIYNKDGNKLDFYGRVAAKYLFKKQSNEDATYVRIGFKGETKINSQLTGFGQWEYNIAANNTESQGDKGNKTRLGFAGLKLADYGSFDYGRNYGVVYDVLSYTDMLPEFGGDSMAATDNYMTARSTGLATYRNDNFFGLVEGLKVAAQYQGRNEDGDVTRNERSIQKANGDGFGLSFNYQNIQGSGVSFAGAYSSSNRTEGQKELVNSAAGDKAQAWATGLKYDANQAYIAAMYGETLNMTPYKRLIANKTQNVELVAQYQFENGIRPSLVTNGAIVIHTQRLKSDPGGNLLS

SEQ ID NO: 9662 - protein, 258 aa, Yersinia pseudotuberculosis
MDHRQRSSADCRPASVCALQSVRTSTALAERVSDTERTGHRDRPGRVRSTRQTGRIVSFSFSSVAFWSRFNDLSISAIVLDGTGAVQNLGLVGKTQTLGLESEFAWRQTDMFGMTSSMTLQDPQTRGLSNAGTAVAGLNGKQISRTPKYIVSLSPTLYFDLVGKQTELTATAYRIGQRYLDYTNATALPAYTSYDIGMSSYLSQRLELQLHVANVSNSVGLTEGNARVDTLSGQGTSEAIYARPIFGRNYTASLTWRW

SEQ ID NO: 9663 - protein, 761 aa, Yersinia pseudotuberculosis
MNNHKIWRLSAVAVALLISGNGYADQTFHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEAYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGSASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYIVSSNNSNYDLIDTRYSSYSDHAVALHAGVRLDGRYPLTNETLLKPFFNVGLQQMLYGDEITIDQSIPNSPVVGVSTKDKTTQGTFDLGMALVSDNGVSASLQLSGMVNSDRQDFTGWANLGWAF

SEQ ID NO: 9664 - protein, 997 aa, Yersinia pseudotuberculosis
MKNSNRSPKNISRNFKHHKETSLSSKNKSPIATCVAAALFIFGSSSVIANPDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMQGDSNIHHLDILDSGRHDLNNPGKTGNQLIINGDYFSDNGTLIFHSQLAGDDSVTDHILIKGNTGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETSPPSNTPELTVPDPKRANAAVFSAKLADYALQAVGGVVDSFTQPETNTPSNTPELTVPDPKRANAEAFSAKLADYALQAVGGVVDTFTSPEQTEQTEQTTATPDSTPKSTDSAVKPASTPKPTDLAVKPANTVISNAKTAAPKRQTLVHTPENGSYIANIAMARNLFTTRLEDRTSHYLYKDIVTGQWQPTSMWMHTQGGRSQFGHTVEQLNIKGNYYSVQLGGDIAQWATNEQGSGRIGMLAGLGKATNHSHSKVTSYHSRGSVDGYNLGIYATWFADQQHNTGVYIDTLAQYSWFNNAVNGQDKAEEKYKSSGFTTSIESGYTFNLANSDQLSYFIQPNAQITWAGINTQTHKTADGAVVSYRNNGHFITRIGAKAYLQTHDTLNTKFTPFVAVNWIHQNQNTGTTISGQGIDNKIQNSTEFNVGVESQIDQQLHIWANINHQIGRYNYTDTNALVGVKYHF

SEQ ID NO: 9665 - protein, 1001 aa, Yersinia pseudotuberculosis
MKKNRRKILSGSRKILFAILAVFFSLSASAQQFTASGQVLDAQKEPLIGVSVQEKGTTNGAITDLDGNFTLTVQSNATLIFSYVGYKSQEQKASRQMKVTLQEDNEVLEEVVVIGYGSVKRKDVTTAISTVSTKDLDVRPIVSAGQAIQGKAAGISVIQPSGTPGGEMSIRVRGTTSMNGSNDPLYVVDGVPVDNIKFLSPNDIESMQILKDASSASIYGSRAANGVILITTKAGATGKAKVSLTAQFGLNKVADKVESLNAAQYKELQDEIGLVSLPDGLPDRTDWFDETYKTGKMQNYQVAVSNGNEKMKYYLSAGYLDEKGILDISYYKRYNFRVNLENQIRSWLTVSANISYSDYTSNGGGAMGTGANRGGVVLAVINTPTYAPIWDALNPNQYYNNFYGVGNITNPLENMARAKNNKDKENRLLASGNVLLTLLPELKFKSTLTLDRRNAVNTTFLDPISTAWGRNQYGEASDNRNMNTVLTFDNVFTYNKNFKRHGLEVMAGSSWTDSDYSNSWINGSHYRNDLIQTLNAANKIAWDNTGTGASQWGIMSFFGRVAYNFDSKYLLTANLRADGSSKLHPDHRWGVFPSFSAAWRVSSEKFMADLTWIDDFKIRGGWGQTGNQSGIGDYAYLQRYNIGRIEWFKVAAEGDTTDYANAVPTISQANLRTSDLTWETTTQTNIGLDLTVLNGRLTFNMDYYYKKTKNMLMNVSLPAGAAAATSIARNEGEMTNKGFELTISSKNFRGGAFTWDTDFNISFNRNKLTKLELQKVYYDAKTADVVNDYVVRNEPGRALGGFYGYISDGVDPETGELMYRDLSGDGKISTSDRTYIGDPNPDFTYGLTNTFSWKGFNLSVFIQGSYGNDIFNASRIETEGMYDGKNQSTKVLNRWKIPGQITNVPKANFKLLNSTYFIEDGSYLRLKDVSLSYNFKGKLLQKWGITRLQPYFTATNLLTWTSYSGMDPEVNQWGNSGTVQGIDWGTYPHSRSYVFGINVEF

SEQ ID NO: 9666 - protein, 638 aa, Yersinia pseudotuberculosis
MDKTLLAGAISLSLVILPVQVLAFTPNVVGITVNDEVVIHGIQNVRDGGVINNGLVSDNAAITVTNGSSAGTANNTTVGDKGWLQITGALATGTIVNQGGLLDTKTAGTVIDSQINDGGHMTLGLNSQSKGYLNIAAGAELFVTNNDPYISDVTTHNPALPANVMIENLNVAGLVEIGPSWKGTSIVPLPLSDVLGPVLVTRINNVTLQGGDINLMAYSAGGQFNRLEIENLSGQGNFAMTTQLASNTGDFITVSQQATGQFGITVQDSGKEPQSADNLVLVHINRGDAQFRLLNTGGVVDLGVYQYGLYSQESNGSTDWYLATSTEELPGTTPNVTAPMLSSAAQGVLNMAAAPRHILNAELSTLRQRQGELKADAEGTVGVWARYLTDDSRLSDNKNIAFKNTLSGMEIGADKQLGLNRGNMLIGAFTSYSSSDVKSTHDANGDIRSYGGGLYLTYLDQSGFYVDTVLKANRFNNKMNTQETRGEYNQNALTTSVESGYQWPVYANLVLEPYGKVSYSRIGSADYTLSNGMVAEVAKADSVQGELGTVLAASYSINQMTIKPYIKLAITREFTKSNAVAINNIGFDNDFSGNVGKYGVGINATVANNTAIFAEVDYLNGSKIETPVTANIGFRLRF

SEQ ID NO: 9667 - protein, 473 aa, Yersinia pseudotuberculosis
MVTHCQIAAHKAKRKTLALAIAGVLFGTGFMAAPEARADGFIDDSSLTGGIYYWQRQRDRKDMTPTSPEYGKYVANLHHSTFNANLAFSSGYVADMFGLDLAAFGAVEISNSGPAAPNEIGFSDAKTRWDEKWTGDKSGVSVYRAAAKFKLGDFWARGGYIQSTGQTLLAPHWSFMPGTYRGAEGGAKFDFDTAGALSMSYMWTDEYKAPWYQNMYHFRQADGLTGVSYLHSFGAKYDFKNNLVMEAAFGQAKDYMDQYFAKASYAFPVAGNDLRTTYQFYGAKDKVDGGASNANDVYDGLAWLQALTLGYTTGPFDLRLEGTWAKADGNQGYFLQRMTPGYATSNGRLDVWWDSRSDFNANGEKALFGGVMYDLKNWNMAGWSVGTSYAYGWDAKPSTNPKFDQNTRLKESAWNFDILYTLQEGRAKGTLFKLHYTLYDNHTNIPSYGDGFGNVFQDEKDVKFIVIAPFTLF

SEQ ID NO: 9668 - protein, 421 aa, Yersinia pseudotuberculosis
MNQKNLFTRSALAAAIALISSNVSAAGFQLNEYSAAALGRAFSGEGAVADNASVGSRNPAAMTLFDRPSFSGGVIYIDPSVDITGTSPSGKSTDASNIAPSAWVPNLHFIMPLDEQWAIGASATSNYGLATEFNDDYVAGMLGGQTDLKTANLNLSAAYRLNDNFSFGLGFDAVYADAKIVRHLGEAGGGLLPANTEAARLEGTKWGYGWNTGILYEIDKENRYSFTYRSEVNIDFDGDYSNQLPVIFGGLGGKTVPGSLTLNLPAVWEVSGYNKVAPQWAIHYSMAYTTWSSFKELKATASNGDVLFDKHEGFRDAYRIALGTTYYYDDNWTFRTGIAFDDSPIPAGNRSISIPDQDRFWLSAGTTYAFNKNASVDVGIAYMKGQNVSITEKTPAPSNTTYEFNSKGSAMLYGVNFNYTF

SEQ ID NO: 9669 - protein, 371 aa, Yersinia pseudotuberculosis
MKRNILAILIPTLLVATTSHAAEIYNKDGNKLDLYGKVKALHYFSDNTKSDGDKSYVHLGFKGVTQITDELSGYGQWEYNFAANYAESQEAKDNKTRLAFAGLRYGNLGSIDYGRNYGVLYDIAAWTDMLPEFGNDSYTRTDNFMTGRTTGVATYRNTDFFGLVDGLKFSLQYQGKNGAEGETNNGRTDTSKQNGDGFGLSSSYEIGAGVSVGAAYASSNRTLAQKNSTFGKGDKADAWTTGLKYSDNGVYLAANYAETRNMTPISGTAVINNVSTSVSGFANKTQNIELVAQYLFDFGLKPSIAYIQSKGKDIEGIGDTDLVKYVDIGATYYFNKNMSTYVDYKINQLNDDNKLKLNTDNVVALGLVYQF

SEQ ID NO: 9670 - protein, 759 aa, Yersinia pseudotuberculosis
MNTNSKKTYLNIAISFILYASTAMNANADSCIDYTVTDICEQSKYAAGEFHNIKLGDGVTAGSEDHHFVFNGEGYELYNSNANFSAQIASGTIRYTEVNNSYFTVNAHHFPDDTIYAGRAENTTLNDSLMWVATSADQTLAKGNSMVVVSTQMAMVDQIFVTTLNDGSLPFDPVITNSRYEDTSYEMLWGMKNEAKGWDTKATSHDSVFVDASKQSIEANGHSIGATFYGRATQVVKAGGESQDTHLFDHSYSWVYAEAKLTGLTEVNDAATVYLNAAATQGAYAENVVLNGEDTTLMVRASLDNNAYATVDNLILNGGEVVFQQSSGDQYASLNIGTLSGSGSFLFNTSIAEGKGNFVTIANASGEHKVIVNDSGHEITSPDMTTLDLIHDLSGDATFTLASISGANIIEVDGGTYVYSLNTWDNSARAGGNLWYLGSGLNTGTELEPEPEEKTTPSTDAVLSMASSNQFIFDGEMQNLRFRKGDLNNNKGDGASVWGRYLTNNTRVNAAHDAAYRLQQDGFEIGADKVLEMSSGQLVLGGFTSYSNNRVKHARGGNSTVDSYSLGAYGTYFDNSGYYVDAVVKANRFKNSLNAHMTNGGSVQSDYNQNAIGGSLEAGYHYSLSNNWFVEPYVRTSYYTAQDKDIALNNGMTANIDNNRSAKGEIGTHLGTKIDLNNGAIIRPYAKVAIEREFIKSNTVTINQVNDFNNDLSGHTAKYGLGMDINLMKQTSVYAEANYRNGTHVESPIMANIGFRINF

SEQ ID NO: 9671 - protein, 371 aa, Yersinia pseudotuberculosis
MKLRVLSFIIPALLVAGSASAAEIYNKDGNKLDLYGKIDGLHYFSDNKNLDGDQSYMRFGLKGETQITDQLTGYGQWEYQVNLNKAENEDGNHDSFTRVGFAGLKFADYGSLDYGRNYGVLYDVTSWTDVLPEFGGDTYGADNFLSQRGNGMLTYRNTNFFGLVDGLNFALQYQGKNGSSSETNNGRGVADQNGDGYGMSLSYDLGWGVSASAAMASSLRTTAQNDLQYGQGKRANAYTGGLKYDANNVYLAANYTQTYNLTRFGDFSNRSSDAAFGFADKAHNIEVVAQYQFDFGLRPSVAYLQSKGKDIGIYGDQDLLKYVDIGATYFFNKNMSTYVDYKINLLDKNDFTKNARINTDDIVAVGMVYQF

SEQ ID NO: 9672 - protein, 311 aa, Yersinia pseudotuberculosis
MNKEALAKKGAGALALLILSHPAVANNNTDTAGNVTVSTSLGLLNAESIESVYQSSEPKQKLSQLNWEANNTPIVKMDIAWDALPRLTLTAKGWSTLSSGQGVMDNYDWLTPQQTQWSDWSHHEKTNLNYANEIDINAKIWFLKQYNYRVGPILGYQENNQSWTAYGGNFNYNNDTNIFTAPDGIVGVGYKQKFDMLYIGLAGSYRYQQLEFNALLKYSNWVNANAYDNHYNRKVSFKDSSKNSSYYSAVIDVGYYFTENTKLFVEAAWNQYSEGRGETQTLNYATGNVGSSKSGIEYQSQTLTVGFQYKF

SEQ ID NO: 9673 - protein, 579 aa, Yersinia pseudotuberculosis
MGEIGHSGVKGFVSYSHARTDNWRGAGYDEKQHVDFKFLKEWGQDSHVSLLGTWNKGITSYYPQVDKQSWKENGISGSNNLASRYNVNNDAAGSDYWRLYRAPEEIFYLAAPIDVRLASNLKLKVTPYGQWDRGNVPAGSTLNNSGLWNGTEAIAGTINLPNATDGTATVRSNYTQRSARAGVNASATWSLKNHDLTLGYWFDYSADKEQNSFTPVDSNGYASNIWADRHSTLIKMPDGSPLLGTNNRTHTYVNAVYLGDHMTFLQNRLTFDIGFKEVIMTRHGYNYLPGSQHKANFSTSEPLPRLGLRYQIDSKSHVFFSASTNFRTADETALYNSYDPTSGDIIVNGNKNLKNEYSVSEELGYRYSDALVTGSLTLFNYNFSNRQLQTVIVQNGSHIQSTINAGNQISRGVDFEIGLAPWHHISPYLSGEYLYTRQTSDLTVGDDLLPTKGKRAVRSPAFQGSLGVTYDDHHFFGMASVKYTGSQYGSFMNDEKIPAYVTGNISVGYRFTQEAFLKHPEIRLNFINIGNNHYLSGIASPTANAQDTVGRNGTVISGSAPQYYIGGGFAVLASLSSAF

SEQ ID NO: 9674 - protein, 1121 aa, Yersinia pseudotuberculosis
MKSRSNLNTRLLPLSILISSLIPGAVLAAPSVAIPPPVQDLINQVQSYANAHVISPEQAETLIKRLTVTPEKLKEEEARVKQELAAVEKKQKEANTEIITTSLEKDQFNKALNNTQKAKLAAETVFINANSKQNEAIKAVNKNWSLADENISKKLSVIVNGESKTQAILAEKIKLTETADINQQEQIIKAQQLDAEIQQIKSALADAESNGTTGTLVLRQKLAQAKEKLEIAKNDPKSKLFDAKAAHDRTSKNLEGPEGLAKRAAIQNKKVYEQELKVLQDPIDVAQKQFTAAQDNTFALMDEQIALAKQKIDSTALTNSLQEVFKQAKNAQLQAEQAAQQAKDATTAQQAMAEAAAAEKSLQEVEQKLAVIAAIAQEAEVKFTAAQLAKADAELQLADKMEQLTNISQNLAALNDALNDLDPKVNSQQTLAKGEAQPVADGELAMATKVAGGEQNVTTGGAVLASVVTEDGVVNLSDNAFAHDTQLINGTLNNTRAHDVNTQVGAQGKLLINGTQEAAATSEGATVAAGGSVTAGTNALVTKMVSAGAVTGNDGALFTETTLNDGQFSLNNGAIAQNTKVNGGQFNVNEGATAEGVTVKGGEFNLRARAQAMKLTIEFGEAQIAGTLTDVTLRGGNTTLASSADVAGTIHSISGSALKVYQGAHTAQADLNLAGRVVLFADDVAPMAALPSRAVRAADNRLSAPFTFRRVNMSGGTLDLRNVKDAQLVMDSLAGNGTFKLGSMLQQDASALVNVTGNADGDFTLQIDGSGIDPTNLNVVSTGGGDARFTLTDGPIGLGNRVYNLVKDASGKVTLVANESTVTPGTASILAVANTTPVIFNAELSSVQQRLDKQSTEANESGIWGTYLHNNFAVKGRAANFDQTLNGITLGGDKATALADGVLSVGGFASASTSSIKTDYQSKGNVDSHSFGAYAQYLANNGYYVNGVVKANKFNQDIHVTSADNSASGNTNFSGMGVAVKAGKHINHNHLYVSPYVAMSAFSSGKSAVKLSNGMAAQSSSTRSMIGTLGVNAGYRFVLKNGVEMKPYVSASVDHEFAANNKFRVNQEMFDNNLNGTRVNTGAGLNVNITPNLSVGSEVKLSSGKNIKTPVTVNLNVGYRF

SEQ ID NO: 9675 - protein, 230 aa, Elusimicrobium minutum
MKNIFALSALSLAFASSAFAGSSYVTGNVQFHDDGRIHGSDVTSTLEAGHTFDNQFGGFTVYTEFDGIQLGKLETENGGAGNTTPAITVGGEQSFNITDHLWVAAGYQHLFSAGENVQYRPLVKIGYNFDNGISLSNRTRAHIDATDADADTDYRMDNRIGYVMNEDVTLSYNNVYMIEAETMDHELRATWTRKGVQPYFEFRSQAHGAENASGDSLVNNAFVFGASYGF

SEQ ID NO: 9676 - protein, 406 aa, Elusimicrobium minutum
MKKIIALSVITSGLLMAAGYKIPEQSLNSMALGAAYVAHTSGADTNYYNPAAMSFMADKQYVEGGITLANLPSNVYTLMPPYSGESEEENIWIPNAHYVANAIGDFRWGVSLTAPGGLTKRWNTPYQKLYAEEFTLKIIELNPSVSYKVTDDFSIGGGVRLVYSEGVVDSDGAAAGAPIKREMEGDTVEFGYNLALLYKPTSDINLAVTYRSNIDLKEEGQANLYFGGVGKQYDADVTVPLPAALNIAVSKTWNNTFTLEAVYERTYWSKYKTLDFNYGSIIANPILDGAFNTPIDKDWEDTNTFRIGATIALDKITLMMGFAVDETPVPDKTIGFELPDSDAKIFSMGFRYQQTDALSWGAAFLYDGKDARSLTPGVAENRVLSNGGGFTGGGAYLTTLGVAYEF

SEQ ID NO: 9677 - protein, 292 aa, Elusimicrobium minutum
MKKIVLAAGAALALSTSFTAGAAETSNSEFVSDWWHQSVNVVGSYHTRFGPTIRNDTYLEYEAFAKKDWFDFYGYADAPVFFGGNTDAKGIWNHGSPLFVEIEPRFSIDKLTGTSLAFGPFKEWYFANNYIYDMGRNASGRQSTWYMGLGTDIDTGLPMSLSLNVYAKYQWQNYGAENQNEWDGYRFKVKYFVPITQLWGGNLSYIGFTNFDWGSDLGDKSGYALNGVKSRTNDSIASSHILALNYDHWHYSVVARYWHNGGQWNDDAQLAFTNYNTRTTGWGGYLVVGYNF

SEQ ID NO: 9678 - protein, 190 aa, Elusimicrobium minutum
MIKSLSISLPLLASFLTFSQAANAGDSSHYIGGTLGYGFHEFETEKYGQASFSDSVTFDLYYRHMVNDNFGIEVGGMSGSGGAFSILSDIWNDVKGLSYRGLRTTAYARLPLGISNSLYAKAGTAYQWVDYNVRQDKETVSVSETDNGFYGAIGWEFRFRNGLALNAEYQHVPMSNLTLRSYNFGINYPF

SEQ ID NO: 9679 - protein, 969 aa, Elusimicrobium minutum
MKFKALIGTSILAMAVATPAFAQDAEEEVARDAFGGEIVVTAQRQSERLQDVPIAVSAFSAEALEAQQIENPSDLQLTLPNVTFTKTNFTSSSFTIRGIGDLCVGVSCDSATAIHQNESPLIGTRLFETEFFDLERIEVLRGPQGTLFGRNATSGVVNVVTAKPNLDAFGAAGEFEYGNYNSIKAKGMVNLPIGDTLGVRIAGFYLNRDGYTKNLFDDSRIDDRDMYAIRGSIRWQPTPDTTLDLMGYYFREDDNRLRIQKQYCQRDPTGVLGCLNNRRDPGVTNANSTFVGVLTSAEFLAIRGIPTAFALGSLYGPDALSTFAPIADPRVVNTDFTPTYFSDELQLQGRLEHSFGAINVSLAGVYQEARVDSSQDYNLSIQDRSFFAPALNTLAAAGAGLVPGLPASFFAPIAQALIPNGPNGVLCTSLAEESGLGSYGGRSLCTATPQDFDRSNQKSNAWSGEMIVSSDFDGPFNFLLGGIYGESHLTENSYYVNSFGIDYLTGILGTFTALGSGGTIPPSFLATPFFRNNTDDLKVKSYGFFGEGYYEINDAIKLTVGLRYNNDKKRVQARSTLASFLVPFGQTGSAFDSPFVGAFDADPGLAGNQLFQVRKVGFDEVTGRAVLDWKITPDNLVYASYSRGYKSGGINPPLQPAFAVDEAFSPEIVNAFEIGSKNRFGALQINVTGFYYQYKDLQLSRIVARTSVNDNVDANIWGLEAEAVITPTPDFVVNIGASYLNTEVSSDKFLGNPRDPSGGRSDAVIIKDITNGSNCAVVPTTAGNAAGTAGYVSAINASLGLQGPAGFGPNSGINSPGAFGICSVLQANAATVGALFGGIAIENAGVPVNIRGNKLPQAPNVKFSAGVQYTHNFANDMSLTPRLDVTYTGDSYGNIFNGRINEINGYAQVNAQIQLNGPDKKWFVKAFVSNIFDSQPVTGLYVTDQSSGLFTNVFTLDPRRYGISAGFKF

SEQ ID NO: 9680 - protein, 1050 aa, Elusimicrobium minutum
MKKIKRILSISALLVCGVANTWGQGGQKLTGKILSATNQPVEGAIVTVLDTMNVTTNKEGAFQFEVKDLSKAGEISVWAPGYFSVKQLIRERSNIVITLIPENQYKYNETMILPFRREGEMQLEDYTAATNIAKKDFMPGTTKIDRALTGQVAGLQVKRSSGMPGEGSYYNLRGIRTLTGDNAPLIVINGVPHMPDKTPSALIDGFTRDIFQFYHLQDIQNITILKGAEAAMYGSMGSNGVILIETDGTASNDLETRVSYYGSYGINWNDKRMPVMGLDDYKQYLADMGMTISKDPQNFYNNFPFMQNPNDPRYNYLYNNNTDWQDLIYKNTASTDHLFRVEGGDNIAKYDLSLGYYRENGLMDNTSMERFHTLLNANVLVNKQLNIFATVGLAYMNGHYQMQGMDITTNPILAAYARSPFLSPYEKDREGNTLKTYASHFYGRSKSRDYSVSNPLAIVNTLDSRNRQYDLNMKAGIAYNPFRELTLTGTVGLYYNYDNEHLFIPGASEATIVPLSDKYGLRNNAVSDGVAVTTNFFANLNASYKKTFNYVHQLNAIAGWQLMTTKNEYDAGEGRNTGNDFYQTLGSTIDGRRFLGYINSWNWTNFYGHADYTYNNMVQASVNIAVDAASSTGTDVARFYTYPSVGVTLLGKGWKPLLDATWLNKLNVRAEYGLTGNSRFSSQMGGYYYSTVPYMQLSTIVRSNIPNVSLKPEKNASLNLGLDLSVLNNRLNVSFDYYNNQISDMISAMPLSSVYGSVPYYANVGKLENTGIELSVQASLVRTRNFEWIVGGNITRSRDKIKSLGGEEQIVLSYDNGVQMVNRVGESPYQFYGYQADGVYSTQAEADAANLSNRTGRRYNAGDVRFVDQNGDNRIDDKDRILLGSAAPSYFGGFYTQLKYKGFALSAEFSYSKDNIAYNAVRQQLEAVSTTNNQSIAAVNRWTVEGQKTDMPKATWKDPVGNSYFSSRWMEDASYLRMKNVTLSYTFSKTLWNFFRSGTIYVTGENLLTFTDYLGMDPEFSYSYAENMQGFDNAKLMQPKTVKMGVNLKF

SEQ ID NO: 9681 - protein, 211 aa, Escherichia coli 53638
MGNKLILSIAMMSAFAANNVMAADSGLYLGGAIGTSGVDDGGLFSSIKEPVTFEAEDNAYRIIAGYKFNRIVSLELQYTDYGDVVAKYPLRSNAGFTWTPQVFSIAANLGYTFDNGVRPFGTIGLSSIDLDMKYADGSRPSSSDFDDSGAGVRVGFGVEYTPEKLSELSLRLGYEADAFTVEVDEGNSWNRKKVEKDIVLASFYLGAMYTF

SEQ ID NO: 9682 - protein, 199 aa, Escherichia coli 53638
MRKLYAAILSAAICLAVSGAPAWASEHQSTLSAGYLHASTNAPGSDDLNGINVKYRYEFTDTLGLVTSFSYANAEDEQKTHYSDTRWHEDSVRNRWFSVMAGPSVRVNEWFSAYAMAGVAYSRVSTFSGDYLRVTDNKGKTHDVLTGSDDNRHSNTSLAWGAGVQFNPTESVAIDLAYEGSGSGDWRTDGFIVGVGYKF

SEQ ID NO: 9683 - protein, 614 aa, Escherichia coli 53638
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 9684 - protein, 230 aa, Escherichia coli 53638
MKKINAIILLSSLTSASVFAGAYVENREAYNLASDQGEVMLRVGYNFDMGAGIMLTNTYNFQREDELKHGYNEIEGWYPLFKPTDKLTIQPGGLINDKSIGSGGAVYLDVNYKFVPWFNLTVRNRYNHNNYSSTDLSGELDNNDTYEIGTYWNFKITDKFSYTFEPHYFMRVNDFNSSNGKDHHWEITNTFRYRINEHWLPYFELRWLDRNVEPYHREQNQIRIGTKYFF

SEQ ID NO: 9685 - protein, 1252 aa, Escherichia coli 53638
MRIIFLRKEYLSLLPSMIASLFSANGVAAAIDLCQGYDIKASCHASRQSLSGITQDWSVADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSTAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFVHSLTGFQNGTLNIDAGGNVTVNQGSFAGTIEGAGQLTIAQNGSYVLSGAQSMALTGDIVVDDGAVLSLEGDAADLAALQDDPQSIVLNGGVLDLSDFSTWQSGTSYNDGLEVSGSSGTVIGSQDVVDLAGGNDMHIGGDGKDGVYVVVDAGDGQVSLANNNSYLGTTQIASGTLMVSDNSQLGDTHYNRQVIFTDKQQESVMEITANVDTRSTTTEHGRDIEMRADGEVAVDAGVDTQWGALMADSSGQHQDEGSTFTKTGAGTLELTASGTTQSAVRVEEGTLKGDVADIFPYASSLWVGDGATFVTGADQDIQSIDATSSGTIDISDGTVLRLTGQDTSVALNASLFNGDGTLVNATDGVTLTGELNTNLETDSLTYLADVTVNGDLTNTSGAVSLQNGVAGDTLTVNGDYTGGGTLLFDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPLPPDPDPTPDPDPTPDPDPTPEPAPDPTPAYQPVLNAKVGGYFNNLRAANQAFMMERRDHAGGDGQTLNLRVIGGDYHYTAAGQLAQHEDTSTVQLSGDLFRGRWGDDGGWMLGIVGGYSDNQGDSRSSMTGTRADNQNHGYAVGLTSSWFQHGTQKQGAWLDSWLQYAWFSNDVSEQDDGTDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVMGNISQRVSLRGSVAWQKGSDDFAQTAVFLSMTVKW

SEQ ID NO: 9686 - protein, 663 aa, Escherichia coli 53638
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9687 - protein, 660 aa, Escherichia coli 53638
MGAFFAGENGNSTTGDAIYMRGADTSNSIYIDGIRDIGSVSRDTFNTEQLEVIKGPSGTDYGRSAPTGSINMISKQPRNDSGIDASASIGSAWFRRGTLDVNQVIGDTTAVRLNVMGEKTHDAGRDKVTNERYGVAPSVAFGLGTANRLYLNYLHVTQHNTPDGGIPTIGLPGYSAPSEGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSANACGGSGRGAITCPVGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9688 - protein, 232 aa, Escherichia coli 53638
MIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 9689 - protein, 199 aa, Escherichia coli 53638
MRKLYAAILSAAICLAVSGAPAWASEHQSTLSAGYLHASTNVPGSDDLNGINVKYRYEFTDTLGLVTSFSYAGDKNRQLTRYSDTRWHEDSVRNRWFSVMVGPSVRVNEWFSAYAMAGMAYSRVSTFSGDYLRVTDNKGKTHDVLTGSDDGRHSNTSLAWGAGVQFNPTESVAIDLAYEGSGSGDWRTDGFIVGVGYKF

SEQ ID NO: 9690 - protein, 468 aa, Escherichia coli 53638
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSIGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 9691 - protein, 751 aa, Escherichia coli 53638
MNKKIHSLALLVNLGIYGAALPVMAEEKTDSAALTNEDTIVVTAAQQNLQASGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRIYRQNYSLTWNGGWDNGVTTSNWVQYEHTRNSRMPEGLAGGTEGIFDPKASQKYTDADLNDVTLHSEVSLPFDLLVNQNLTLGTEWAQQRMKDMLSNSQTFMGGNIPGYSSTDRSPYSKAEIFSLFAENNMELTDSTMLTPGLRFDHHSIVGNNWSPSLNLSQGLGDDFTLKMGIARAYKAPSLYQTNPNYILYSKGQGCYATGAGTGIGCYMMGNDELKAETSINKEIGLEFKRDGWLAGVTWFRNDYRNKIEAGKVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGKPVTGTDKQSVSPYSIVGLSATWDVTKNVSLTGGVDNLFDKRLWREGNAQTVRDTKTGAYMAGAGAYTYNEPGRTWYMSINTHF

SEQ ID NO: 9692 - protein, 393 aa, Escherichia coli 53638
MKRKVLAMLVPALLIAGAANAAEVYNKDGNKLDLYGKVDGLRYFSDDAGSDGDMSYARLGFKGETQIAEQLTGYGQWEYNIQANGTEGDKGDSWTRLGFAGLGFGQNGTFDYGRNYGVVYDVEAWTDMLPEFGGDTYTQTDVYMLGRTNGVATYRNNGFFGLVDGLNFALQYQGNNEGTGFGQEGSGNSAGRKLAKENGDGFGMSTSYDFDFGLSLGAAYANSDRTDAQVARGYGDGMNQRNNYAGGDKAEAWTVGAKYDAYNVYLAAMYAETRNMTYYGNGDSELNGGIANKTQNFEVVAQYQFDFGLRPSIAYLQSKGKDLGGQEVRHGNWRYTDKDLVKYVDVGMTYYFNKNMSTYVDYKINLLDEDDSFYADNGIATDDIVAVGLVYQF

SEQ ID NO: 9693 - protein, 968 aa, Escherichia coli 53638
MHSWKKKLVVSQLALACTLAITSQANAANYDTWTYIDNPVTALDWDHMDKAGTVDGNYVNYSGFVYYNNTNGDFDQSFNGDTVNGTISTYYLNHDYADSTANQLDISNSVIHGSITSMLPGGYYDRFDADGNNLGGYDFYTDAVVDTHWRDGDVFTLNIANTTIDDDYEALYFTDSYKDGDVTKHTNETFDTSEGVAVNLDVESNINISNNSRVAGIALSQGNTYNETYTTESHTWDNNISVKDSTVTSGSNYILDSNTYGKTGHFGNSDEPSDYAGPGDVAMSFTASGSDYAMKNNVFLSNSTLMGDVAFTSTWNSNFDPNGHDSNGDGVKDTNGGWTDDSLNVDELNLTLDNGSKWVGQAIYNVAETSAMYDVATNSLTPDATYENNDWKRVVDDKVFQSGVFNVALNNGSEWDTTGRSIVDTLTVNNGSQVNVSESKLTSDTIDLTNGSSLNIGEDGYVDTDHLTINSYSTVALTESTGWGADYNLYANTITVTNGGVLDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAGAIADYKDKEIIYVNDVNTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 9694 - protein, 955 aa, Escherichia coli 53638
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLSTGSTSKSNDDGIIIGHSSTLTATQFTIENSNGIGLTINDYGTSVDLGSGSKIKTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSSSDATINFSGTAAQRNSIFSGGSYGASAQTATAVINMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFTTLNVENLSGNSTFIMRADVVGEGNGVNNRGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIDSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMAMKASNGLNIHLNHYESLLGRASMILGYDITAGNSQLNVYVKTGAIREFSGDTEYLLNDSREKYSFKGNGWNNGVGVSAQYNKQHTFYLEADYTQGNLFDQKQVNGRYRFSF

SEQ ID NO: 9695 - protein, 967 aa, Escherichia coli 53638
MSACGGSGLVRPPTPTPTPTPTPTPTPTPTPTPTPTPTPTPTPTPTPTPTPTPTPTPLPVLDPALAAKFRVHLDVTNTEPAHTLGFTGKGYMVGVVDSGVNRNHVTLHDQVIHNNVYVDYQDPASPDDVSGHGTNVAQLIAGQPVEYWPGGIAPGATIFSARVFSSAAESAKESPIGGNFFEGEAAQLKRVNADMIAAGVRIQNNSWGYENQNTGDKQVWIDPAVTDGFVNVYRDLVLNNNVLVIFASGNYSQQQPGRLSRLPSLPTVEGGASPADLERGWLVVAALDSFDHPDQLTSYSNHCGIAMHYCLAAPGDLIEIDTNVTTSPVDGDKGYLNGYLIQNGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGTNNAYVTLQRLNVSAAAQALGIVDRVAQASAQRVEHAFRAIDAQQAQGGGALPTSFIGAAAALQQSSSAAVAAASLQSLSGQSHVAAAAASLDAIDLGRRSLATRLDAPRSGERIVTWHQALGGPGHNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGSLALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 9696 - protein, 700 aa, Escherichia coli 53638
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPAPGRNYGVGVNIAWRFE

SEQ ID NO: 9697 - protein, 232 aa, Escherichia coli O157:H7 str. EC4196
MIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSSLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 9698 - protein, 660 aa, Escherichia coli O157:H7 str. EC4196
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGVTTTLVLGNAFDKEYWSPQGIPQDGRNGKIFVSYQW

SEQ ID NO: 9699 - protein, 1234 aa, Escherichia coli O157:H7 str. EC4196
MIASLFPANGVAAAIDLCQGYDIKASCHASRQSLSGITQVWSIADGQWLVFSDMTNNASGGAVFLQQGAEFTLSPENETGMTLFANNTVSGEYNNGGAIFAKENSTLNLTDVIFSGNVAGGYGGAIYSSGTNDTGAIDLRVTNAVFRNNIANDGKGGAIYTINNDIYLSDDVFNNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFAHSLTGFQNGTLNIDAGGNVTVNQGSFAGTIEGAGQLTIAQNGSYVLAGAQSMALTGDIVVDAGAVLSLEGDAADLAALQDDPQSIVLNGGMLDLSDFSTWQSGTSYKDGLEVSGSSGTVIGSQDVVDLAGGNDMHIGGDGKDGVYVVIDAGDGQVSLANDNQYLGTTQIASGTLMVSDNSQLGYTHYNRQVIFTDKPQESVMEITANVDTRSTTTEHGRDIEMRADGEVAVDAGVDTQWGALMADSSGQHQDEGSTLTKTGAGTLELTASGTTQSAVRVEEGTLQGDVADIFPYASSLWVGDGATFVTGADQDIQSIDATSSGTIDISDGTVLRLTGQDTSVALNASLFNCDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTQDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDASTISDDAVKQRGEIKVGVTGNISQRVSLRGSVAWQKGSDDFAQTAGFLSMTVKW

SEQ ID NO: 9700 - protein, 367 aa, Escherichia coli O157:H7 str. EC4196
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 9701 - protein, 863 aa, Escherichia coli O157:H7 str. EC4196
MHQSGSVSLCRSAISVLVATALYSPIALASTVEYGETVDGVILEKDIQLVYGTANNTKINPGGEQHIKEFGVSSNTEINGGYQYIEMNGTAEYSVLNDGYQIVQMGGAANQTTLNNGVLQVYGPANDTTIKGGRLIVEKDGGTVFAAIEKGGLLEVKEGGFALAVDQKACGAIKTTTRAMEVFGTNRLGQFDIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTKVQANAVYDLGRSDQNGSITYSSKAISENMVINNGRANVWAGTMVNVSVRGNDGILEVMKPQINYAPAMLVGKVVVSEGASFRTHGAVDTSKADVSLENSAWTIIADITTTNQNTRLNLANLAMSGANVIMMAEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTVMWSSAINTRNNVTTDAGAGFEQTLTGLTLGIDSRFSREENSTIRGLFFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 9702 - protein, 659 aa, Escherichia coli O157:H7 str. EC4196
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNSGAAWQVTKDVKLRAGVLNLGDKDLSRDDYSYNEDGRRYFMAVDYRF

SEQ ID NO: 9703 - protein, 244 aa, Escherichia coli O157:H7 str. EC4196
MKSIATLVVCAISGIACVNLSAHAAEGEHTISLGYAHFQFPGLKDFVKDATAHNRETFSHFVNRNYFSSLGEYTDGRVSGYEGKDKNPQGINIRYRYEITDDFGVITSFTWTRSLTNSQTFIDVQSADHTRKIKNPAASARTDIRANYWSLLAGPSWRVNQYMSLYAMAGMGVAKVSADLKIKDNINSSGGFSESNSTKKTSLAWAAGAQFNLNESVTLDVAYEGSGSGDWRTSGVTAGIGLKF

SEQ ID NO: 9704 - protein, 446 aa, Escherichia coli O157:H7 str. EC4196
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAIYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 9705 - protein, 713 aa, Escherichia coli O157:H7 str. EC4196
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHCVSRRSATNGADYYLPGYFVADAFAAYKMKLQYPVTLQLNVKNLFDKTYYTSSIATNNLGNQIGDPREVQFTVKMEF

SEQ ID NO: 9706 - protein, 719 aa, Escherichia coli O157:H7 str. EC4196
MKGDTMPPRAHASRAQGAVLALAATLPLADAARAQSAPPETTTIALDTLDVSAQPLGDGLNLLVPSMTGSRLDLTPLQTPSSVQIIPGEIARERGQYTVIEAVTQDAAGFSASPAPGNGGTSLSTRGFSGHGSVMQLYDGTRLYVGAGTVTFPFDTWSAERIEVLRGPASVLYGDGAIGGVVNVVPRKPDPLSSHGEALMAVDSLMSGRLALDATGPINDRVSYRFDIAGKLSDGWVDRGDNGSLAVSAAVRIQASDTLVLSLSNDYGYQEPQKYFGTPLINGQFTGLLRNQNYNVGDAAISYSDNWSQFKAEWTPSDALTVRSTFYYLTSDRHWRDSETYAFQPATGLVRRSDYIEIMHDQSQLGNRTDATWRGSILGFANEVVVGFDINSIDFTHTNNSPYRGSSSVPLIGFNPGTFASPDPTVPKYHTDTTQYSLFAEDRLVLDEHWSIVGGLRWENPTITRTNLVTAQEEFQKSYSAVTGRIGVIYSPVQDLSLYASYTTGIDPVAGLITLSSANANFNLTTAEQYEAGIKQVFWGGRGEWTFAVYDITKYNLLARSSANSQVTEQIGQQSSRGVEGTVSVSFLENWRISANLALLDARYDNYITTGGINATGNTPVGVPEQVGNVWLTWNFAPKWKTWAGLQYVGPVFVNEANTVQRPEYYVVNGGLQWAPTPAANITLRVYNLFDETYAVAGNTGQWVLGQPRTVELSSSVRF

SEQ ID NO: 9707 - protein, 390 aa, Escherichia coli O157:H7 str. EC4196
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSCSPGDPIVTLTAGKDVLTDWLYCIRFMKEKDSKYGGYSGEHPTKFL

SEQ ID NO: 9708 - protein, 948 aa, Escherichia coli O157:H7 str. EC4196
MKRHLNTSYRLVWNHITGTLVVASELARSRGKRAGVAVALSLAAVTPVPALAADTVVEAGETVNGGTLTNHDNQIVFGTTNGMTISTGLEYGTDNEANTGGQWVQDGGTASNTTISSGGLQFVGAGGKATDTIINEGGGQSLKGLALNTTLNGGEQWMHEGAIATGTVINDKGWQVVKPGAVATDTVVNTGAEGGPDAENGDTGQFVRGNAVRTTINKNGRQIVTVEGTANTTVVYAGGDQTVHGHALDTTLNGGNQYVHNGGTTSDTVVNSDGWQIIKEGGLADFTTVNQKGKLQVNAGGTATNVTLKQGGALVTSTAATVTGSNRLGNFAVENGKADGVVLESGGRLDVLEGHSAQKTRVDDGGTLAVSAGGKATGVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIRFDNQTTQDAVLSRAVAKGDAPVTFHKLTTSNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESSGSYGFVRLESDLLRTEVAGMSVTAGVYSAAGHSSVDVKDDDGSRAGTVRDDAGSLGGYLNLVHTSSGLWADIMAQGTRHSMKASSDNNDFRARGWGWLGSLETGLPFSITDNLMLEPQLQYTWQGLSLDDGQDNAGYVKFGHGSAQHMRAGFRLGSHNDMSFGEGTSSRDTLRDSAKHRVRELPVNWWVQPSVIRTFSSRGDMSMGTAAAGSNMTFSPSQNGTSLDLQAGLEARVRENITLGVQAGYAHSVSGSSAEGYNGQATLNVTF

SEQ ID NO: 9709 - protein, 182 aa, Escherichia coli O157:H7 str. EC4196
MESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSFRIGVSFKL

SEQ ID NO: 9710 - protein, 199 aa, Escherichia coli O157:H7 str. EC4196
MRKLYAAILSAAICLAVSGAPAWASEHRSTLSAGYLHASTNAPGSDDLNGINVKYRYEFTDTLGLVTSFSYANAEDEQKTHYSDTRWHEDSVRNRWFSVMAGLSVRVNEWFSAYAMAGVAYSRVSTFSGDYLRVTDNKGKTHDVLTGSDDNRHSNTSLAWGAGVQFNPTESVAIDLAYEGSGSGDWRTDGFIVGVGYKF

SEQ ID NO: 9711 - protein, 790 aa, Escherichia coli O157:H7 str. EC4196
MKRVLIPGVILCGADVAQAVDDKNMYMHFFEEMTVYAPVPVPVNGNTHYTSESIERLPTGNGNISDLLRTNPAVCMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADHISWRNVSLMPGVRYDYDNYLSNHNISPRFMTEWDIFANQTSMITAGYNRYYGGNILDMGLRDIRNSWTESVSGNKTLTRYQNLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 9712 - protein, 96 aa, Escherichia coli O157:H7 str. EC4196
MKLKIVAVVVTGLLAANVAHAAEVYNKDGNKLDLYGKVTALRYFTDDKRDDGDKIYARLGFKGETQINDQMIGFGHWEYDFKGYNDEANGSRGNNL

SEQ ID NO: 9713 - protein, 1106 aa, Escherichia coli O157:H7 str. EC4196
MKITSSPKLFKGRFRSVCIVFALFLFQVGFAQDMRSVTGSVTSKDDGMPLPGVNIFVEDTNYAAVTDFDGNFTIELPASTMVLTVSSVGFITKSIEVSPTQQNLSIVLETDVAALEEVVVIGYGTSSRRNVTGAIASISGEEVAKVPVADATQALQGKLAGVNISTQDGRPGADVRVRVRGGGSISQSNQPLFIVDGFPVSSISNIPGNQIKSIDVLKDASSTAIYGSRGANGVIIVTTKSGSAGKTRITYDGFAQYSYIPEYIPVMNGYDYIAYNWAYADAIGDQYADAWEQLWAIGRYQEGNPEGIDYYRNVDSKDFTKELFNSAYTHNHNLNISSGTEKTKYLLALNHIDQDGNKTRSFYKRSNVQFKLDQEISSRLDFTINTRFVDVREGNNQGNSNAYWFRPIASDDILGESDVTVNTQLGDYNQVLQDFYNPVALLNDTDSDQRSRSLVANTAINWEIIDGLTAKTNFSISANWSRAKYWEGAIVNNYLDNAGNVTYSGDARIRAAEGWNLRWINTLNYEVQGLGEDHQLSVLAGMEISDSGSEFTDIRGNEFPASYDATRAWANMNDFLRREDQENFQLGSQIGIPNRLQSYFGRFNYSYLDRYLFTGTFRADGSSRFAPSNRWGYFPAGAFAWRLSEEEFLSNTSWIDDLKLRLAYGAVGSDAISSELWKQSWASATGTYSINETIQPLYRPASSLIANPDLKWETTITRNIGLDFTLFDRKVSGSLELYKNTVKDLLLVRDVSPLTGFSFTQENIGQTSNKGIELTLSTDIVTSENFNLQGGFNISINRGNIDELAEGIDGQYGSNWGSVAQNPREDYVFQVGQPVGLIRGYIYDGWYTTDDFNYDPDTQTYTLKDGVADYASGVLGNVYGTASNKPGAQTAYPGVQKVKDTNGDGVIDDLDIGIIGDTNPVHTGGFNFSGNYKAIDFALNFNWSYGNDLYNVTHQAAYLGNKEAGLFRNRFQELAGHYKIYDIVDGQLNQVVEPAALDALNENATTFLPYPENAVVSTFAIEDGSFLRLNTLTIGYTLPNPEKLGITRLRFYGSVFNVFTLTGYSGYDPEVNVDETGRSSYYPTPGFDYQAYPRPRTVTLGLNLEF

SEQ ID NO: 9714 - protein, 199 aa, Escherichia coli O157:H7 str. EC4196
MRKLYAAILSAAICLAVSGAPAWASEQQATLSAGYLHARTSAPGSDNLNGINVKYRYEFTDTLGLVTSFSYAGDRNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 9715 - protein, 746 aa, Escherichia coli O157:H7 str. EC4196
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPLDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 9716 - protein, 186 aa, Escherichia coli O157:H7 str. EC4196
MNVSKYVAIFSFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 9717 - protein, 813 aa, Escherichia coli O157:H7 str. EC4196
MGQSFTGRLLGVVVRDLRCSVSALSLSVALGSCLLLTVDAAAQTSSPPASATRTPSELPQVDVTAPKPRSSAAARSSETQKRQSTRSNTRRPVAAPAAAVADRQGQGDQRGVATPLNSSGVAASASRLGLTPRETPASVEVVGADTIREQGYHTTVDTVKGATGVTAGDAPNDVAYAMRGFQGNQINVTYNGINIGPTGFTALTMETFNLDRVEFLKGPSSLVSGQGAVGGAINFVTKAPHTGPITQEAFFGFDNRGSIRSGYGSGGSTKIDGLDYRFDISKSREVGFIDDTDTKNLHVSGQLNYRLTDTFKVFAATEFKDYQAKLYEGTPLVTSAYSGAFATSGIVSGNKISDYNLSALNNVTIDSRTLSTNYNVLDGHKTIKESWVRGGFEWAATNDVTVRSQFYNYNASRDWYNNEVIAFNANTNQVDRERFYVHHNQNMVGNNTDVTWNSNILGMDNRMVTGFEVYHLDFARPGAASIAPPDQVSLVDPVRGYYGTLQTQRQTAIIDSFAINLEDRLKITNNFALIGGLRYNPFTLDRTSVDKFGATKSGFPYSATWDPVTGRIGYTWEAVPGLTFYSQYATASDLSVGSLFLLSPTQKLTLTSARSYETGVKNLLWDGRAEWTLSLFDIERSNVYSAQAGQRLNLAGKVKSQGVELSGAVRPTPETKVWANVAYVNARYADYDFTGGTYSGNTPPNIPSLVVNGGASYRFLNPGWLPVELGFSVRHVGDRFTTDANVVMMRAYTTADVFAFVDIPKSRLLPTVDNTRVTFRVRNVTDKKYAVWSDPNYPDQIFLGAPRTYEIETSFKF

SEQ ID NO: 9718 - protein, 199 aa, Escherichia coli O157:H7 str. EC4196
MRKLYAAILSAAICLAVSGAPAWASEHQSTLSAGYLHVSTNVPGSDELNGINVKYRYEFTDTLGMVTSFSYAGDKNRQLTRYSDTRWHEDSVRNRWFSVMAGPSVRVNELFSAYAMAGVSYSRESTFSGDYLQVTDNKGKTHDVLTGSDDGRHSNTSLAWGAGVQFNPTESVAIDIAYEGSGSGDWRTDGFIVGVGYKF

SEQ ID NO: 9719 - protein, 614 aa, Escherichia coli O157:H7 str. EC4196
MIKKASLLTACSVTAFSAWAQDTSPDTLVVTAIRFEQPRSTVLAPTTVVTRQDIDRWQSTSVNDVLRRLPGVDITQNGGSGQLSSIFIRGTNASHVLVLIDGVRLNLAGVSGSADLSQFPIALVQRIEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIYYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 9720 - protein, 929 aa, Escherichia coli O157:H7 str. EC4196
MKNIMNKKINIFLAGVLCSLGVMAQEDTLIVRQNDEVVEMGRTITMDAREMTGAVSVTTNLSHKNSIKPSNQLFGTLPGLQVLQKAGTVWENGATLYIRGNSSLNSNSPLVLVDGFERSIDELSSEEIESVSVLKDAVATSLYGIRGANGVILVKTKRGSVGAPKITFSYEFNMASPKRLPKFADGYTYAMALNEAMENDGLAPRYSGTELDAFKNQTYPGVYPNVDWLDESLRDMSYGDNVNFTAQGGSQFVRYYTMLNFLDNRGLLKPTSDNDGYSTQLKYSRLNVRTNLDITVSPTTTVQLNLLGNFTEHNRPGESTDKIFNALFQVPSGAFPVKTDRGIWGGTTNYSNNPVALISGRGYARSQTRAMYADVNMKQDLSAILPGWSAGFKVGIDNTASYWDNNTKEFGYESASVDFATGENIYTTLRNEGTLGFSKSVGSVATHFNLEFYTNYIKQWNKHSLNATLLYSMDKAKTKSQNSGRAFMDIVGSAHYAYNNRYLVDFSLSGSASSILDPDDRWGIFPAIGAGWILSEENFMKRDWLNLLKVRASYGISGRADYGVNLFQNIYGSGNSYYFQNATNVPSSSSGMKFTQLGIDGLTYEKSHKLNVGIDFRAWNKLTMTLDAFYDHRTDILVSSGGSVSQIFGMSVPQINNGVVDNKGIEASLAWDDNIGNFKYHLGGQFTFTRNKIKNQNEEYRPYDYLKRTGSSMNQIFGYEVIGIYKSQDEIDNRGVEQLLGDVRLGDLMFKDQNGDNKIDAYDQVPLGYNATCPEIYYSFDLGLEYKGFGVYALFQGVGNYSKVLNTASVYRPIVNNNTISTYYWENRWSESNPNGTLPRLTYSGSDNNYNTNSMWVSDASFLKLRTLELYYNFPTKLLKKTGFLAGVKVFARGHDLFCLDGIDLRDPESIGTEHPTMTQYAFGFNLSF

SEQ ID NO: 9721 - protein, 1349 aa, Escherichia coli O157:H7 str. EC4196
MAFNALLFMQSWFYLDVLLEIVMNKIYRLKWNRSRNCWSVCSELGSRVKGKKSRAVLISAISLYSSLVFADDVIVNQDKAIDFGKENQSIDYRITVTDNANLVINTTDTSRPRLTLASGGGLDITGGKVTINGPLNFLLKGTGFLNVSNAGSELYADDLYESNSGMRHDQGYFNVSNGGKIHVKGTSRLTYTQGNVSGEGSQVNAGTFFMGVYGGYGGNQFLSVNNGGEVNAREHISLGYYDQRSDTTLVVSDGGKISAPKISLSTNSELALGAQEGSAAKAAGIIDAEKIEFVWAKTSDKKITLNHTDKNATISADIVSGSEGLGYINALNGTTYLTGDNSAFSGKVKIEQNGALGITKNIGTAEINNRGKLHLKADDSMTFANKISGNGTISIDSGTVALTGNNYAFSGYIDVASGAVAVISEDKNIGRADLDVDGKLQINANKDWVFDNDLQGRGIVEINMGNHEFSFDEFAYTDWFQGSLAFQNTTFNLEKNAEFLQRGGITAGQGSLVTVGKGAHSISTLGFSGGTVDFGALTAGAQMTEGTVNVSKTLDLRGEGVIQVSDSDVVSSVSRDIDSALSLTEVDDGNSTIKLVDAQGAEVLGDAGNLQLQDKNGQILSSSAQRDIQQNGQKAAVGTYDYRLTSGVNNDGLYIGYGLTQLDLHATDSDALVLSSNGKSENAADLSAKITGSGDLAFSSQKDQTVSLSNKDNDYTGVTDLRSGTLLLNNDNVLGNTHELRLAAETELDMNGHSQTVGTLNGSADSLLSLNGGSLTVTNGGTSTGSLTGSGELNIQGGTLDIAGDNSNLTANVNIANSANVLVSHAQGLGSANVENNGTLALNNSAEKRAAASVNYTLGGNLTNNGTLMTGMSGQQAGNVLVVKGNYHGNNGQLVMNTVLNGDDSVTDKLVVEGDTSGTTAVTVNNAGGTGAKTLNGIELIHVDGKSEGEFVQAGRIVAGAYDYTLARGQGANRGNWYLTSGSDSPELQPEPDPMPNPEPNPNPEPNPNPTPTPGPDLNVDNDLRPEAGSYIANLAAANTMFTTRLHERLGNTYYTDMVTGEQKQTTMWMRHEGGHNKWRDGSGQLKTQSNRYVLQLGGDVAQWSQNGSDSWHVGVMAGYGNSDSKTISSRTGYRAKASVNGYSTGLYATWYADDESRNGAYLDSWAQYSWFDNTVKGDDLQSESYKSKGFTASLEAGYKHKLAEFNGSQGTRNEWYVQPQAQVTWMGVKADKHRESNGTLVHSNGDGNVQTRLGVKTWLKSHHKMDDGKSREFQPFVEVNWLHNSKDFSTSMDGVSVTQDGARNIAEIKTGVEGQLNANLNVWGNVGVQVADRGYNDTSAMVGIKWQF

SEQ ID NO: 9722 - protein, 199 aa, Escherichia coli O157:H7 str. EC4196
  misc_feature (169)..(169): Xaa can be any naturally occurring amino acid
MRKLCAVILSAVVWQVAAATPASAAEHQSTLSAGYLHASTNVPGSDDLNGINVKYRYEFMDALGLITSFSYANAEDEQKTRYSDTRWHEDSVRNRWFSVMAGPSVRVNEWFSAYAMAGVAYSRVSTFSGDYLRVTDNKGKTHDVLTGSDDGRHSNTSLAWGAGVQFNPXESVAIDIAYEGSGSGDWRTDGFIVGVGYKF

SEQ ID NO: 9723 - protein, 116 aa, Escherichia coli O157:H7 str. EC4196
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWT

SEQ ID NO: 9724 - protein, 199 aa, Escherichia coli O157:H7 str. EC4196
MRKLYAAILSAAICLAVSGAPAWASEHQSTLSAEYLHASTNVSGSDDLNGINVKYRYEFTDTLGMVTSFSYAGDKNRQLTHYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 9725 - protein, 362 aa, Escherichia coli O157:H7 str. EC4196
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDSARRSNGDGVGGSISYEYEGFGIVGAYGAADRTNLQEAQLLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 9726 - protein, 1300 aa, Escherichia coli O157:H7 str. EC4196
MNKIYSLKYSHITGGLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAIITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGSSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 9727 - protein, 747 aa, Escherichia coli O157:H7 str. EC4196
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLFNLYNPVNPDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 9728 - protein, 199 aa, Escherichia coli O157:H7 str. EC4196
MRKLYAAILSAAICLAVSGAPAWASEHQSTLSAGYLHVSTNVPGSDELNGINVKYRYEFTDTLGMVTSFSYAGDKNRQLTRYSDTRWHEDSVRNRWFSVMAGPSVRVNELFSAYAMAGVSYSRVSTFSGDYLQVTDNKGKTHDVLTGSDDGRHSNTSLAWGAGVQFNPTESVAIDIAYEGSGSGDWRTDGFIVGVGYKF

SEQ ID NO: 9729 - protein, 285 aa, Escherichia coli O157:H7 str. EC4196
MLYLTKISNAGSEFTENEQKIADFLQANVSELQSVSSRQMAKQLGISQSSIVKFAQKLGAQGFTELRMALIGEYSASREKTNATALHLHSSITSDDSLEVIARKLNREKELALEQTCALLDYARLQKIIEVISKAPFIQITGLGGSALVGRDLSFKLMKIGYRVACEADTHVQATVSQALKKGDVQIAISYSGSKKEIVLCAEAARKQGATVIAITSLTDSPLRRLAHFTLDTVSGETEWRSSSMSTRTAQNSVTDLLFVGLVQLNDVESLKMIQRSSELTQRLK

SEQ ID NO: 9730 - protein, 760 aa, Escherichia coli O157:H7 str. EC4196
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9731 - protein, 199 aa, Escherichia coli O157:H7 str. EC4196
MRKLCAVILSAVVWQVAAATPASAAEHQSTLSAGYLHASTNVPGSDDLNGINVKYRYEFTDALGLITSFSYANAEDEQKTRYSDTRWHEDSVRNRWFSVMAGPSVRVNEWFSAYSMAGVAYSRVSTFSGDYLRVTDNKGKTHDVLTGSDDGRHSNTSLAWGAGVQFNPTESVTIDLAYEGSGSGDWRSDAFIVGIGYRF

SEQ ID NO: 9732 - protein, 199 aa, Escherichia coli O157:H7 str. EC4113
MRKVCAAILSAAICLAVSGAPAWASEQQATLSAGYLHASTNVPGSDDLNGINVKYRYEFTDTLGLVTSFSYAGDKNRQLTRYSDTRWHEDSVRNRWFSVMAGPSVRVNEWFSAYAMAGMAYSRVSTFSGDYIRVTDNKGKTHDVLTGSDDGRHSNTSLAWGAGVQFNPTESVAIDIAYEGSGSGDWRTDGFIVGVGYKF

SEQ ID NO: 9733 - protein, 356 aa, Escherichia coli O157:H7 str. EC4076
MDDNEAQKMKKTAIAIAVALAGFATVAQAAPKDNTWYTGAKLGWSQFHDVGNNQIDNNGPTHESQLGAGAFGGYQVNPYVGFEMGYDWLGRMPYKGNTQNGAFKAQGVQLTAKLGYPITDDLDVYTRLGGMVWRADAQNNTGFKDHDTGVSPVFAGGVEYAVTRDIATRLEYQWTNNIGDANTVGGRPDNGLLSVGVSYRFGQQEEAAPIAPAPAPAPEVQTKHFTLKSDVLFNFNKATLKPEGQQALDQMYSQLSNLDPKDGSVVVLGFTDRIGSDAYNQGLSEKRAQSVVDYLISKGIPADKISARGMGESNPVTGNTCDNVKARAALIDCLAPDRRVEIEVKGVKDVVTQPQA

SEQ ID NO: 9734 - protein, 993 aa, Escherichia coli O157:H7 str. EC4076
MSGSNALKRYRPQKTLAALAVGSVLFLSAPAAMAADGLGVMQGHITTESGSNLSNAKVIIKHESKGIVRETTTGANGSFSLKGLPIGKYTVSISKDGYYKVSEQHIAVTIGNALTFDVALDLEDSGVERIAVSGARISRVDTSSTTTSQVISMSELNQLPVELDSTAIALLTPGSVAGDDGFGGVAIGGSSVAENGYYLNGLNITDLRKGMGDIDLPWEAIAQTEVQTGGVSAEYGRFIGGVVSLVSKSGDNEWKFGAKAEIAPDSLAEPTLRMKDDGTIEEAKEGYWQETEYNIWASGALIEDKLFFYGLWNPFEEDVTAYDENQISDKEWKTNRWFTKVDWFIHEDHSIGVMAFSNEGDYEKTEFQRADDGGRGDEIGLTETTYGGIGWNALYTGYLTDDITLSAMYGEITQSTKDNSGTLDQSTYWDLRSGTWERLGDWVGYGSSETEDKRITYRIDLDWVIGDHTLRAGYDYERLEIADIYTPHGEGWYEYFAAGADNAYGLAEGTEYADLRIWGKNSETENVHTALYVSDTWAVTDTVTINAGVRYSEFSNTTGSGDKYVDLDGQFAPRLGATWDVLGDGASKLYASYGRYFQPVSPNTNLRMASAAYDSHIVSHLDGVNADGSPILGDEISRRVVADGSVPDADQLFNNKAGSMYSDEFAIGYQQQVSDDWAVGIRGVYRDLKQSIEDVSFNYGMNQWILDNYDANTWHAGNGETSAEDYFVGGWFPTLTNPGIGTEIYYDVDGDGVKETVNVNADQMGFPEAERTYKAIELNFSGNVTEDFTLNGSYTWSKSEGNTEGLVRSDNEQADPGWTTSFDYPELMDNGDGYLPNDRRHNFKLYGVYNITDDFSVGFNSYLQSGRPINAFGIHPEDQGYCVQAVAIDGTCYGRDWYGASSFYADGEAAPRGSMGRTDWIYNIDLNMSYTMDFNEAGRLNFKLNVYNLFNFDGVKGVDEQYEFDSGAKNLRYGYPDSFQTPRYVRASVRYDF

SEQ ID NO: 9735 - protein, 790 aa, Escherichia coli O157:H7 str. EC4076
MLIMRNKVILQISILALIQTPLTLFSTEKVKEGHVVVDSITIITEGENASNKHPLPKLKTRSGALFSQLDFDEDLRILAKEYDSVEPKVEFSEGKTNIALHLIAKPSIRNIHISGNQVVPEHKILKTLQIYRNDLFEREKFLKGLDDLRTYYLKRGYFASSVDYSLEHNQEKGHIDVLIKINEGPCGKIKQLTFSGISRSEKSDIQEFIQTKQHSTTTSWFTGAGLYHPDIVEQDSLAITNYLHNNGYADAIVNSHYDLDDKGNILLYMDIDRGSRYTLGHVHIQGFEVLPKRLIEKQSQVGPNDLYCPDKIWDGAHKIKQTYAKYGYINTNVDVLFIPHATRPIYDVTYEVSEGSPYKVGLIKITGNTHTKSDVILHETSLFPGDTFNRLKLEDTEQRLRNTGYFQSVSVYTVRSQLDPMGNADQYRDIFVEVKETTTGNLGLFLGFSSLDNLFGGIELSESNFDLFGARNIFSKGFRCLRGGGEHLFLKANFGDKVTDYTLKWTKPHFLNTPWILGIELDKSINRALSKDYAVQTYGGNVSTTYILNEHLKYGLFYRGSQTSLHEKRKFLLGPNIDSNKGFVSAAGVNLNYDSVDSPRTPTTGIRGGVTFEVSGLGGTYHFTKLSLNSSIYRKLTRKGILKIKGEAQFIKPYSNTTAEGVPVSERFFLGGETTVRGYKSFIIGPKYSATEPQGGLSSLLISEEFQYPLIRQPNISAFVFLDSGFVGLQEYKISLKDLRSSAGFGLRFDVMNNVPVMLGFGWPFRPTETLNGEKIDVSQRFFFALGGMF

SEQ ID NO: 9736 - protein, 627 aa, Providencia stuartii ATCC 25827
MFHTRFLLLATSAFLPTIAMAQDGATDQPLLLDEIVISGGLTPLAADGYGRAHSVLTAKEIEARGITTVQDALRAMPGVAASSTGASFTQVRIRGAEANHTLILIDGIEATGGADEYILTGLETANIERIEVLRGPQSVFYGSNASAGVINIITRKGGPGLHYGGSFELGNGAAASAHVSQRTERGGIALNLSARDDHGYDQSGDGGEKDGINRKTIGLSGDWRASDDLAVGGTLRWSDEHYDYDATAWDATDADSYVVDDPDLFSERREFSGAVWAEYSMLDGQLTHRLEYQKTIYKQSYDGGPFSRGETEKLKYRLSYGLDGQPVDSANHVLNLLAERQKDQNSTAPDYRRDMKSLTVEYRGFLDNGLDIQAGIRHDDNKVFDDFTSWNLGLSYRIPGQPVRLHASAGSALVNPSYYELYADDAYTVGNSGLKPEINRGFDLGVEVEVLNGRGLIDVTYFNEKMEDEITYVYGAAPDGRASYVNQPGKSPREGVEVTGRLQATEDLSLALNYTYLDASNPDGSVEIRRPRHELGLSATLAFLQGRGSVTADLRHVSGNYDSQFWGAYSTEHLPTYTTVNLAAGYDLTNNVRLNARVVNLFDKDYSDVWGYASQGRTAYVGLQARW

SEQ ID NO: 9737 - protein, 192 aa, Providencia stuartii ATCC 25827
MKNNLLIALAAAAISTGAITSANANDWYVQGTGGLSLGSITEDVKGGDDNTFKDEGFSGRIGAGAYVYNNFRIGLEGGYAAFSKNATDIDVWDILAVAYYDFENETAFTPFVGLGAGLSHMKIDFDDGVDSFKNTTNHFSTKLGAGVGYEISENLELLAEYSFQYNFKTKVTNGVDVTAHQNQFNVGLRYSF

SEQ ID NO: 9738 - protein, 364 aa, Providencia stuartii ATCC 25827
MNKSILSAVILTALTSGSAFAAHTFTNDAGDSLTLDGRFDVRYQDKGGDHNGEWNSGSSRFGLKGQMGLDNDWTGFGHAEWGYNSGANGDNIYDRLLYAGVEHEKYGKIAAGTKQWSTFYDVAWFTDMGRVFGSRGSGYYNLSDWGISSGTGRAENSITYRNSINDNWKYGFTYQTTREDVAVSTRFNQTNSDTVTLKNGIGASTLYTVMDGLTIGLAYHQNEFDDVDSTVQNIKDGDTQRIGLLGVNYTNDGLFVGFTYSQGSNWETTSQSEFYDHRGAEFFTYYHFENGLRPTFNVNYLTDTDDNANGYERQLIIPGLEYHFKKNKFLVWTEYQFDNGKDSYNGVKYENNDDQFAAGIRYYF

SEQ ID NO: 9739 - protein, 807 aa, Providencia stuartii ATCC 25827
MRKNILFITSCLLATTTFAENINTLPKDTTKVIDIEEVVVIASPKETGKLRELPTAVSLLSQKDMQANQITTLKNVSSLVPNFFMPDYGSRLTSAIYIRGIGSRINTPAVGLYVDNIPYIDKSAFDFNFYDIERIDILRGPQGTLYGRNTMGGLIKVHTRSPFSYQGTDVKLSYGTKSNYRSASLTHYHRWSDCFAFSAGGYYEGSDGFFRNSLNGKKVDNMEAGGGRIHAIWLPSENLKLDFTIGYDYSDEGGYPYYYTGAIDGYDKENEKYKNYTGKISYDQDCTYRRGLFNTGLNIEYQAQKFILSAVTGFQNLNDRMFMDQDFLPVSIYTIEQKQRLNTISEEITFKSKNNKRWQWVTGVSGFYQWLHTTGPVNFMEDGVTDMIEGNINNTFKKIHLDNPRTPEMSLDVLNNRIRVSGSFDTPVFSTALYHQSTFNDLFVKGLSVTAGLRLEYEKMSMNYFSDSNIDFDFFLKMAMPPLNIPFRNLNAAPLLEGKEKNDYVQLLPKLAFKYDFSPANNMYVSITKGYRSGGYNVQMFSELIQSDMQQKMIEAILNKAPESMAGMIEGMIKQHMPNYGKELNVQETTVYKPEYSWNYEVGSHLSLFNGKLKTDLAAFYMDTHDQQIAKFVNSGLGRMMVNAGSSESYGVEASFLASINKNLNMNVSYGYTHSTFKKYDGGTTSSEEQIDYSGNYVPFVPRHTMNAGANYSFFFDKSNWMQSLTLGMSYTGAGKIYWTEKNNVSQSFYGTLNGRISLQTEALQIDVWGRNLTNKDYTTFYFETMHRGFEQKSRPLQLGVDIRYHF

SEQ ID NO: 9740 - protein, 208 aa, Providencia stuartii ATCC 25827
MKIKHLLFAGATSLLASNAHAADLEVEPVAIQTYDWQGVYGGGQFGFGWFEGRDNLGSPPENLASPVGGVHVGYNHMLGQFVLGIEGEANLANFSDTTSANLDVDINWMIAARLRAGYAFDRFLAFATTGVSFSEVTFEIPGTGISDSNTHTGFLFGGGVEGYVTEHISVRAEYQHHWFGNESYNVGAGAFDIEGDLDLLRAGVSYHF

SEQ ID NO: 9741 - protein, 211 aa, Providencia stuartii ATCC 25827
MNNKLILGVALMSAVATNSVMAEESGLYLGGAIGTVDFEDDDLVSSTTEPVTFEAEDNSYRLIAGYKFNRIVSLEVQYTDYGDLVAKNHADKTEGFTWTPQTVSVAANLGYTFDNGMRPFGIIGLSSIDLDMKNADGSRPSGSDFDDTGTGVRFGVGVEYTPPKLSALSLRLGYEADAFTLETYEGDFWNRRKVEKDIVLESFYLGATYNF

SEQ ID NO: 9742 - protein, 724 aa, Providencia stuartii ATCC 25827
MRVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGNTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWNWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 9743 - protein, 752 aa, Providencia stuartii ATCC 25827
MVVESSSFGAMGRGACGGHAAFWKEPMARMHDMARAEHALILINKSLMIGISLATLLAAAPALAQQAASGARSTPATATAPAGNVNGATGGDSQQALPTISVNDAGNSLFGDPYATPAAVSSVDLLNSPGDYERLDDVLRSVPGTFTTQSTSNPGVAVNIRGFQGMGRVNMMIDGVRQNFRFVGHEAGGFTYVDDQLLAGMDIARGAVSTAGGAGALAGAVNMRTLGIDDIIKPGSTWGAIANVQWGSNGQGWQEMVASAVRMNDRFAVGGAVATRDTGNYKNGDGQTVPYTGQDLTSGLLKADMKLTDDSRLKLGAVFYNNFFYADSADQHVRNNTFTGNYSYTPGNDWIDFRLNAYLNDLKMVYGNVPATTSSYRGRVIDDRGWGFDTSNTSRFLLGQVAVATTYGAEYFYDDVSSTNTVTPSLYGGVNPAGTSAIGGVFDETKFNYSIFELIVGLRYDFFNLNGSGYENSMGGAVPVGPWTVDQDKGRFDPKVTFAISPFDWLQPYVTYAETMRAPTASETMIGGEHPGTSVSYSANPYLQPEVSKGWEFGVNIRRNGIFTANDQLRLKADYFTNDIDNYIVTCRKTQYYFCNVAGTSTVSGVEFEAHYDARKVFADLTYTHNTNDLPAQTQGFGANQYLPEDIVTVSAGLRFLEEKLSVGGRYTYVSEGQTLAYNASFLGTVSSTPSPAYNIVDLFSSYAVSDKLTFRFDATNLLNENYTPALSIQPTGFSGDTGQGRTYLLSLRAHI

SEQ ID NO: 9744 - protein, 1051 aa, Providencia stuartii ATCC 25827
MKIKKHILIPLMVLLLFGSMDAMAAIEQAIQVKGKVVDNIGEPVIGANVVVKGTTTGVITSIDGSFAIDAVKGSTIVVSFIGYLSQEVKVTGNFLNITLENNTELLDEVVVVGYGVQKKANLTGAIATVGAKELEDRPVTNAAAALQGKVANLNISNGDGGPGKKASFNIRGYAGLDATYSPLVIIDGVTGYFDDLNPNDIETLTVLKDAAASAIYGAQAAYGVILVTTKSGKKNEKTVINYNNNFSFNSPTVLPKTAGSLEFSRLFREADINGGGSGIIDLETMERIEKYYYDPTSIPNNVPQRDNPDRWADWGDGRSNANEDWQKAMFKNNQLNQQHNISIRGGSDKTTYVMSLGYLKDEGKLRYYDDHYQRYNALAKITTDVTKWLTVGLNVRYSHEKSVSPAYGMNPGGSVNDMIGWTQVVWPTIPVRDPNGHFSPAGRMVFIADANPQTSYTDNFWGTANVVIKPLKGWTINADFTYNKWMNKRSYSKGLIYSYSVSNEPYLEGGFGTEDTRVWQESNNDDFTSMNAYTTYEKEFKGHNFKIMAGMQSEYKKNFGLYANKMGMVLPGQPSISTSTGKIEAWDSLDHYATLGFFGRFNYDYKSRYLFEFDLRRDGSSRYAKGHQWGTFPAFSAGWNVAKEAFLEPYTSILSELRLRGSWGELGNMRGKNYQYISTVPYNATTDYIMGDKRISAFGAPNMIAYNTWEKNRTLDFGVDIAALNNRLTMSFDWYRRDIIGLITKGVTLPAVLGVNSPDTNNADIRNEGWELTLGWRDQFSLASKSFNYSVSFNLSDYQGTVLKYSNPKGLIYDYYVGKKMGTIWGYTTDHIMTDPAEAKAINDSGVQNKFGGDWVVGDIKYVNLDDDPNINDGNQTLEDHGDLSIIGNDTPRYNFGFGFNADWNGIDFSMFLQGTMKRDLWLEGPVAFGLGGGQWGSNVWKNTLDCWREDGSNPDPWLPRLYLWSTSKNLQKQTRYMDTGAYCRLKNIQLGYSLPGAIINKVGLEKVRIYFSGDNLLTFSGINENFDPEAPWGGAYPISKSISFGVNVTF

SEQ ID NO: 9745 - protein, 804 aa, Providencia stuartii ATCC 25827
MASAANGASHLPSYKSQDCVALIRTRFRIPETFSHALCHICVNRVNSVAPRHAGRAAPPPESGVLPMSASRSLKISALAVAVVSLLPLHAVAQQTPSDDGVVRLDAVKVTVERRSEDSKDVPVSASVLRPEFLDAISTSGSDIRVLAGKAPSLNIESSNGRVFPRVYIRGYGNTDFNTYASQPVSLIYDDVVQENAFLKGFPIFDLEGLEVLRGPQGTLFGRNTPAGVVKFNSVKPTIGANDGYASLSYGTYGTMTLESGLSIAMGDHWAARLSTLGQRRDDWVENRDGRDLEGYTDSAVRLQLLYQASDDFSALFNAHARHLDGTARLFRANIIQPGTNQLVDGFDADKSFIDGANRQELQTYGGSANLSWDLGDIALHSITAYEGIGKYYSRGDIDGGFGAVFAPPSGPGVIPFPVETAGGIKSLDQYSQEVRAESQYDGPLNWQAGLYYFHDDVEGENYTYNTLSGGDLASYQLTRQRNTSWAAFGSLNYAATDRLNLRAGIRYTYDKKTFDVLALDRVTLVEPSSGQTDNSKVTGDLAATFSINDDVNVYARAARGFRGASFGVPSGTAPLTVAEPETVDSFELGIKSDLFDNRARLSFDIYDFRVKNQQLTAVGGASNDVRLLNADKTKARGAEFDFEALLTQNLRVTAGGAYNWTRIDDPNLSVGICRTCTVTDPINAAGRAVIDGNDLPQAAKWMANATLRYGIPMGNDGELFFYTDWSYRSEVNFFLYDSKEFTGQPLVEGGAKIGYNWGAGAYELSVFCRNCTNQIRVTGAIDFNNLTGFINDPRIVGAQFRANF

SEQ ID NO: 9746 - protein, 368 aa, Providencia stuartii ATCC 25827
MEFKKTILGLAVSSLVLSASVFAADGDGVDSQQLQDSASYEVYGIIALQAAYRDYDTGDKAVNDDLGGTQLNNESRIGFRGSKQFKNFGPKFIWQIEGGYVDPSFGGEGAGLGERDTFVGFESDQLGQVRLGRVLTPIYELIDWPASNPGLGDVYDWGGSIGGAKYQDRQSNTIRWDSPTYAGGLSFDVAVGAGDSASTGSGDDYWGGLAAHYNIGFLQFDAAYEGNRNIESEGQDWENDTYLLGLQGWFDNGISFFAQYKYMEASTKVGRDEKQDAISTGLMYTTGDWQFKAAYAANFELEVDGKTIKNTDDDVISVQAMYFVDPSAVLYARARTNDFGDAAVGADGKERWKSGSFDELSVGVEYYF

SEQ ID NO: 9747 - protein, 440 aa, Providencia stuartii ATCC 25827
MSQKNLFTKSALAAAVAIISSNVSAAGFQLNEFSSAGLGRSYSGEGAMADTAASASRNPALLMMYTRPELSLGAVFIDPDVDITGKSPSGASLDSKNIAPTAWVPNLHYVQPINDQFAVGGSVTSNYGLATEFNDGYTAGAYGGKTDLTTVNLNLSGAYRLNQQFSFGLGFDAVYAKAKLERYAGELPKLIAGSGQLPPQLAGPVSQIPADTQISHLKGDKWGFGWNAGILYEVDENNRYGFTYRSEVKIKFDGDYKSSLPSAYNPLLGALGLPMGTDGTTIPGSLDLNLPEMWEISGYNKVAPQWAIHYSLAYTSWSQFQELKATGNNGQTLFEKHEGFKDAYRIALGTTYFYDDNWTFRTGIAFDDSPVPAQNRSISIPDQDRFWLSAGTSYAFNKDASVDVGVSYMHGQKVTIKEGPYTFESVGKAWLYGANFNYRF

SEQ ID NO: 9748 - protein, 843 aa, Providencia stuartii ATCC 25827
MVNKNTNKDIVYFLFPSVIALSLTLSFSSYSANRFNPAFLADSPDAVTDLSYFEAGNRIKPGDYLLDIVFNHEYLRSENIHFISQDNHVIPCLNRDYYQSLGINIKLFADFEKFSANECIDIEKIIPDSVVNYDIEKQALNIQVPQAALDLKARGYIPPEKWDNGITAGILNYTFSGANSWGNSHNNSYYLNLRSGINIGAWRLRDYSTWNSSNGKNQWNHINTYLQRNIVSLRSQLQIGDSYTSSTLFDSVNFRGISLESDDTMLPDSQRGFAPVVRGIAKGNAKVVIRQNGYVIYQTFVSPGAFEIRDLYPTSNSGDLYVTIEENDGSKHSYVVPYSAVPILQREGQKQFVIQAGEIRQNNQHKKPRFIQGHLIYGLPYDTTVYGGALATKDYQSYALGAGKNMGTLGAFSTDITFAHSQLPNNSTSDGYSLRFLYAKSLNQFGTNFQLLGYRYSTSGFYTLDETLNTRMSGYLYEDNQKKPLSYFNLHNRKKGSLQINLSQQLGDYGSIFMMTNWQNYWGTNEKNVLVQTGYNGNIKGLSYNVIYSYNRMMNSGQRDQTLSVGLSIPLQLLMPTSYQSINSTYLTYNYSHNNNGYSTHNAGIAGTLLEDNTLNYSVQQGYSNQGGNYTGSAALGYQSRYGNLNASYNYHQDAQQINYSLAGGMLLHSGGLTLSQPLSANAILVDARNTADVPIDNATGVYTDWRGFAVIPYATAYRQNRVALDTTALPDNVEIEQNIKQVIPTQGAVIKVQFDAKKGYRLLLTLQHQGRPLPFGAIATDKQNHLSGIVGDDGLLYLSGVPDSGKLEIRWGHNASQYCQVNYQLPASQLDEPFVKMTQECQ

SEQ ID NO: 9749 - protein, 1250 aa, Providencia stuartii ATCC 25827
MRVIFLRKEYLSLLPSMIASLFSANGVAAAIDLCQGYDIKASCHASRQSLSGITQVWSIADGQWLVFSDMTNNASGGAVFLQQGAEFTLSPENETGMTLFANNTVSGEYNNGGAIFAKENSTLNLTDVIFSGNVAGGYGGAIYSSGTNDTGAIDLRVTNAVFRNNIANDGKGGAIYTINNDIYLSDDVFNNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFAHSLTGFQNGTLNIDAGGNVTVNQGSFAGTIEGAGQLTIAQNGSYVLAGAQSMALTGDIVVDAGAVLSLEGDAADLAALQDDPQSIVLNGGMLDLSDFSTWQSGTSYKDGLEVSGSSGTVIGSQDVVDLAGGNDMHIGGDGKDGVYVVIDAGDGQVSLANDNQYLGTTQIASGTLMVSDNSQLGYTHYNRQVIFTDKPQESVMEITANVDTRSTTTEHGRDIEMRADGEVAVDAGVDTQWGALMADSSGQHQDEGSTLTKTGAGTLELTASGTTQSAVRVEEGTLQGDVADIFPYASSLWVGDGATFVTGADQDIQSIDATSSGTIDISDGTVLRLTGQDTSVALNASLFNCDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTQDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDASTISDDAVKQRGEIKVGVTGNISQRVSLRGSVAWQKGSDDFAQTAGFLSMTVKW

SEQ ID NO: 9750 - protein, 366 aa, Providencia stuartii ATCC 25827
MKKTAIAVAVALASFATIAQAAPKDNTWYTGGKLGVSQFHDTGFYGNGYTGVNNNPIKSKLGAGAFVGYQANPYLGFELGYDWLGRMKYAGSTASNDDSASFKAQGIQLAAKLSYPVMPDLDVYTRLGGMVWRADSHAATSVNTGTRADINNDDTGVSPLAAIGVEYAIDKNWATRVDYQWVSNIGDAGTVGARPDNLLMSVGLSYRFGQDDRVAPVAAPAPTPAPAPVVETKRFTLKSDVLFNFNKATLKPEGQQSLDQLYTQLSSLDPKDGSVVVLGFTDRLGSEQYNQALSEKRAQSVVDYLVSKGIPANKVSARGLGKSQPVTGSTCDNVKPRAALIDCLAPDRRVEIEVKGIKDVVTQPQA

SEQ ID NO: 9751 - protein, 751 aa, Providencia stuartii ATCC 25827
MIINPINIKWDGSTFIPNTEHLMSHRTTLSLSLISTALFTALSPQVIAQEIDSQATIEQISIFGERNPLNTVPGSAHQIGQAELDTFKYTDIMRTLSSVPGVYIQEEDGYGLRPNIGMRGTGQNRSEKITIMEDGVLAAPAPYASPAAYYFPTPGRMQSIEILKGSSTVKYGPRTTGGVLNMISRQIPEEELAGQLDIAAGQDGFGKIHAYAGGQGERVGAVVDLYRYQADGFKDINGVGGDTGFEKNDALAKVSIRSAEGAQYEQIVEFKLKYSDEVSNETYMGLTDADFDATPYARYSASQKDVMNTEHKQLQINHIIDFSDNLTLGTTAYYNDFARNWYKADKVDGLKLSKGGVEAASAFDKNPASAPMDVRVKANNRSYISQGIQTELNWYLDNHDLAFGARYHEDEMDRFQWADHYALDANQVMTRTESGLPGSDSNRIDSAEAIALYVQDKIQLGDFNITAGLRYEDVKTNRTDWGKENSGRDGEPKKDIDNSFSATLPSLSVTYQINSDLLVLAGVQKGFAPASPGNADKVEEKSWNYEAGARYNSGEFSSEAIFFYSDYSNMHGECTASKGCDDENIGDQYNGGEVDVKGLELSLGYSFNTQNDISFPVKLAYTYTDAEFANSFDSDFDPWGNVEEGYKLPYIAENMLFASAGVKSDNWELTLAARYTDDIRTKAGEGEIAQENLIEAKTIVDLSGRYFISEAQELYLTAENLFDKKYVTSRVYGSNFVGKPMTVSVGYTYKF

SEQ ID NO: 9752 - protein, 495 aa, Providencia stuartii ATCC 25827 [sequence omitted]

SEQ ID NO: 9753 - protein, 702 aa, Providencia stuartii ATCC 25827
MRKLPAYLGVLSLICSAVPVARGEEASQDRESMKHLTMEEIVVTDTAVTDPAATVVGVKTIEKGRSTTIPDVLENEAGIDISRKALVGDTGDTLKIRGLSGNRIMLNIDGRSVNAAGVQGGYFVDWSTIPLDNIEKVEVIYGGGSVKYGNNAGGGVINVITKKPTEKPTVSMYGNFGAGDHISDMQNYRVTHTYKVGPIGYSIAGSYQHADEYLWNNDYEAKNIAAKLYVDMPFRGEMTLGMQYTDVDRGFALSNRLSSKINDPNYDVKRNDAYPLSSGDSFSPGAGNVTTAGPGANWNKTKYLLDFGYKQPIGTALVEFKAYKNHEDRHEKNYSANWINSSYSNGKLVLDRTVKSDRSYGGSLELFVPIRDHEIAIGAERKIIATGGQDVDYVDTAYGVKGTVADSNGDSAHMWGIYLQDSWSVTDSFLLTPGVRYDLYKGPTSEGGQLEDYGVSFSLTGTYKLTDSDVVTASVYRKYLTPSAPDAAWWSDGYGQYYTKELKLERNNAIEMAYQHSFSPKDYLKLSAYHYMIDDYISRFSRTDGRGCYNIDRVRLTGVSLEGATEPLPWVALRGNVTYQKSKKKGDSMDPAQVSDELEYLPEWKGNAGVDFRLPYAATFSVKERVVGITKTVQSYTEKGTTTYKRLQLSPHATTDIELRVPVTQHGELSVYCENLLDHHYQERYGYALPGRIVGASAKVSF

SEQ ID NO: 9754 - protein, 546 aa, Providencia stuartii ATCC 25827
MGLICGLAIASGLTVTIPSEAQTISVNEFFPPVNRYQLGASNLGNGVNQVTSVAELRDVQPSDWAFAALQSLVERYGCLVGYPDRTYRGDAEGTLRARPLSRYEFAAGLNACLNTIEQLLQENVSVAQGDLDLLKKLAQDFQAELKQLAVRVDNLETRTAFLEDHQFSVTTKLYGQTITSLDKVFGDRVGGGSNEFQTQFAYRVRFNLETSFTGKDLFRTRLQFSNFLNGVEQTGTNMTRFNYDDNSNNNVEVSHLWYRTPLTDNLTLRLGTVGVGYTDLVDTLTPPTIADDALGIPSRFGEYDPVYRRGGGGAGFNWQITPTVQLSVGYLATNPNDPDPGNGLFNGGYHTLAQLAYQTADGGIGFTYSRSYFPAGNTDLMAGTGSLLAIQPFGEVIATAGNFYTLQGYYRITPHVQIHGWGGFVEAQAQGGGLSNLSNGVGGTVLRDVSWNSSAIWYGLVGISFPDVGGEGNLPGIALGIPPTVTASNLPGAVGQTTPYHLEAFYRIQLNDNISITPGFWVVLNPEANSNNATQYVGHIRTSFLF

SEQ ID NO: 9755 - protein, 941 aa, Providencia stuartii ATCC 25827
MMKHLRKLLFSIFVCLLSIAYAQAQVTLSGVVKDNKTGEGLVGVNIVVDGTVQGTTTRADGSFSMSVSQPTPFKLKISYIGYASQTVDITGSNSNIQVSLKESNSLIGEVVVSASRVEEKILESPVTIEKMDIIAIKNTAAPDFYDGLANLKGVHINKGSMNFASINTRGFATISNVRMVQLMDGMDNAAPLLNFPTGNVVGISELDMESMELVPGAASALYGPNAFNGILMMNSKSPFEYQGLSVLVKGGVATSNTAKDGATAYGNQPLYNTSIRYAKSFLKDKLAFKVNFSLSQAQDWRSNDYVTHRTDVTTLRNETQPTIGDPSFDGLNSYGDEVPIVAPFGTASFANTVALGVINNPAFAATLASQFGGNTALAQGVVANGLQSLGTVPLRRLGYKEEEMLESFDARSMKISAALHYRITPKIEASFSFRRGSGSSVYQGGERYALRDFTQTYYKAEVKGANFFARAYMSETDDGDSYNMTAMGLLTTSTLAPTYIGTYASALLPTLLAGNTPTAEQVAAAQTAAYAAVQPGTSNGLAESTLKTVREGVFQRGGAGFIDNSRLYHAEFNYNFSDMIDFAEIQVGGNYRQYDLFSDGTVFNENRGNGTFERIKIGEFGVYTQVSKKLLKDRLKITASIRFDKNENFDGQITPRASLVYSAGKEREHNFRASFQTGFRNPDTQAQFIYFPSTSGILLGSTKANAEQYGLFQGGATDSKGNTVNLEFIQPEQLTAFEVGYKGLIANKVLIDINGYFNQYNNFMDQQTVFAKNAGTAPTGSWAAGTAFRPYINSKVPVNSQGLGIGVSYKLPKNFIVTGNYSAALFSADIDPDDEFQIAFNTPGDRYKLGLINRGGLIKNLGFSINYRWQDRFLWRSAFGHGYIPAYGVLDAQVNYKIKSLKSIVKLGASNIGNNDYRTSFGAPFIGQMYYLSITFDQALN

SEQ ID NO: 9756 - protein, 721 aa, Providencia stuartii ATCC 25827
MANSGVKMKRLIITAFFAIYTSFTMMPVLAEDFPYQENTEPVEITNAIHEEIRWLLAETEVAISTRHGVRISKAPGIVTVLNGEEISHSGYRTFSELLRTVPGYEILKSGNFGGIFPAVRGLDGANRVRVMIDGHFVNNPLDGSAFGNFDDFPLKNIKKIEIIRGPGSALYGENAFLSVINIITKNGADIDGILVDSGFGSYDTLEENIVFGKRYGNIEVSGMMHYRDTNGYDGIVESDSQSVLDKSLSPYGFPAVSQAPGEVEDWRREYSLHLKMAYKDVYLLGWYNNKNRGPFIGPQHALADESDIESNYVFAEVGYKKTFEDIFTVKPRVYYDQFDDDSYVESFPEGATLSFDTNNDGVYDTFKTYPDGFVGDGKVIQRIIGAEMPFDYELFDGNIITVGFEYRRIQQTDVRYSANFDPLTMDPLESMKDFTDTYPFLKETTRNIWSVYIQDTWDITEDISLTLGARHDEYNDFGNATSPRSGLTWKFMENATLKFLYGEAFRAPSFLEMFTVNQPARLGNEDLDPEIIRTMEMGLMYTFNKHVTSSINYFNNNIKNLIMLRALDSASETWQYDNFGDARVQGFEVETKINVSPGNYVFFNYTFQDPEDDHGNELPFVAKHKGNIGINVQPCRYINTNASAFFSGKRYREEDDGRDDMPSYALVNLSVTGRNFFGTMNVQGTIFNVFDKDYKDPGPVSIAEDLPRPGRTYFVGLSYQF

SEQ ID NO: 9757 - protein, 1026 aa, Providencia stuartii ATCC 25827
MSIQQGVDTRGLKTALLTGVAAFLMTTGYAAAQDAVVKGRSDAMAEPTTQVAQAQVAQATGTAAANDGSKVEEIVITGSRLRRTQFDVLQPTVEVNIGYIDRRGFTNIADALNDVPGFGTAVSPIGDQSTFNVGQNFVNLFSLGSARTLTLVNGRRFVAGRAPSLFGDAGPGLQVDMNVIPTAFIERIDRIAVGGAPIYGADAIAGTVNVILRDDYEGGEVDLLFGNSDDDDAKNKRVRAAYGVNFDNDRGNIALAVEYNDTQGLLYTDRKRTAKDITFVPNPADTGAADGIPGQLYREGRTIPLVTAGGIPLTVNSGGGSAAAITSRFFRIPDPNNPGQTVPAQFVDGRLVPFDPGQIFSGSVAIGGDGLRLSSVTSLQAPVERKLGAIMGHYDILDNLRFFVEGNYSKTIGYENVNQPVYNSPLFSGEGSGLTMRTDNAFLSPADRAVLSAGGRTTFVLSRGHLDLVDGNENRSENELKRIVTGFSGDFDVADRAVNWSLSYNYGKTEGEFTTTQVLDATFPLAIDAVVDPATNQIVCRSRAAGCVPLNIFGNGSPSPEAIAYVTGRDVSSSAITQEVVEFNADTSIITLPAGDLQVGVGALWRKEKGDFNPGEITLAGAGRTVAISPVSGDYTSKEVYGEVLIPLLDDSMGIPLVHRLEAEGSIRYVDNSLSGGDDTWTIGGRYSPIRDITFRGNWTESIRSPAITELFLPKSDLFTTATDPCATRNVSGGPNPAVRQANCRAALEALGRDPNAPFVSRIETATIQGETAGNPSLTNEQAKSWSVGVVVNPRFLEDLTIAVDWVDIEISEAITNLSASALLQVCYDNPGYPSAACDRFVRTPRSAGLINEDDIGQITFIRTGYVNAGYTNFSGLTATANYDFDFGDYGQLALGGSYYYIHQLETSVTGLGFDLGSDAGEVGQSKHQFQIQADYTYDKIGLLVQANYLSSAKFNNDFTVESRDILEVDDYWRFDTTATYMLADNVEVRLAINNLFDVEPPKYVTGAGVYDLIGRYYSVGLNAKF

SEQ ID NO: 9758 - protein, 802 aa, Providencia stuartii ATCC 25827
MSIRAFLLASAMTFGVVASSQALAQDAAQPNAVDGVIVQARDKAGLLEKQPSTTVFGLEKSLLETPRSASFVSDTTLQRFGIETIDGLTAVSPGTYTASFYGVPGVLNIRGTLAENYFRGFKRVENRGTYSTPIGGAAQIEIVRGPPTPIYGAGKVGGMLNFIPKSARDEGRFLTDPKGELTATVGAYDKKNLTGQVALPVKLGSADGGVYAYGELDDSKSFYRGLHPKRQLAELSADFDLNNGWSTAFGGMVYHSTGDVQTPGWNRLTQDLIDHGTYITGRDTSLVDADGNGRITPGEAGFYPFGSALYIPYGGAPATDANHTLDTGVGTTKLDPRTVYISAADFSKTWTNTLYLDLAKRFDDDSVLKLQLFYDDQENKRFVSYGYPAWFDSSVWEARASYAFARDFGAVSTQTIVGASYREFQGRRRESFNSGLIALDRRDIRYGATPNDIIDSPFSTEPAGVQGLEWENDNRSTWSQTGLFFTSDVKFGQRLTLTLGGRYDGYDVAAHDTGYLPFTVPGRQTDSRGKGTYSASLTYQTPVGLMPYISYAKASALEVSQAGDIAPGLVADGSWLSDSDLAEAGVKFQLLRGTLVGSLAGYRQNRTQLSGLTPVVQGTRAKGVELEIRWLASEHVSFTATGNTQHTTVKGPDLSFQYIPAYTAGVSGAQAYGGSYVVWTFGGPTGLPGRLGDYDYTLIPKSVVSLYGAYTSDTHDWGSAGATLGVTHVTKTSGTVQDAVTYPAYAVVNASAYFARGPYTAELNVDNLFDKLYFTPDADTYANLGALPGKGREWRVTLKRTF

SEQ ID NO: 9759 - protein, 409 aa, Providencia stuartii ATCC 25827
MKKQLLAFSVSSLIIGTASAQSSVTLYGIVTGNLTYANNVQTAATSGSRRPVGGAQVAQFDNGSSGLSSSRWGLTGIEDLGNQLKTIFKIEGGFSINTGALGQGGAIFGRQAYVGFTAPNYGTFTLGRQGDAQVELVSPLIYGWYWGNLAIHPADYDNLNFTHRINNSIKYLSDTFYGFRFGGLYSLGGVAGNVTQNQYWSLGASYTGGSFALAASIFNARNPNTSLYGTNPNASATGNNLGSAGSATTAESNPAIAGFASANTQQTVSVAATYTAGGAIFGVSYSNTQFRGLGTNAALNALQYSGTAVLSTVSASLRYQATPFLRFGTSFDYTAGGSVNGKEGAKYEQVNLGAAYSLSKATDLYVTGAFQHASGTDSLGRPAVAAIGYITPSTTNKQVVVSAGIKHTF

SEQ ID NO: 9760 - protein, 244 aa, Providencia stuartii ATCC 25827
MKKAFIVPALMGCISLPAFANTDDSKTGLYVTGKMGASIEQMSGQQFVYSGYADAGDNGTKNGDNHRTGVFGGGLALGYDFSNQFDIPVRAELEFMARDKANSTYNIRDRVRNGVHQTRDIKNQIKLNTLMVNGYYDIKNSSDFTPYISVGLGYAAVDFKTTRADAYTPGLSLHDTHTHTANNFAWSVGAGVNYAINDDWDMGLSYRYLDAGKADITTAVGDGENTSKIKVKANDIMLGLTYRF

SEQ ID NO: 9761 - protein, 2383 aa, Providencia stuartii ATCC 25827
MLSVFTFFRCARKGAFMLARSGKVSMATKKRSGEEINDRQILCGMGIKLRRLTAGICLITQLAFPMAAAAQGVVNAATQQPVPAQIAIANANTVPYTLGALESAQSVAERFGISVAELRKLNQFRTFARGFDNVRQGDELDVPAQVSEKKLTPPPGNSSDNLEQQIASTSQQIGSLLAEDMNSEQAANMARGWASSQASGAMTDWLSRFGTARITLGVDEDFSLKNSQFDFLHPWYETPDNLFFSQHTLHRTDERTQINNGLGWRHFTPTWMSGINFFFDHDLSRYHSRAGIGAEYWRDYLKLSSNGYLRLTNWRSAPELDNDYEARPANGWDVRAESWLPAWPHLGGKLVYEQYYGDEVALFDKDDRQSNPHAITAGLNYTPFPLMTFSAEQRQGKQGENDTRFAVDFTWQPGSAMQKQLDPNEVAARRSLAGSRYDLVDRNNNIVLEYRKKELVRLTLTDPVTGKSGEVKSLVSSLQTKYALKGYNVEATALEAAGGKVVTTGKDILVTLPAYRFTSTPETDNTWPIEVTAEDVKGNLSNREQSMVVVQAPTLSQKDSSVSLSTQTLNADSHSTATLTFIAHDAAGNPVVGLVLSTRHEGVQDITLSDWKDNGDGSYTQILTTGAMSGTLTLMPQLNGVDAAKAPAVVNIISVSSSRTHSSIKIDKDRYLSGNPIEVTVELRDENDKPVKEQKQQLNNAVSIDNVKPGVTTDWKETADGVYKATYTAYTKGSGLTAKLLMQNWNEDLHTAGFIIDANPQSAKIATLSASNNGVLANENAANTVSVNVADEGSNPINDHTVTFAVLSGSATSFNNQNTAKTDVNGLATFDLKSSKQEDNTVEVTLENGVKQTLIVSFVGDSSTAQVDLQKSKNEVVADGNDSVTMTATVRDAKGNLLNDVMVTFNVNSAEAKLSQTEVNSHDGIATATLTSLKNGDYRVTASVSSGSQANQQVNFIGDQSTAALTLSVPSGDITVTNTAPQYMTATLQDKNGNPLKDKEITFSVPNDVASKFSISNGGKGMTDSNGVAIASLTGTLAGTHMIMARLANSNVSDAQPMTFVADKDRAVVVLQTSKAEIIGNGVDETTLTATVKDPSNHPVAGITVNFTMPQDVAANFTLENNGIAITQANGEAHVTLKGKKAGTHTVTATLGNNNTSDSQPVTFVADKASAQVVLQISKDEITGNGVDSATLTATVKDQFDNEVNNLPVTFSSASSGLTLTPGVSNTNESGIAQATLAGVAFGEKTVTASLANNGASDNKTVHFIGDTAAAKIIELAPVPDSIIAGTPQNSSGSVITATVVDNNGFPVKGVTVNFTSNAATAEMTNGGQAVTNEQGKATVTYTNTRSSIESGARPDTVEASLENGSSTLSTSINVNADASTAHLTLLQALFDTVSAGETTSLYIEVKDNYGNGVPQQEVTLSVSPSEGVTPSNNAIYTTNHDGNFYASFTATKAGVYQLTATLENGDSMQQTVTYVPNVANAEITLAASKDPVIADNNDLTTLTATVADTEGNAIANTEVTFTLPEDVKANFTLSDGGKVITDAEGKAKVTLKGTKAGAHTVTASMTGGKSEQLVVNFIADTLTAQVNLNVTEDNFIANNVGMTRLQATVTDGNGNPLANEAVTFTLPADVSASFTLGQGGSAITDINGKAEVTLSGTKSGTYPVTVSVNNYGVSDTKQVTLIADAGTAKLASLTSVYSFVVSTTEGATMTASVTDANGNPVEGIKVNFRGTSVTLSSTSVETDDRGFAEILVTSTEVGLKTVSASLADKPTEVISRLLNASADVNSATITSLEIPEGQVMVAQDVAVKAHVNDQFGNPVAHQPVTFSAEPSSQMIISQNTVSTNTQGVAEVTMTPERNGSYMVKASLPNGASLEKQLEAIDEKLTLTASSPLIGVYAPTGATLTATLTSANGTPVEGQVINFSVTPEGATLSGGKVRTNSSGQAPVVLTSNKVGTYTVTASFHNGVTIQTQTTVKVTGNSSTAHVASFIADPSTIAATNTDLSTLKATVEDGSGNLIEGLTVYFALKSGSATLTSLTAVTDQNGIATTSVKGAMTGSVTVSAVTTAGGMQTVDITLVAGPADTSQSVLKSNRSSLKGDYTDSAELRLVLHDISGNPIKVSEGMEFVQSGTNVPYIKISAIDYSLNINGDYKATVTGGGEGIATLIPVLNGVHQAGLSTTIQFTRAEDKIMSGTVSVNGTDLPTTTFPSQGFTGAYYQLNNDNFAPGKTAADYEFSSSASWVDVDATGKVTFKNVGSNSERITATPKSGGPSYVYEIRVKSWWVNAGEAFMIYSLAENFCSSNGYTLPRANYLNHCSSRGIGSLYSEWGDMGHYTTDAGFQSNMYWSSSPANSSEQYVVSLATGDQSVFEKLGFAYATCYKNL

SEQ ID NO: 9762 - protein, 415 aa, Providencia stuartii ATCC 25827
MAMKKLTYAGVPLLAATMTASFTAQAVTVDQLNRQVQKLNQRIAAQDQRFRVNGFATFGIAKSDEEIAYNGVSDQTTWTEFTRAGIQMSFQVNQDSSVVTQIVGRGSEDFNANMEWAYFKHQFTNSLSAKVGRIRGPFYMLSEYLDVGYAVPWAQMPAETYSLLSPFANIDGVDLTWSTDIGWDTLEIKGFYGRTENENFIFDDVMGISATYSAETWSARLATTVAGLSFGSGEQGASTANAQALLEGTTAAQLGTQDAAFTSFGFRYDPGTLLVMGEYTTSSADGITQDEDSMYLTVGYRMGAWLPHLTYGMHESTDDKDRELPAGVPASTVVDTDGTTAGDVAALVQANSNSDTSRIGLGVRYDFGAGTALKLQYDIVDADSTGLFNATQYLQAGANAPDSANILTITIDTVF

SEQ ID NO: 9763 - protein, 965 aa, Providencia stuartii ATCC 25827
MKKAFFFFLIGSSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRPFTSSNPNAAVNKIREGGAIHAQNLYINHNHDVVGFMKNFSYVRGGAISTANTFVVSENQSCFLFMDNICIQTNTAGKGGAIYAGTSNSFESNNCDLFFINNACCAGGAIFSPICSLTGNRGNIVFYNNRCFKNVETASSESSDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGAGNSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWSWGWAKTQDPEPASSATITDPKKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELEIATQLLASKGIWFGSGSPSSRHAMSYKISQQTQPLSWLTLHFQYHGFYSSSTFCNYLNGEIALRF

SEQ ID NO: 9764 - protein, 1036 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTSSGDPTKVANVTIHGTGSLGASSSPLYIVDGMQTDLSVVATMNPNDFDNVTVLKDASATSIYGARAANGVVIITTKRGKMGEAGRITFNYSYGVSSIISKKPMSRMMTGDEQLNYQFNNGYWDTTKPEYATIEAVKATLIKNAEDMYAKYPELAPLVKSGYLKPIDFDNDTDWLEYFIRPTAPTHQGDISFTGGSQGTSYFVSLGYFNQEGISREPSSFKRYSGRMNLESRIKEWLKLGLNLSGAIAEKQASSFSGTNYYNTGTFGALSMPKYLNPLTSDGEIADVYYIIGTTPRQSPLRIAKWYPEEDYTYQANVGGYLQFNPIKGLTIKSQAGLDFTDSRATVKTLPNNIFSPNPLGNRTERFYGGRLFTVTNTGEYKTNFEELHDVTILLGQEFIDADVDVFSARANGFENSKVMLLSQEKTGNFLQLPAQRKEEYAYLSFFGRGSYGFDKWMYLDVSLRNDQSSRFGDNNRSAWFYSFGSMFDIYNKFIKESDWLSDLRFKLSYGTTGNSEIGNYNHQALVGSNNYTDTALGLTVSTIGNPDLSWEKQSQLNVGIASGFWNNRLTAEVDFYVRTTDDMLINVPLQYISGFTNQFQNVGSMQNTGVDVNLRGTIFQNKDWNVYAAANFNYNKQKITKLFFDLKEYVLPNTGTIWQIGKPNSFYIAEYAGIYKGTEPYTDPDGNVYHGGDQLWYVPGKTWADGTPATTNVYSADLEQAVDKAVNPPITGGFSLGASWKGLSLDADFAYIIGKWMINNDRYFTENGSGAAMRTNKDKILLDAWTPQNPNSDVPRLGQDNQFDSRLLENASFLRLKNLKLTYVLPQSLFKTQGVVSGARVYLMARNLLTVTKYKGFDPEAGGNVALNQFPNTKQFVGGIQISF

SEQ ID NO: 9765 - protein, 707 aa, Porphyromonas gingivalis
MNSGTHGLKLTHLSACLASLFIHHGVAADEQVASQNVDQENAIETLSIVGSRQAYQGNFSPLETPQSELKINSEALANAGAIDLNQALDLSASVARQNNFGGLWNSFALRGFVGDENLPSNYLVNGFNAGRGFGGSRDLSGIESVEVLKGPRAALFGRGEPGGTVNLVTKRPTFDTAGEIKVSAGSYDTYRADLDYTTPLSDDVAVRFVGFYEDAGSFRDTIKSKKEGFSPSIAWEISEQSTLVYELEYAHQEVPFDRGVLAIDNKLGVIPQSRFLGEPADGPIKTDTLGHQVEFQHDFDDNWSVLLGANYRDTSLEGFATETGFSGVVDDEVNRFRRYRDYDAKYQVFRAELTGNLEIAGVEHRLIVGVDSDKFENDQFALRDRTTEQYINVFSPVYTAANALANDFSTQIDRVETQESLGVFIQDQISITDKLDVRIGARFDDYQQTMNNRLSESQSKQTESRVSPQFGIVYEASDTLSLYAAYGENFRPLSGTDSNGDGFEPNQSTSAEAGIKFTLNDGALFGTVSIFKVEQDNLLVVDDPTSFTYAAIGEAESQGIEIDINGEIADGLTLWASYAYVDAKTKNAFFDGNFGYTIEAGTDLLNVPEQQLSLQLVQLLELDGKDLEVGGGLVYVDKRNGYFGTDFTLPSYTTARAFIAYDITKSISLRAEVDNLFDKDYYTNSFADAWVQPGTPRSFRVSASYHF

SEQ ID NO: 9766 - protein, 779 aa, Porphyromonas gingivalis
MKSVSACLSFFIILPVLGQDINDMEKINVYGQTPLSSTVVSDHSAFGSVQTIDAQALVQSQAISLAEHMKNQLTSLHINDVQNNPFQPDVQYRGFTASPLLGLPQGISVYLNGVRFNEPFGDTVNWDLIPLAALDTVSLYSGSNPAFGQNTLGGALALQTKNGFSYTQNELEARFGSFGQQQYTVQSGGNKGNWGYYFVANKYQEDGWRDHSASELQQMLATLTYASERRTIDFIVSANNNEMLGNGAVPEKLAGLAGRSAIYTQPDKTDTSFQQFIVKADNVINDQMSWQANVYYRQNEINSLNGDDSDYEECESGSLYSLCEEGEDDSLERVHFVGYDEDTWLSELSDIDADDIDGTLNTGLTDNESYGAALQWVGLSHFDASESFYAVDNEFIFGLGVDQAQISFNSDTQFGILNNETVDDDRSVTGIGLYDSESRVSLKVKTQQQYLYFLNAMTFGGNFTLNLAGRYNYADVSMKDQIETGKGSLNGEHVFHRFNPAISVNYQLNQEYSVKLSYSESSRTPSPAELSCADEEDPCKLPNAFVADPPLEQVVAKTTEASLHYDNTNFSALATVFSTLSYQDIIFQQAGEKSNEGYFINLDKTQRQGVELAFSTQVGDVDFSASYNYLKATFESPFVSFSPVNPLGPNRQVNPGDEIPGQPQNQFKFHINWLFNDQINVGTEFLYASSSYYRGDEANDNKKIPGYAVTNIYLNYQINERLRLSAKVDNLFDRHFDTFGTYGEADEVLGELYPDTEFDEYFVGPSRPRAISVSINYQF

SEQ ID NO: 9767 - protein, 1041 aa, Porphyromonas gingivalis
MKKFFCLTLVCKLFALSEFELHHIDKVHKLGYSGDTIIIGVADDAFNQDHISLKDKILKSTYPTDTAGKQLIPDLKKSTHGSHVAGIAVGAKIGDSKPYGVAYGAKFYGAGVFPNGSYTQIPDIYNFFKDVSIINNSWGINFYPYFNLKASNSGLVDCTQTNQGTSYNICNTPLEYVMKADKVANDMMRLSKDKGVLNVFAAGNEGILSPALHAILPSYDESLRAWLAVGALDANEITLESDGTLIIKSQGLADFSNGFKGATNFSLVAAGVNINNVDSSTNDKFTKKSGTSMAAPMVSGTAALVKQNFPFLDGKQIADILLSTANKNYKAPKFTVKQVTDGTNQPKFLIVYISQDPPRIEDEIKRDLKQLYNGIQVQVNGQWIDYSDYIWDNRDSAQSQKLNTSTISSINGVVRVEKEELFGQGILDAQKALKGLSILDANRLSDQDVLKYEQEPNTAYYTINTAGYDAEFSNDISQRKWDESTHLSSAINKPTHLANLNIGLSKEGEGILIISGQNTYEGATLIKQGELKLKGKVKNNAYVEQKAILSGNGIVGQNLNNKGIVRPGNEDLNDLTVQGTYTQEGVDSKLQLDFGNYKNSKLIAKTYDIKSGNLEYIPLPKYYILNKPVKINLGDLEKSLSSFNHVLIQNTYALNFDFVLSDDLVSINKTLIKPNLKPNAYEIPNTSLGNALRQLRSRTDLSQTYQEFFASLDNGIDVKTKLNRIEGSGYLSTFSNHNQSNLMQNNMLFTLHPLNINNFAQNNNILLASTYLPRIFSNEEYFWHLTPSYKYYKDKDFSGQKTGANISLGENFSSGFLAYALSLSSAKFNFNNGSDLKSYNMDLLLNYNHDLDFIKILSGLGIGVGFNTLNRFVVEQPIEGKYKTLQTSAQLGVTKDIILGQDFIFNPLMYFTHSFFYQEDFKENKSPFAKNYESLKHHSINANLGFNLAKNIEQDDYQASFSTFVIFEKRIYGRTLENKASFVDFPITFIQKYKLKDNILSQGFNSEFLYKNNVFWQFMLMNRFSHNAYELHLMSSVGKRF

SEQ ID NO: 9768 - protein, 250 aa, Porphyromonas gingivalis
MRTKTAFIMCCVLGIPAAGHALTFDVRGGYRAGSHSYESRYKVSQGWETGWWASMEMDNKNNKNNHQGNQGTDRADGSHSFGDSTVDYNEIEANYSWPFADKWALQPGGIYHWSSKGTQLRPYLRVNYKATPDLTFGLRYRYDYNTYETVNSAGESHRDSVNRLDLYVAYKFNAQWSALYQGTVYRHVNDDYKYKNDKSSATENALTLRYKWNDWFSPYIEYDYLGKQGYHDGQNKISESRYRIGMTFTL

SEQ ID NO: 9769 - protein, 716 aa, Porphyromonas gingivalis
MIGITGRTLPPHRIPKGILLSLFIGAFSQTAYTSENDPLFELSLEELLQIKVVTAASGYEQKLADAPGSVTVITKHEWQAAGARALEDVLDMVPGVHISKTTTGLVANKAVIRGISGTFGQQVLVLIDGVPIKYRQDSGQTVGSRIALAGFERVEVVRSPGSAIYGADAVGGVINLVSNKQLDNTLTLRTGEYNTHDIEWTHQHNFEEGVWRITAAHQRSDDDPDKIATDDLQTVFDNIFGTDASQAPGRVDERYAIDQINAQLDWHKLSLQVHYWNNSDKGVGSGVAAALDNKGTASLTDTQFNASYNLYNDAQQSLAFNGAYNKQQSRTFLYVFPAGTQLPIGADGNIDFNEPVNVVTFTDGYIGTPGNNASATDVNATYLVHLGKHDTRVQIGYQTQSYKAVERKNFGPSIIDGSQTVVDGTLTDVSNTPYVYIPPSDRDLTYLSIEDTWQISSDFRASLGMRYDQYSDVGSTFNPRINLQWQASKNITFNTYGGTAFRAPSFTELYAQNNPAGVGNPSLKPEKARTFQSGINSTIRFNKSTDVTVNIYQYKINNIIEFVSQAESGIQLASNTGEQAGWGSELIANWQFDKKLLIKGHYSYLDARDKFDNRLSDVPVHTFYIQGHYKLATHWQLFAKSKWLSERSRKPGDPREALEGYNITSLNLAWAQSRYSAALSISNAFDTDAREPSTGSLPDDYPLSGRHAMLSVSYSY

SEQ ID NO: 9770 - protein, 1176 aa, Porphyromonas gingivalis
MKVKGKNTKGILVKGSYFQSKVNIGEGATLDIDIESSDKDSSGISFAEKRDFIIEKNGKLNVKNLFNGTINSGDILRQFHSSKEGKGILVRGVSVAKKFTTEGNTRIESSGAGIGFDKTTSNGQGEIEFKKGSKTFVKGGIAGVFARYNNVTFEEGSDTTLIGGAYGLMANKGTIKKGAKVTLMGNYGTGKFEVKEHDRLTFESGSELNILANNSALYGIRLVGKTKLIAKGYNVLRQIDTYADGEHSLNTVTFEKGSILDGNIDRSWNSQFLLEEETKLFVPEKIQANLEIKGDLYVGPRSAYEGKQKTYKEAVEKSSDVDTVVGATAIFMGKQAQRARKGEIRYGKTYDDFSANEYYTLKYNENSYNYKSTLNLNNGKIHLRLGTPDRLGRINDKIIFSKNTVINGKGELVFHKRNSSQVTKNTVFKILEEEGLKNINGTQGYYLEKLPLKIPDVSFGQLVFTTKVQKLNGRYVVSLVFKGIEADNFLLAKGETKTLNKKKEGSLEDAILSAKEVTIEEKSTLNIKGDTNGLFAKNKVTVEEKANLNIETENKIALKLGENLETFGNINIKNAGTGILADNTTSVLKFENGSKTIVNAKDVAINAQKGTSEFKGGSNIELTSNKYALVAKKAVFEKGSTVKLNAEYGIGTLSETDSSDVTFNSQSEVNINSSNSGIYNVNVGGSGKLSIKAPNVLKQVRTVNQSLKFESGSVLEGNIEKSWNANLILDKGSKMFVNNKIEANMDIKGDLFVGTRNSYEKEESKNSMQTLSTMSTFSSSDKYYTVHYNKDSNGHKTKVNLDNANIHLRINGEQSESNDKIVFSKDTEITGKGEITLHPENVSKVKRNMTYSLLEEEGKDVGGNKVYNLEKTSLTLKTVEFGPLVYGRKDKKVNGKYIVTLEDTGELSQAAKNSLTNSRDSYKYNQEELKAISDKIFENHNLELKNNFWLLVSKENLKNKDSVIKLNQNTKYAGYDHTFNTGISLGFFAGQSTGRYKNIGQGIYLKKDLKPFYLGTVYKHTKSKDKNNDKKLHSNDFSFVVGYNKDISEKTFLDSNIKLTRGYISDYKYTAENDLNTRNEKTNYWNGEINTKLGYKFKYGDAFLKAGLDKDLKGNQKVIWNENIDEEIKYDDLSKNIGIGMEYKIKQHSFNIELSRKYSKHYRANTKISFGYSYKF

SEQ ID NO: 9771 - protein, 867 aa, Porphyromonas gingivalis
  misc_feature (384)..(384): Xaa can be any naturally occurring amino acid
MRKRILQLFLTALLLALGSSLAIAQTVVTGKVIDSETSEPLIGVSVSTGQGASLRGVTTDMDGGFRFEVPAKSVFTFRCVGYATVTRSIGRGSQEDLGTILLDPQAIGLDEIQVIASVVPKDRMTPVPVSNIRVADIQAASLNVEFPELVKSTPSTYTTKGSGGFGDGRTNVRGFDTYNFGVLINGVPVNGMEDGKVYWSNWSGLMNQASTIQIQRGLGASKLGISSVGGTMNIITKTTDANTGGSAYVGMGNDGLHKESFSISTGMNDGWAITIAGSHMTGLGYVKGLKGRAFSYFFNVSKKFNERHTLSLTGFGAPQWHNQRSSKYSVADYDKYGIRHNQSFGYLRGELTPTAYAYNTYHKPQFSLNHFWKMDENTSLYTAXYASLATGGGRRAYGKNSKWVLINYNTGQPYEQTKVTPDGLIDYDAVLAANAAASNGSEAIFALGSNSHKWFGLLSSFKKKLNSSLTLTAGYDGRYYRGDHYDKITDLLGGSYYIEDPKTKLAYHAEGQQLKVGDIVNRDYTGEIMWHGLFAQMEHSSEWIDAFVSGSINYELYRNHNYGGSKSTGYLPGVSPWKSFLPWSGKAGLSYKFAQGHNVFANGGFFTRAPLFGNIYAAGAIIPNDKANMEKVLTGEVGYGFTNHKNFEFNINGYYTKWMDRVTSKRIGNEYVYLNGVDAVHCGVEAEVSYRPIRQIDLRGMFSLGDWTWQNNVSYTSYDEAGNETGQDITYIKGLHVGDAAQMTAAVSADIELFKGFHVIGKYNFLGKNYAGFNPATRNAQQYEADGKEIVESWKLPDVGLFDLSASYNFKLGSLSTTFYFNMDNVADKRYVSDADDNIIGKKHDEASALVWYGFGRTWSTGIRVNF

SEQ ID NO: 9772 - protein, 936 aa, Porphyromonas gingivalis
MKKNGLSYIPVLRALLICTLLLLAYGASAQHHVSTCTIRGKVTDMAGKEGIGFATVLLADQAYGVACDGKGEFVIKRVTAGSYRVVVSCMGFASFETTLHIKADTTVHFRLKEHSIALKEVQVLATYKNKTDGNVSVDRTALEHIQPTSLRDIFLLLPGNVVQSNSLTGFVGTTSRQIGSDDNTSLGTNISIDGMPLSNDAMRTQLYGITGVDRSDLYVADRTVTRRTGMNAGIDLRTISTDHIETIEIERGISSVGEGNLSSGAIRIRTKQGSAPLQMRVKADPLSKLAYVGKGFKVSKRGASIHTGIDFLHNKPDVREVLDSYKRSTLHARYSDQLNYGDMIVDLGIGLMQTFSIQDSKSDQLVNEYEETYNSKYLRSSLSFDAKVRFSGSWLNSIDWLLSADYTSDLLKRKKYYISTSGPKSMPVATESGEHEGVFLPSAYYAYYEIDNQPLYFFSRFKANTDINFTERHHHHLLYGLEARSSKNIGRGVVADPTRPPYPGNNSYIRPRPNYNIPASVYAAFFVEDRASVEWGANRLGIQAGLRATHLFNLPSSYALSRKMLIEPRIKANWQYRAEHLSINLRAGYGMENKLPTLDHLYPDKIYRDFMVLNAYMQNPELDHLITYTYIHNPENPAIRENRNVKKEIGIDMTYKRFDFSLTLFHEESRRGFEYFDSYLPIAFDRYTKLIAPLPPGHKPQKEDYIQEHHKDFFVIPTVQNSAKVVKRGIEFRLRTPYLKAINTQVEVNGAYYHTLYASGIPIMFRPIVSEYEQALYPYVGYYEGSLHKHYQRFNTNVWVNTHFPRYKLIFTSFFQIIWHDASYRGHEESEFPYAYMDLDGVVHPTSKAAILEAAATNDILKYLSRERTELYYRATYKPISLRINFKATKEFSDRMRLAFFVDNIIDINPKYKQANNTTERDWSIPYFGIETTFTL

SEQ ID NO: 9773 - protein, 250 aa, Porphyromonas gingivalis
MKRIVLASASLLVLSALAPASAADLAARPYTKAPVAVASIYNWSGFYIGGNAGGGSSHNCWDLTAVGVAAIPVTAEGCHNATGALVGGQIGYRWQSSSWVFGLEAQGDWADLKGSNVSAPAALFPLVNNTKIDAIGLFTGQVGYAWNNVLWYVKGGAAVTHNKFSGTLAGITLDTANETRWGGTVGTGIEFGFAPNWSVAVEYNHLFMGKHTDTFTFLGVATRSDSIKQDVDMGTVRLNYTFGGPVVAKY

SEQ ID NO: 9774 - protein, 766 aa, Porphyromonas gingivalis
MKEAELAKRCRAAGRAGATLWVGGMLGGWLTPAAAQVAPSDPAAEQTLAPIVVVGTTPLLGIGTPLSRVPANVQTIRGDDVERQHRGVLTDYLERNVTSIDINDAQGNPYQADVNYRGFTASPVVGTPQGLSVFVDGVRVNEPFGDVVNWDLIPQAAIDTMQLIPGSNPTYGLNTLGGALAITTKNGRTSPGGAAQLSGGSWGRKTAQFEQGGRIGSALDYYVTGNVANDNGWADHNASRVRQGFGKLRYVDADTTLSISAGGADNALQGTQTIPRSFLDNRAQAYTYPDLNRNSAAYVTLSGDHAFNDQVQLSGGVHYRHYRNTNTSSNVNDDFGSVDDSGAVDTVQGTNDRSTITTDSYGAALQLTLLGKLAGMDEQFVMGASADLATSGFEQASQQAAFTDARATVGVGNFTQTTRARTRNANYGVYFDNTLALTQQWALTLAGRYDWSRAAIEDVSGQQPLLTARHTFSRFNPAVGVTWNPVPGFTAYATYNEGMRSPTAIELACADPAAPCSLPNDFLADPALKPVIAKTFEFGARGRAGQATTWSAAVYRTTLADDIQFISSNGGASTLGYFQNVGNTRRQGVELAGHTRLGPVGIGASYSYVDARYRSTWTESSASNSSADARGNIVVHSGDRIPGIPASTVKLRLDFAATPKWNIGTNLTYRGGVFARGDENNQDANGTIPGYFLIDLDTTWQATKHLQLFASVTNLLDKRYANFGTLGRNFFNGPNHSFDGLNPVNEQFVGPGAPRGAWLGARYAWD

SEQ ID NO: 9775 - protein, 794 aa, Porphyromonas gingivalis
MAENKPSSPEPDNTGVGNSPSDYLHGEAIIPPLSSLSNFNDKRFMKKLHMIAALAVLPFCLTAQAPVSNSEIDSLSNVQLQTVQVVATRATAKTPVAYTNVRKAELSKSNYGRDIPYLLMLTPSVVATSDAGTGIGYSGFRVRGTDANRINITTNGVPLNDSESQSVFWVNMPDFASSIEDLQVQRGVGTSTNGAGAFGASVNMRTDNLGLAPYGRVDLSGGSFGTFRRSVKLGSGRIGRHWAVDARLSKIGSDGYVDRGSVDLKSYFAQVGYFGSNTALRFITFGGKEVTGIAWNGLSKEDEAKYGRRYNSAGLMYVDAQGVPHYYHNTDNYEQRHYHAIMTHSFSPSVILNLTAHYTAGYGYTDEYRTGRKLKEYALQPYVENSVTVKKTDLIRQKYLDNDFGGLIGSLNWHTGAWDLQFGASGNIYKGDHFGRITYIKKYNQPLAPDFEYYRNRADKREGAAFAKANWQITPELNMYADLQYRTIGYTINGITDEYDEVQGSMQHIDLDKTFRFLNPKAGLTYSFDDAHTAYASVAVAHREPNRTNYTEAGIGQYPTPERLIDYELGYRYASPLLSAGVGLYYMQYKDQLVLDGRLSDVGQMLTSNVPDSYRMGLELTLGWQILPRLLRWDASFTMSRNKIDRYVQYTSVYDADYNWLELKEETLESTDIAYSPNVIAGSMLTLSHAGFEMAWTSRFVSKQYLDNTQRSDRMLSSYWVNDLRLGYVLPVHFVKRVALGVQLNNLFNLMYASNAYIYDAGYVQASGELSAYADLRYYPQAGFNALGSLTIDF

SEQ ID NO: 9776 - protein, 833 aa, Porphyromonas gingivalis
MKQLNIISFIIAFLFLGTSASAQQSGGSVTGTVVDKSSKEPIAYVQVFVKGTTLGTSTDANGNYSIKGIPSGNQTIVARLMGYSTCEEKVHIEKGGSRHVDLYLTEEILSLDGVVVSANRNETFRRQAPSLVTVLSPELFLKTNSTNLSQGLKFQPGLRVEDNCQNCGFNQVRINGLEGAYSQILIDSHPIFSSLAGVYGLEQMPANMIERVEVIRGGGSALFGSNAVGGVINVITKEPLRNSAEISHSTMTFDHAKGWGSFQNTTQFNGSMLTEDRKAGVMVFGQHNYRPGQDIDGDNFTELPNLRNRSLGFRSYYKTGLYSKATLEYHSMQEYRRGGDRLDNPPFEAQIAEYLQHYINGGSFKFDQGFSGGKDFFSLYASAQDVQRRSYYGGGDYTENLLNGAVQSGSTESDEYNDAFTALTSYGTTKGFDLQGGGMYRHTFGENWDFTGGLEYIYGQLDDRSGYRPSKIDQNTSTFSQYDQLEYKTEKLSALIGARIDYVLLNQDGKRYIDPLFIFSPRANVRYNPNKNLSFRLSYSEGFRAPQYFDEDLHVELAGGTPISRVLSPNLKEERSRSISASFDYYHRADEWQFNIMGEAFSTFISNQFKPSDKVETTSDGKEWIIRTIYNDKDGVSKVYGVNLEGRIAYNKSFDLQLGGTWQRSRYGSIYTAVEADKTTGQAEISVKDYVRTPNLYGYFVATVRPTEHFAINLSGTFTGKMDVVHEAYEGDIPAEHIAPDGSFDFEMNGQQFKGLAEGHAKLVKTPAFADIDLKLSHDFHLASTMTLELNAGIQNIFNSYQKDTDKGPGRASTYVYGPMQPRRIFVGTKINF

SEQ ID NO: 9777 - protein, 243 aa, Porphyromonas gingivalis
MKRIFTVALVLLASVTMAIGQSRPALRVDANFVGSNQSMKRDGYVWDTKMNVGLRVGAAAEFMIGSRGFYLAPGLNYTMKGSKTEWDIPEMVPGTYITMVSTRLHYLQLPINAGMRFDLMNDMAVSIEAGPFLAYGIYGTYRQKLEGWKPNNYSTEFFGPTLGGPTNIRWDIGANIIAAFHYKRYYIQIGYEHGFVDIVSGGGSDIPRLNDNRQSSSTTALREKGNNEYAYNRDFFVGIGYRF

SEQ ID NO: 9778 - protein, 728 aa, Porphyromonas gingivalis
MKRLISHPFKVNLISLALLFPLYSYAETTPNEELEVIGVRYAKPITIAEPAQTTINWSEIEEQQYSNFASMIDAVPGASIDGGGRSGGERINIRGFDDPSDIAVFVDGAPIGFQQYRYGTFFFDPFLIGEAEIIKGAHDYRALNGKFGGSIRIKTKSVDDLLYGDRNFGARISSAYNTNGDENAYTLTLYGKNDTGFYFLANGSVKDSDDIKVGGGETLDYSGYEQENMLVKVGYENNDHEFEISHTRYKDEGRKPWANRRGKMPNITEYNIKKYGSLEKAQYAYTVDNKYTDNTTTISYHYMPTNPYIDFNIKMARSENDRHWVRPDVAFEKMFVSVGSYGHESWLSYERDYVDVFNQAQFGDHTLVTGLQYQKTDRDSLVFNASYDSNEAKNYGWYTPYYEPSGTQSIYAAYIADHYQATDRLTITPSLRYEYIKSEGKGNAAPDYNDPAAGHDYGETTHKGFSPRLDIDFDASNNTRLNASYAYALKAPTVDNIYSVQYARATATATALNLDVSRIHAYQASVINLTEGLVNSRDNLATELTMFYNDVSDTVDIRTGENLDKNTTELQSWNTNLDGFKNYGFELISQYRIEDFYSNFSASYIRGKNKGSLSDSTGSDDDHPDVPPLNINLGLGYEWIPGLRTGWEVRWYDAQTKTKASGNNLKVKSPSEQYTLQNAYVVWEIQQVEGLSVGAVVKNLTDRYYEAYLSNGVPSPGREVKLHLTYQY

SEQ ID NO: 9779 - protein, 254 aa, Brucella abortus
MKDERRPICEVVAESIERLIIDGVLKVGQPLPSERRLCEKLGFSRSALREGLTVLRGRGIIETAQGRDSRVARLNRVQDTSPLIHLFSTQPRTLYDLLDVRALLEGESARLAATLGTQADFVVITRCYEKMLAASENNKEISLIEHAQLDHAFHLAICQASHNQVLVFTLQSLTDLMFNSVFASVNNLYHRPQQKKQIDRQHARIYNAVLQRLPHVAQRAARDHVRTVKKNLHDIELEGHHLIRSAVPLEMNLS

SEQ ID NO: 9780 - protein, 345 aa, Brucella abortus
MKMAAIATAITTALVSGSALAAEVYNSDGTSLNIGGRAEFRGDFIGKSSGAELDGSMDNNSRFRLNVGGNTQITNDLSGFAFYEAEQGVNSDGSGAGNSQTDNFKQRYMYAGLQTNFGAISFGRQDTALVQLSQMSDIATYTGAQKEFIDAGNEQANNNILYTGMFADDALSLKANAILSDEKNQNSYGVSGIYTLPMGLGIGLGYAGGEEWANNSGTETADTSQFMGGLSYAVGQLYVAGTYTQGKFKESTGDVDFTGYEFAGQYKFDNGFVAQGVYAKQESDTSPTDSSTLEKNNYVELTGKYYFNNSIHSYLSYKFNMLKADSSSLSKDADDSLRLGLRYDF

SEQ ID NO: 9781 - protein, 212 aa, Brucella abortus
MFKRSITAAALGAAVMAFAGSAFAADMMGGTDYTYNDPVAAGPHDWSGNYVGAQVGGSSSKFPSPFASRTGALGGIVVGKNMQNGNIVFGAELEGNFAEAEHRIGHGGTLQQSWNGNAKGKVGYAFDKTLVYGTAGYGVTRFKAKDNTTSAPGWEGGVLIGAGVEQALSGPLSVKAEYDFQRFNDVKSQVNGIEQRNNLKNHSIKAGLNYKF

SEQ ID NO: 9782 - protein, 853 aa, Brucella abortus
MHIKTPLAVAITLTLAMGAAAPLQAAGQQAVAATGAVAADAVDLDRIEVRAQLESQIRAVDLKRSSDAIEDAVSSDALGQYPDKNVAESLQRLPGISVTRDQGEGRFVVIRGLDANLNSVSVDGIAIGTPEDSSRAAPLDVIPSDSTERLRVVKSPTPDMPGDAIGGAVLVESASAFDRDGRSLRGKIEGSHQQLSGETSPKAAFNYSEVFNDTFGVALGVNYQKRKFESDNTEVEYDGEDDAVPGDVTAINLQHRKYEIERKRIGANLNLDWRPNEDSKYYLRTLYSQFDDAETRQRVIFNFDDAKMVKTGTDQYRLDGMPKDSIDKRMRYRTKKENTFAASLGGENKLTNAVVDYRIGYTRTEERVNDEMEARFKLDGKAFNGTLDQRSRLPSYSFDNPQWLDNGNYAFDRFVLSPKQVNDKEHSAQVNVRFDGDSSSIKFGLLGRWRDRDVNVDERELRVGPKVALSSWTTSSPEHRHGNLGDGMDSAAMRAFWAANGGQYSARPQDAGGNAMTSLEEDYVASEDIFASYAMGTWDVGALRIIGGVRVENTQFKAIGNQVDVAANGRSFTVTPRVANSSYTNVLPGLHLRYDAADDWVLRASANKTVSRPSFGDVSPRVGYSRGDEEVRLGNPELDPYESKNIDLSVEKYIGSTGIVSLGLFHKSIDGYIVQTVRTNDPAYGGFDVTQPINGRKATVRGAEFNWQQQLAFLPAGLDGLLVGASGTWLDTKFDAGIKDRAGEDFTLPRASKHVYSAHIGYEKYGVSTRLAAVYRSEYLDSIGKGRAFDIFVAPNTQLDFSLDYKFTPRVSMYFEAQNLLDKPLELYQGTRSRTLQMEEYGRTYALGLKVAL

SEQ ID NO: 9783 - protein, 939 aa, Brucella abortus
MKTAKSLLSLAIACVVTAHTGLALAQASASNNAPATARATSQLGSVTGRVINQATGSLLQAATVRVLELNREVTTGRDGSFVLTNIPAGNYTLEVNYGGLDSQRLPMTITAGRSLRQDIRLTSARYGVEEMLVTGRAEGFASTINLQRNADSLRTVVSADALGQIREGNIGDALVRLPGLSVETRAGVQRTATIRGLAPQYNTVTVDGLRMTNVDGNRDIALDSFPANLLARVEVIKAPTPDMSADAIGGTVDLVTRSAYDRDGRTFDVQLGTTLNDIRDSWNKQAGITLGDTFGENRQFGLLGSVFYFRDERGYDVVDTAYTVSSADSFFINRSLYYDRDEMKDKVGAGLMFDYRPSDDTSAYIKAIYHYDFRELWRRGTDYRPNPATQFDVTPDAGSSTGGRVDSIVFYREPKNVFQMYTAGIEHRTGDWVLDGRLGYSKAKKDYPTTLQVVNSFNGVNLTYDRSDRDFPVFTVDNAVDLSNPSSVAFRQFDTNQVPRVEDELSVDVNALREFNTGRFPWSIKTGFRATIKDASQAQPDTVRYSGLTGVSAASLLEYYSNSDFMSESNGRAQLLPFFPDWRKYLELQQTNPSAFTQNAAAQLFSAETLANADFTIGEDILATYIMGTVDIDKLTLLGGVRVETTSIDSQANEVAVDNGQITDITRVSDSNEYTNVLPSLHLRYAAMDDQLIVRSSISKAISRPPPGDLIPSKQENAQLNQRIIGNPALEPAESINYDLTAEYFLPPLGVISAGAFYKDIDNFVFSSSRIASDGVDERTRINGDGGKVRGLEFVWSQDLTFLPGLLSGLGVEANYTWLDSEGVYPGRDDDLPLVNSPDYIINGILSYAQGPFSMRISMNKMPDRLESVGGREALDKYNAASTVWDLAFKYRVLDQHNIFFNVKNLTNEPTVQFQGSRDNPTSVVYYGTQYTLGVDLSF

SEQ ID NO: 9784 - protein, 274 aa, Brucella abortus
MNRSRIFYAGLIASAALIVSFSVASATDLPETVPEVMIAPPAVGGWYLRGDIGYSWNGFKRAEYAPLGDCDTCNGLGRGGDTLYGDLNGSFLIGGGAGYQVTDYFRTDLTLDYMTRSRFSGHVSGPDCNGDTGCASDERSHYSALSILANAYVDLGNLGGVTPYVGAGIGGTRVNWSDLVDITSGFSQEGAANWRFTYALMAGASVDLTHNLKLDAGYRYRHVNGGKMFEGNQWTDAGYDKGLNIHDIRVGLRYMFGGSDNAAYASQAASTIVD

SEQ ID NO: 9785 - protein, 219 aa, Brucella abortus
MTVEGHWAFGERAGSQTANSAYGLGANYFAGPFGLGVAYDEVKVLTAAEALGGPGNEYARDKRAAIAASYTVGPVKLMGGYRYGKTDTASSGATLALLPHRDDLYWIGVNYQATTALSFTLSYYYDNIKEATIGTTTVNPRKPQQLNFIADYNFSKRTDVYFTAAYSRNASLNWDSIGYATTASGQLSIGYLPAASQTYFITPDASNQLGMAIGIRHKF

SEQ ID NO: 9786 - protein, 442 aa, Brucella abortus
MPNKINCSRCWSAYLRAVTSVILAVGAASGHAYDVSTSPYLLGDWGGTRTRLEEQGVAFSFGYVSEVAHNFSGGTDRLTRYTDQWAFGTTLDTNKLWGWQGGTFQFTMTDRNGRNLGADANIGNNMLIQEVFGRGQTWLLTQLWMNQKLLEDRLELKLGRLTVGEDFFSFSCDFQNLTFCGAQPGNLVGSYWLNWPTSVWGSRLKYHTSQETYVQTGVYQVNPNYVDESWLRHNGWKPINPSGTTGALIPMEVAWLPTWQGRPGSYKVGGWYNTSDGNDLFLDVNGNPRGVTGLDPLKRSGQYGVYLNFQQQVTGTNGGRGATVFFNFSHADRNTAQLDHQITMGVQYKGLFEGRARDSIGFAVGATHNNARYADFVKQNNARTGQNVIAGSGYEYVSEVYYAWSPVPSVSLRPNLQYILHPGGTSRNSDAFVIGLKSSVTF

SEQ ID NO: 9787 - protein, 663 aa, Brucella abortus
MKFTRTLVLASTSLLATVATSQAQEVKRDTKKQGEVVLKPITIISHGKDNIEATGGTVLNYKDIEKLQPANVSELFSRQSSIAVSGGGGPSKRIHILGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQFYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQKRGGIDPVWAPGRTFTFQTAFKFLR

SEQ ID NO: 9788 - protein, 861 aa, Brucella abortus
MNSAAFQPCFSRPKGLKSTFWTTVFMTPTALMLLALAPTASAADIQPLQQEEVTTVLPDIEVTAAKRGVALGGQEPIVSYDAAQIQAFGATNIGELVTLLEAQTRSARGGSPVFLVNGRRISGFREIRGIPPEAIERFDVLPEETALSYGYSANQRVVNIVLKADFRSLTASVNVSRSDQGGRTTTASENNLLKIAGADRWSLDINGESSNALYETERNIDRTDSNRVDSAGDNGERNAYRTLLPRAAEASVAGTYKHDLNDKVGMTLSGSLEDSSSRSYSGLPGFSLSLPAGNPWSPGGAAADLYRYVGLPDALQRQTNTRAAELGTVFDGYLGDWRWTATGEYSRTETDTTTGRGVSAAALQAAITAGDTTVNPFGDLTGAVTTSARDTANSISQSAEAELVLNGTAWELPAGGVTTTFKVGGEHQSLDSESVRSGVTTDRSQSRDLGSLQANFDLPISSVDRGVLPKIGDLSANMNLAYQELSDFGGVSTLGGGLNWSPVARLSLSANYSDEDKAPTIQQLNDPTISTPNTAVFDYSTGQTVQVVQITGGDPNLKAENRRILKLGVNWQPLSATDLRLNLAYTRTEVEDEISGFPAITPDLEAALPERFTRADDGTLQSIDARPLNFASREQQDVQWGFNFSKPFGKPNPAMMGQRPGGPGGRPPGGAMRMGGGPGGPGGPGGGRLRGSAAPGMQPGQGMFNFSLTHTWRVQDEVVIRDGLAPLNLLDGDSISGSGGQSRHEVQVQTGLFKNGFGAFVNANWRSGTTVEGDTAGSADLDFSDRTTVNLFAFADLTQRTAWVERFPFLKGSRVGLGVQNIFDDRTSVTSSDGATPVNYQRDYLDPQGRVFRINLRKILY

SEQ ID NO: 9789 - protein, 228 aa, Brucella abortus
MSVERTLHHFPLDPASRQVRLALGEKRLPFVEMQVRYWEMPPEFTSLNPSGMPPVLVETKHQRNLVICETRAILEHIEETETEPPLLGRDPAERAEARRLLQWFDRKFDNEVNGFLLHEKMEKRLLRMGAPDLAALRQGREALRMHLGYIESLLQTRDWLAGRRMSLADFAAAAHLSVIDYFGDVPWKDFQAAKTWYMKLKSRPCFRPILADRWPGLAPAAHYDDLDF

SEQ ID NO: 9790 - protein, 284 aa, Brucella abortus
MKRGCAIAVMICGLITSVSAASAADLIVQEPVFEPLPQPALAGWYLRGDIGYNFKSKTGGKWDFWNQFEEPYRGVDDTFNYDDFSLKGGASYGVGVGYRFNDMLRTDLTLDYFRASINGRTNCPSYVKSSHGLNPVEDNCHYEDNSKASVWTAMANAYVDLPRVGPLTPYLGAGIGAAYVKYDTWKTSEICPTCTLQSDKDGFDSWRFAMALMAGVSYDLTDQLKLDLGYRYLRVNGGNAYGYDEQDRQVINQYGQGAGADGPQAKDNGFNIHTVRAGLRYEFR

SEQ ID NO: 9791 - protein, 353 aa, Francisella tularensis
MRLKSGTAAAAVATVLMSGSAQAQVASGVTLYGLVDTGIEYLSHAGSDGTGAQYRMSPGNVTGSRWGLRGREDLGGGLSAVFVLESGVNSDTGTSGQGGRLFGRQAYVGLQGNWGMVTLGRQINTLYEMFVPFDPVRYTSYGLLAQDAQFANRADNAIKYTGNFGNLTVIGLYSAGYDATIANGSEVPGNPRVGQEIGAGVSYTIGNLGMVLDYDQRRGTTASTAPNIERRYATGLLWTSGPFTATVGYRFLQGTIAAPSLRAHLYWLGGSYNFTPAFVLRAGVYRTDVRDSPNDAMSYALAAAYSLSKRTDLYLNASFMDNKGASRLGVVNGGTVAPGVNQTGVVAGIKHIF

SEQ ID NO: 9792 - protein, 1010 aa, Xanthomonas oryzae pv. oryzae
MKNHRTVSTLPPRSLLYCTLAASLLAANPAMAQSSNATLRGQVASAQSGSEVVVTNIATGSVRRAPVNANGNYTIVGLQPGTYKVESNGISRTVTLSVASSATVDLGNETAAAPAGDATTLDTVTVNAPMMREVKTSEVGNTVSLRQIQQLPQATRNFLEFADTVPGMVFTIDQDGNTKLRAGASNASSSNLYIDGVSQKSYVSGGGIAGQNETQGNPFPQLAIGEYKVITSNYKAEYGQISGAAITAATKSGTNQFHGEAFYRFTNQDLRKERPDEENGKVDSQTKEYGLAIGGPLIQDRMHFFFAYEGKDNVAPKSVQPSAEASPFVGLLPSNLRDQFGASNMPFTEDLYFGKIDVEPTDNDRIELATQYRDETQVSNVGGQNAPDRAVDKINKDKRTSLRWQHSADSWFNEAIITTEDSSNVPTPRGTGNGSIYTYVDRTEADPRQWVFLNTGAASGEDFKLRSQKGWSFQNDLTFNALEWHGEHTIKTGVTYRDIKLTSRESSSLNPQFSYEVSQNGIAPVPFQVRYIRAFDNPGQVPVVESPSKQYGIYLQDDWAVNDKLMLNIGMRYDYEDTQAYTDFVTSQPFINALYSDDPDNPGQPWANRLVPSGINVADYISTGNNRKNFKDAWAPRFGFSYDFFGDESAVLHGGAGRSYDRNLFEQLALESVKAALSPVVVYFSDAASRQPCFRDDRVCTAWNPGYLNGIDQLNTIPGTNDSSELFMFNNKLKTPYSDQYSIGISNQVGDWLTDVTFQRVLAYDGLVMSLVNRYPNGAYFDSTGSVPWGEPVPGYRNTILGYNGLEQRSSQFLLSAEKPYTKESGWGLNLSYTHTSARQNRTIDEPFAFDKATIRDYPFVKSDAVAAHRFVASGSIDGPWGVTFGAKLILATPEPINTIACYGFTDPDGGTCQAVGVTPPGNGKFLVGGKIWGYRTVDLQANKEFTVVGDFKLNARINVLNAFNFKNYTQYQYNSFGSDGRLQPDITVVDNGEISYVPRSVVLEIGAKF

SEQ ID NO: 9793 - protein, 1052 aa, Xanthomonas oryzae pv. oryzae
MKNHNLFLTPDYRYRLPESNFKKLILSLIILLSFVHVAAQNNINISGTVVDDQGEAVIGASVVAQKSKNGTITDVEGNFKLSVRSNDVLTISFIGYITQTVPVSGKNNIVVTLKENSMLLDEVVVTGFGLAQKKASVTGAISSVGAQELAHAKSVTATGALVGKLPGVNFRQDNGRPGAAPNIQIRNMGTPLIIIDGVQKDSGNLNNLDFNDIESVSVLKDASAAIYGMQAANGVVVITTKRGQKNQKLKVNVNGYYGWQLPSNYPKPASAEDYLAAIIQTETINGTPRTVTKEEYQKWVDKVDEEHTSFDWYKYIWVSAPQSYINANVSGGTEKVRYYLSLGHIDQEGNIRGFNGFNRTNMQSNIDIDITNRFKVGVAINGRIETTDNPGLPGDDYNLPIYGAYNNLPTKKPYANNNPKYPAISAPWAQDSFGWMNYEHAGRYKDQWKVIQINGTAEYEILKGLKARGLFSYWLANRRQSNREYSYKFYEYDKENDVYNVVETGTARYTERSMEMKEELTSNIQLSYENTFALHHVNAVVGFEAKKGTYPRMYALGNPPANGIPYIDKTSLSTFTDGIGNPQTRMGYIGRLNYDYANKYIIELSGRYDGSYRYKRGKRWGFFPSASIGYRVTEEKFWQDVDFLKDNITNLKIRASYGVLGEELGTALSHIVGYNYNDGGAVIDGGLVTGSTVTGLATDNITWGKSKILNIGIDLGFLDNRLNASFDYFNRDQTGLLASRYDVQIPEEVGFSLPQENLNSNYARGFDASVNWRDRIGDVNYTVGGNVTYSRWYVGDRYKPRFSSEWQKFRYQAGNITGRYTDVEFSLVSDGQFQSWEEIANHPIDQDHQGNITLKPGDAKYKDMNGDGLINDADWRAIGYRKGGTPWVNFAFNLALDWKGIDFRADFVGATAYTYVQQGFLRYFDSNKNLSQYLWNNSTRLVDIWDADSGFNIGKYPLALRTRNSSDCTHWPSDFWYTNMTYLKMRNVEVGYTLPQKWTSKVGISRCRFYVSGQNLFSLKNIDIDIDPEITAENGMAYPNMKVVNFGFSVDF

SEQ ID NO: 9794 - protein, 228 aa, Xanthomonas oryzae pv. oryzae
MWVYSSRFYNHNDGADMKKLTVAALAVATLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 9795 - protein, 1210 aa, Xanthomonas oryzae pv. oryzae
MTLSQTNTSATTVNLTRSGTATSGTDYTGAVTSVMVPANTASASFSVTPVADTTVETDETVTFQVASGTGYSTGSPSSATATIVNDDFPSASIAVSPASVTEDGATNLLYTVTLNQPSPTALSIGFGVGGTATSGTDYAAVNSPLVIAAGQTTGTITINPTADSTVEPDETVVISLNAGSGYTVGSPNSATGTILNDDAVVTISPALLPAATAGSAYSQTLSASGGTPGYTFVVSAGTLPAGLTLSASGVLSGTPTASGSFNFTVTATDSGAPTSGSRAYTLTVAGANVTLPATTLPAGTAGQAYSSAITPATGGIAPYSYALTAGALPAGITLNTSSGTLSGTTTSVGSFNFTVTATDSTSGTPSQGTRGYTLNIAAPTIAVAPSTVPTATRGTAYSQTLTASGGTAAYTYAITSGALPAGITLASNGTLSGTATLEGTFNFTVQATDANSFTGTQAYSLIVAGPNLVLPASTLPAGTAGQAYAAAIAPATGGTAPYSYAVTAGALPGGVVLDAATGGLSGTPTVSGTFTFTLTVTDSTPSPAAQASRSYALTVNAATLVLGQPTLPAAVRGTAYSQVLTASGGIAPYRYSIASGTLSGTPTVQGTSSFTIAVADAGNATATQAYTFTVNDAAPVAVADVAATMTDTAVTAAVTANDTGSITAIAIASAPTNGTAVVSGLEVVYTPNAGFTGTDVLSYTATGAGGTSAAVTLTITVNVRPVAVSVTAAAVPGEAQQVDITRHATGGPFVAAAVVAVLPASAGTATITRVGGTATAAAARASGLSPAATAMAEAPTFTLTFTPNPAFVGQATVQFTLSNAVATSAPASVVFTIAPWRAPSVDAEVRGLIDAQSESTRRFARAQIDNFQRRLEATHRGGGSFTNAVSFQPTSHCRQAERGISGQLCSPDTQDADNDFRDAPAVASSTGSSAQTPGDLGLWVGGAIRSGSLNRQTNSNGVEFQTDGLSVGADYRVASSLAIGAGLGWGRDDSDVGSNGSHSKATAYTMALYASFRPGKAFFFDTLVGYQMLSYDLRRFVTDDSSLAEGNRDGKQWIASLSTGADLQRGTLQITPYARVDVARATLDGYAEEGVAPFALRYADMDVATTTGNLGLRLEWRREVAWGRLSPQLRVEYQRDFQGRGDAILSYADLTGGPFYRTAQSAFDRNRLMVGIGAALLTEQGLSTRLEYRGITDGDSNNDQTWMINLEKKY

SEQ ID NO: 9796 - protein, 792 aa, Xanthomonas oryzae pv. oryzae
MKNSVIWICLLMSTFLFAQEKFSVSGTVKDKKNGETLLGATVYLKGTTIGAVTNEYGFYSLTAPSGTYTLVISFLGYQDITKEITLTVDQTVNFEIEEASTSLETVVIEAEESERVSIRKPQMSVSKLNAETIKQMPVVLGEVDVIKSIQMLPGVTNSGEGSAGFNVRGGAADQNLVLLDEAIIYNTSHFFGFFSVFNADAIKDIKLYKGDIPAKFGGRISSVLDVRQKDGNSKNLEVNGGVGIISSRLAVEGPMFNKKGSFLVAGRTSYAHLFLPLIEELKDDKISFYDLNLKTNYEINENNRIYLSGYFGRDIFDISQFVKNRYGNASANLRWNHVFNEKLFSNLSLIYSKYDYRLVLDFIQLDWVSDIKNFNLKYDLRYYANDKIKLDFGVSGITYDFNPGEVKPTDPSSPINFRKLDQKRAFEAAAYISAEHQLTDKLTAQYGLRFSTFSRLGGQELSDYANDQPVVYNEEIGIYEEGEEIGTTNYGKSESIKTFANVEPRLGLSYQLNDKSSVKASYTRSVQYVHLLSNTVSVTPLDVWAPSGRYIQPQKSNQYAVGYYRNFNDKKYSLEVETYYKNVDNRIDYIDGSDLIGTNNIETEILNGEARAYGLEILFRKNKGKLKGWLAYTLSKSEQRAPGGNAGGPGINRGNWYNTPFDRTHDISITGSYDFSEKWKFSANFAYQTGRPVTYPNGQYEYEGLSIASYDARNANRLPAYHRLDLSATYTPTKNKNRRWQGEWVFGLYNAYARRNAASISFTQDFDTGINEARRLSVFGSVIPSITYNFKF

SEQ ID NO: 9797 - protein, 656 aa, Xanthomonas oryzae pv. oryzae
MTQKRTLLKYGILSLALASPLSACAFDSLTVIGDSLSDTGNNGRWTWDSGQNKLYDEQLAELYGLALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSIQLMAQGSRTTLDSRYQQFRQGENPVGSLGMFGGYSGGYQRYDNNEADGNGNHNNLTVGVDYQLNEQVLLGGLIAGSLDKQHPDDNYRYDARGFQATVFSHLRAGQAWLDSDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLSDGNQTRYNVGFSARF

SEQ ID NO: 9798 - protein, 842 aa, Xanthomonas oryzae pv. oryzae
MLHKKVLLVLTASLICQESLFAKEKDYTLGKVSTAGKKDKSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIELDIFPVTFQAIDRIDVIKGGGSVQYGPNTYGGIVNIITKPIPTQWENQAAERITYWAKARNAGFAAPPDKTGDPSFIKSLGNNLLYNTYVRSGGMINKHVGIQAQANWVRGQGFRDNSPSNISNYWLDGIYDINESNGIKAYYQYYDFAIAQPGSLSEQDYKINRFANLRPLNQKGGRSQRFGAVYENRFGDLDRVGGTFSFTYYGQLMTRDFQVSSSYNSANMVTCFSEAACRAAGLPAGYNLAVPYYATNYNGWAEVENPVRSINNAFEPKVNLIVNTGKIKQTFIMGLRFMTTTFLQRQYLNTNECTTKTSGEGAGFLCEGANVMSGWKPHIKHGVYRNWNNWRNNYTAVYLSDRIEAWDGRFFIVPGLRYAFVQYNNENAANWAQIPEKDLRKIKHMNNWMPSTNIGFIPVQGDHNVLTYFNYQRSFVPPQLDVLSYGGAEYFTQHFDTVEAGARYTYKDKFSFNADYFRIWARDFATGQYSVYTSGPMKGNVRPINGYSQGVELELYYRPIRGLQFHAAFNYIDTRVTSHGPLTDLNGDVLKGTSYNKHFPFVSPFQFILDARYNWRKTTIGISSYFYSRAYSGISNSAAGGYYGMQYYSGGNNYESVLNSGYQCEAWCMTQHEGLLPWYWVWNIQVSQIFWENGRHRVTGSLQINNIFNMKYYFTGIGSSPAGLQPAPGRSVTAYLNYTF

SEQ ID NO: 9799 - protein, 416 aa, Xanthomonas oryzae pv. oryzae
MKLAPTLLGSALLLALAAPAAHAEIAIDVIGGSEVSLEGLVQADGNWFHNDVQDLNGAIGANGDNSEFSIRRAELVLKGKGPGNVEWVLGYDPSVLKQVTIKGTTVNSTGRFLDNNVKYKFGGNANNYLQIGQFKQPNSLEELSSTKNNDFVSKASVTNTYGISRRLGVAYGMGDTNWSVTASAFGRELTRNQAHGSGYGARGTWAPINETGNVLHFGLSYLAYDTDDDSLRLRARPDADLATVRLIDSGAITNVDNVGVAGAEAMWITGPFKVQSEYFQENANRIGANAHDYKSDGWYVSGVWNITGETWGYKAGVPTTPLPNEPASGMWQLAVRYDTLDLNDGHLVANGNTPFVDGVLGGKMNIWTVGANWYWRSNFKFALNYAKVDSSRYNSATRALVDDNPSIIEARAQFYW

SEQ ID NO: 9800 - protein, 840 aa, Xanthomonas oryzae pv. oryzae
MVAAHTCGVSCTRRFVLPAASIARLLAGILFSYAALHAQVSIMGRVVDENGAGIAGARVEVRSSAGLTVSAFSDPAGNFRAVLPGEGEYSVRVERLGFFLYTNPAQQFEPGASQLTIHLNHQQEFADKVDVTYSPPAIDPQETSERKELSAAEIQGVPYPAPQDYRSALPLFNGVVQDTAGHLHFNGGDSNQANYTLDGFNMSDPVTGRLETRINLESIQSMDLENSRYSADNGRGSSGVLDLKTRMGDDRFRFGGTNFIPGVTSDNGLYINKWTPRVEFSGPIVKGRAWFHNGLDAFYNVDSVHGLPNGQNRTSGLTVSDLSRFQVNITPANILTASFLYNLAETNRFGLSILTPAEATTNIRQTLYMSTIRDQHYFGGALLDIGFADTRGLLHNPSQGPEIYQITPFGNRGNYFSAVNRHWYRQQVAANLFLPTVHFRGSHHLKFGVDLEHESFHQQVARHDYEVLRDDNSVARTVAFAGMPFQSRKNVEAAQYIQDHWSPTDGVTLEAGIRTEWNEIVRDLEVAPRAAVAWAPRKLHDTKFSAGWGIYYDAINLGLIAREQDQISLSTFYLPGGVVHGPVATSFQVNDRALSTPRYQTANVTVERKLPFEFYGKAGYTWREGGDGFVFSTTAPQIGPMFYNGAVFVLKNARHDRYDAADFSIRRTFAGQFEWFLGYTRSSTRSNAAVDYSLENPIFAPQMPGPFAWDTPNRVHMWGWVPLPKRLLPPRLAFLIRNTTAAYLLEYRTGFPFNVLDEEGFLVGAPNSHRYPDYFNVNLHFERRFRALHYLWAWRFGYNNITGNLNPNVVENVQGTPRFLTYGRGQARAFSVRLRLLGRK

SEQ ID NO: 9801 - protein, 578 aa, Xanthomonas oryzae pv. oryzae
MNCKTLLSSAATAMLVFGSPFAIAADLPVKAASPLKALSEFSAWETQIGTRWWYSSGRVQKDLFGDGIASSTAVSRLIYDNLTGHSGEVFGRADHTSGLFAKFNAGLGSMGSHGKMNDEDFDPVAMGGTGYSNTLSTLRDGAFSYATVDLGYSFVTAPGAKLGAFVGYNHFFTQENAYDCVQQAANSMTGCGANTRVITESNHWHALRVGLSGDFMLSDRLKLNVDAAYLPYVSFRGVDDHVLRDLRIDEIGRSGDGAQIESVLSYAVTDAWSVGLGGRYWTFKSNSANARFQFLPAAPSNSTERTTFTAERYGMFLQSSYKWGDVTPVAAAASVKAPPVAVHWTGAYVGGHLGAGFGPKHWSDPLGSSMALVDPGPPDYAVGTPRGLNMAGFGKSTPMAGGLGGLQIGYNVQIDNTVLGFEVEAALADLKGSHTIYSGIGGGQAEAHTKALGTFAGRLGYALDRSLIYVKAGGAWAVTDHTLNTSSVYGNVQGLDCCGDTVSSSRFGWVVGAGIEYAVNRTWSATFEYDYMDFGTQSIRFPTNAGLGLPPAAIDQAFHTVKMGVNYKIDWPSISAHF

SEQ ID NO: 9802 - protein, 799 aa, Xanthomonas oryzae pv. oryzae
MHTSNALSLAISVALTVCSFAASAQSQSAQPQKTLDTLIVTGTRVSDRTVAESASPIDMISEESLQATGATDVATALGKLLPSLNFPRPAISDGNDAARPATLRGLSPDNVLVLVDGKRYHTSALVNYNPYVGRGSAPADLNSLPMSAIARIEVLRDGASAQYGSDAIAGVVNIVLKHGAGTGTNSMSVNGGIMDKGDGAQNGIDGSIGLPFGTTSGDTAPGWVRLSWNYQNSMDTNRSENTNRATTLAGAANPSGVPYQRHGDPDARFYQGLAAFGYDVTPNLELYGHLSVSRREVTSNGYYRAYDNTDRNVQAVYPNGFLPQIYNPINDRSAVLGVKGATASDWHWDVSATYGKNDMTFNILNSINSNLYWSTGRSPTNFNSGGFETEQGTLNADFNKSFDWGLAYPVNLAFGAEHRQDRYEIVAGSPASYFFDPDTINPDTGSPYPGGAQVFSGLEPSVAGRFGRHSNAAYAALEANLTDKLSGGIAGRYENYSDAGATRSGKLSARYAFTDTFSMRATVSNGFRAPSLAQQNYASVVTLPENGQLIQVGTYRTSDPIAVQLGARPLSPEKSTNVGIGSVWQPIANFTSTLDVYQIRIWDQILYSDQIQLAQPIGQVGAVQFFVNGATSRTRGVDWVNSYLADLGAGGSLNLSASANYNKTTILELSNPNFGRASEGLLTESTPRTKYMLAADWTLGGFSLNGNATRYGAIKRISDPADGSQDQTYSARWILNLAANYTWQALTFTVGADNVTNQYPTKAQLTNGYDDRASGLQYSSLSPFGFNGRYWYGRVTYRF

SEQ ID NO: 9803 - protein, 713 aa, Xanthomonas oryzae pv. oryzae
MSTFRFHALPIAIAAITLALPQPARAADTPTTDAVDATDGGTPIRALDAIQVQGTLLGRSKPDDVQGYAGSRQVIDREQLRNGGNRSLDDALQRVPGIKIFDETGNGALPQLMLRGLYESRSGRAQLLEDGIALALAPYGQTSLSLFPVGLHQIDRIDIVRGGAAVQYGPNNVGGVINLVSKEIPSAWNTTLAHKVTAGGQGQFLQDSALSGGGYLTENMGMQLDANRTYGEYWRAHSDTDISNLRVRAEWWLDDTTLLKARVQRYLVDMDLAGALSPDDYRRDPRQSTRPMDSFNGRTTRASLSYAQLLGDWGAMKDVRLDWTNFSARSSRNFIVGMRQASTETWRSDLPPQLRQTAPRDFRVVGSEPRLSWTMGDAGGMRQQWTAGARAVREDIDFLVGNLRLRDGLFTTVRDWQFEDHALAAYVSNAITLPDERVTITPGLRYERLDSRYFNRATGVSTFNRTRDVLPGLTLGFQANEQWFFYADGQRSMRAPQVTQIIFGNNLDAELAWNYEAGTRYQPNERTRIQLGGYLIDFDQQIQLDNTTRVFRNLGKTRHQGGELELQWSPEQLRALTLNASYAYLDASQESGAFRGFRVPYTSRDQITLGGSYALDHTTVALSGYYFSKAFSDAANTVQENAIASVGQLPAYMVWNTQVRHTLFEHDGEKFSASLAINNLFDRQYWFRGVDTSPWGRQAAPARTVTAELEYTF

SEQ ID NO: 9804 - protein, 1047 aa, Xanthomonas oryzae pv. oryzae
MYNFKSIKMNTNLKMLAALAAITLTSPVATLYATVGGQEVSQAVMTIRGNVKDVNGEPLIGVSISVKGRSGQGTVTDIDGNFTLQCEKGNVLSFSYIGYKTTEVKVGNKSDLMITLQEDTEQLEEVIVVGYGTTTRKSAVGSVSQVKSEAITKRPVANVTQALQGAAPGVIVQQTSYNPNDNKTNFNIRGISTLNDNSPLIVIDGIVSDGGSFNKLNPNDIENISVLKDAGTAAIYGSRSANGVIVVTTKSGKKNEKPTVRLNGSVGWQNPDILFSPVAGYQNATLTNLANTNVGNDPKFTPEQIRDLAAHQSEESWFYDQIMRTALQQNYNLSVSGGSANTTYMVSMGYFDQESNYVGNKNFGVERYNFRTNINTEVGRFKLNAILAYTRNNSISTTGSSLEIDAERVPTYYYYKMKSADGRYLLNDILSEFNPLGALEAGGFNKYRNNYLNANVSAEMKIIDGLSLKGVLGADVINDTRFTRNNAVEYYASEDATTPRPVNLANNKTSNWNSDAYLINTQLLLNYNKTFGKHTVNGLFGVTNESYTYTANEIEKKYVDPDLGIGTDTTTGEAGNITGKTSVDDTNRTSLTSLLGRVGYSYADKYYGELSFRYDGSSKFHKDYRWGFFPSVSLGWRLSEENFMSFYKEKVGDLKLRTSFGILGSQAIGTYDRFTTYTVYDNNYAYGNSVVSGTGFALGLNDLTWEKTKTFNIGVDASFFNNQLNLTFDYFYKRTTDILMKPIVPTVFGTDMPMDNIGEMQNQGWEIGINYNIRTGQVQHGFSLNLSDSYNKVLKFPGHEQITKVNELERIIREGVPLNSYYGYKTDGYFQSYEEVEASAIPVGGKVQPGDVKFVDRNNDGVIDSKDRFILGNAFPRYTFGFTYNLSWKGLDFSMFWQGVGKRDMMLRGELIEPFHENYSYNIFKHQLDFWTPTNTDATWPRLAAPGSDSNKNNYRTGSDMQILDGKYMRLKNLVIGYTLPKSWSKKVGMEKLRVYVSGENLLTFSNNSFIDPESTEFDSKMSAGGANSGRSYPTLRYYGFGIDVEF

SEQ ID NO: 9805 - protein, 485 aa, Xanthomonas oryzae pv. oryzae
MKKRNFATVLCALSATASGSTLAAELELYVDRKTKQIFAEPAPGRDKLGTFVQVDENGKLPASAMPATPAQPLAPAPGAATPADTAVAQAGPAPAPAATPAPAKSGDAGKKWYDKLSLRGYTQIRYNQGIGGDAQDLRAPGDRFIGNDQSLGIRRARLVLSGDLNEHVSLYFQPDFASTPTGSTTSNFAQLRDAYADIFFDKKREYRVRVGQSKMPYGWENLQSSQNRLSLDRADALNSGLRDERDIGAVFYYSPTVAKGRFQDLVKSGLKGSGDYGVIGAGVYNGQGANRAERNDSMHAVVHATYPFKFANGQYLEVGADAYAGRFVPTAAAVNIGGRSFTPAITEPNGYTDQRVAAHIIYYPQPFGLQAEWTVGRGPELDVAQRRIRTRSLSGGYVQAMFKHDFNYGTLLPYLKWQTYRGGSKFDTNAPRMRLDEVEAGVEWQPMDVLELVFAYSKMKRTDVSTAPYPVVEGDLLRLQLQVNY

SEQ ID NO: 9806 - protein, 1264 aa, Xanthomonas oryzae pv. oryzae
MDLINSLTDRQTDRQTDRQTDRQTDNHNSTTSHSSNTNQRLNGSSDSTSSNNSLTSDNQTPSDEPNKVDSSSSADSSTTSNEPTISDNQTTSDSPNATDKPSTENTNNEQATAETTDKQEVAKEEVKEEVKEEVKEEVKEEVKEERKEEITEEPKVEHQEQPQTETEKQPPREEENPQAEENLPAEESTKQELPAEEPSKVESPQEELPQVEEQKQPINTETETSVEDSKEKEKIEEKIKKDPEEENTVNSSDNRNEISTNNELTNSEATNNEISNNTDPVNNVVHNDNVSGENINQENNNLPTGNNNANKNTDTENNVSGNNSVENNDVTLNLNNNSESTTPENNPSTQSNPSIKPVDNQSWVQPQVEKLDKNNYQQTAQETKFTNKIGIVDMDYNVRDDLGKAFKFENGSDRIILNAGLYTRANGHKSSHGTMVAGVIDQKNKNATLYAYTAKSAYMEAVSASNQHYDEAYRHGVRIFNNSYGNNPHRDSVNGKGWKQLSDLHLYKQLAEMAERDSIFVWASGNDGRDKKTGRSEYATIEGHVPVIRDGARKGWIVVTSINPQNSGVMEYASQIGKDAKNWGIAAPGEWYLFGDKVRTEGTSFATPVVTAAVANVWEKFDWMDHHLVTQTILSTANKLNSSDVTEEPNERVGWGVLNQERALKGPARFDTKLLTDDNKTHVVAKLDYKHHTDRTKYTWSNNIKGDAGFKKQGTGTLYFTGSNSYSGNTIIENGTLVIGNELTQSAVEIQSQGTLLTKNLVNTEKEVKIVKNVDNKGSLEVYGKGLIIEGNYTTSNNARTVIDIDKSKLTVKGNVNLQSSYIVADVENINEVVPREPQTKTIIESQNPIQNYNGDYKISDRATPYIDLKEIKLNNENKEIIATYKRNDTEFVLNAANESSLKNVYTARSLDLILDRASDSGNTNGNLRSAALSFINAKPQAVASAVDSLSGEIYPAVHQVALNSIKTLNRQIAKQQFLNIQDIKPYHIYTQLATQNLKLYQNDNFGFANLKNSADSQLVGIDKQFNAFTFGMGLQRVHQKLSPLSSQNQQVGKVDLKQHSFALYGKYDWNKWYYLNQISFTDIKGKLDRTLLLPNGTQAIKANLKLRNYSFYNETGLNLQYEKLRFNPYIALHINRLKQDSINEKEDLALSIDKYHKTHYGYELGLRLNQSLSEKLNINLDVSYLYNKNSMNNMLSGKYIVSSTETKLYGMRLPKYEFKTSLGMGYYLTENFNIYANIAYYRLWNNPMKSYYKEGNIGAKYNF

SEQ ID NO: 9807 - protein, 795 aa, Xanthomonas oryzae pv. oryzae
MNQVKMVLIFAILLFLSCVNVSAQVIKGRVTDSTTNEALSYAAVEIRSFEDDVYIGGSSTNEKGEFEFHLKGRYPKIRITVSFLGYKTIQKVYAPATEYSYLKFEMQEDSQTLNEVVVKGLSPAEKVQRLAYNVSLVETAKLKSTTMDLSNVIDKISGVKIRSTGGVGSEANVTLNGFSGRHVKIFIDGVPMDGMSSAFGLNNIPVGLAKRVEVYKGVVPIELGGDALGGAINIVTDNSRCTRVNASYSFGSFNTHKTNVYAEHTTKKGFYVSLNAYQNYSDNDYKVNIDSYTKFNEDGSNQEVKENLTVRRFHAKYHNEVAILKIGIVDKTFADRLLLGFMGGYEYKQTQNASTMDWVYGARYTTANTLMPQLTYEKRFKVLKGLHVSLNGNYNFGKSYSADTASCNYNWLGQSQPKGVPGELSYMKYRYRDHNGAANFRMALFPADGQSVSLSSTLTTFSRSGKDETAYKPTYEHPSQSMKIVTGLSYKYDYKGKWNTSAFVKHYMNHLEAYLDPEGGINYQDFSNTTSYWGGGWASTYFWGRHTQLRLSYEYALRLPTSRELFGSGDDIERGNSNLKPESSNNVNISVTANAVDLTDHRLTIDAAFQYREIKDYIRRTTNNDSGRASSQNDGRVRNLGTDLSIRYTFKDAFFVGGNFSYIDMRSLTRYVTGTQQESKNYKERVPAIPYMYGNGEAGLTLRDVFVKGTVLDIHYMMNYVQKFSYEWNVYQNAELDIPTQFSHDLFVSYNFGKKSEFTVSAECTNIFNARLYDNFKMQKPGRAFAIKFGYSFMK

SEQ ID NO: 9808 - protein, 911 aa, Xanthomonas oryzae pv. oryzae
MNRSLLATTIASCLVLTACGGGGGGGNVRSNAPQDTIIAPAPTPPPPAADPPPKTAPAPTPAPQRYQGVGSNLLVPTNADLAQQAGAKGKGVKLAVLDDNLVQSYTPISGKVDSFNDYTASPGTPESSANALRGHGTIVSALVLGSAQDGFAGGVAPDADLFYARICAENSCGTQATRRAAVDLAAAGVRIANLSIGASYPDAAASANAALAWKYALTPLVQADALIVASTGNEGAAEASYPAATPVQEASVRNNWLAVGAINIDSAGNAAGLTSYSNHCGAAAQWCLVAPGSYTVPALAGSELGGQIAGTSFSTAAVSGVAAQVLGVYPWMTASQLQQTLLTTATDLGDPGVDALYGWGLVNAAKAIKGPGQFASDWAINVTSGYDSTFSNDISGVGSLTKSGAGKLTLSGTNTYTGGTTILDGVLSLTGSLRSDLLVANSATFEAHGGVINGNYSLVNSTGTTAIELGKALTVTGQASLKGNLLLLPEAAGYPVGSTEKIVNAGVLHGTFDRVQYANHFFWNAALSYNPTTVTATLTRNSSAASAQAAGAPQSVVNGGNQVDSLVKVLDTRVASGDTDNLGGLISATGALIAASDAQVAASLPTLAGQVHGIERTLGFQSALNDARVAADRLPYLADTTTLTTWMQGSYLDGDLSRSGFDSADYTQQATTFGVDLPMGNAGTIVGAAVTSGQDRAHIAASSSRLRSDRYAMTAYLYQPMGQAYLSAIGSYGMSNVETERNVQAGSIGERLQDRRHDTNWSARAEIGLMPHAGLSPFVAAGVVSQTQDAFSEASMTGLGLSANRDTLRAGYGEVGVRGHLAHGKWGFDGLVAYRSLLGNPNSDFSAWFTGLPEARFNVAGEPVSKQSLRASAGVRYQLNDTFSIYGNLGTERSRSDANSINANVGLRWQF

SEQ ID NO: 9809 - protein, 710 aa, Xanthomonas oryzae pv. oryzae
MPRRAPLARAVLALAASLSAQHVAHAQEAATAPAAPTATLQEVRVQDATDGSGYQGAQRQTAATRTDTPLVETPQAVRVVPRQLLEDLGARRLADTVDFVSGVTRMNDFGGTWDNYAIRGFSNTEGGSLLNGFASGRGYGPQRDAATIERVEFLKGPAAALYGSSEPGGTLNVVTKKPQFTAARTAGLQIGTLGMRRATLDLTGPATQNLAYRLNVAAEDGASRTGLVDNRKYVVAPAFAWTLGADTVLQYEAEIIRIRTPLDRGVVQVNGNALALPADRFLQEPDRGNLHVNGDTHQLTLDHDLGGGWRTRLGGTYRETEFHGNAVDFGTGQIGLLAANGRTLSRTDSWRTLPSRDVSVQAELEGKFSTGSLRHTVLAGLESWRLYMGQDIRYSAQKYPIDIYDPVYGTVPRGPLVQGYLQDDRLRATGLFLQDQIDLTPRWKLMAGLRFDRFHEDFVNWMTNARQNQQHSSATPRVGLSYMVTPDSSVYVSYGRSFRPNAGTDAAGNSFDPQEGKAWEAGAKWQSPDQRLNASMAVFDIRKTNVLTRDPANGNFSVAAGEVRSRGIETDVAGKLDAHWRLTANAAFTDTEVLRDNNPALVGKRLLGVPRVSAGLFAIREDRLASGGRYGVGAGLVHVGERTGTATDTYRLPAYTTARLTGYWQIDPRTRLTLDIHNLFDKHYAAASWNAIAVIPGMGRQVVAGVQVKF

SEQ ID NO: 9810 - protein, 1048 aa, Xanthomonas oryzae pv. oryzae
MNSFKSKAMFTFVGGLLVINPAFAQDVAPPPAPAPQSSSDSATTLDAVNVTGIRNSLNQSMGIKRDAAGVVDAISAEDIGKFPDTNLAESLQRITGISIERRDGEGAQVTARGFGPQFNTVTLNGRLIPGADAFGAPGQTPIGGVDVGTRAFNFAQLASEAITGIEVFKTSRATAPSGGIGATINIQTDKPFNHDGVVANAGAKMVSDRSEPFGDSLTPEVSGIFSYTNPDKTFGIGLSASYQKRHGGSVQATENTWNIQRWTGTDPALRPDAVVTNAPAIGQLYGMPNDLRYAFADFQRERMNGQAVMQFAPTDSLTLTLDYTYSANEIREERGEQGIWLQRANSFTDLTFDTGQAVATPVYLRDVPNGAKDFGMEQQRNEQKYTLGSLGFNADWQVSDRFQLSFDAHNSKTQSLPNDPTTGGSATYFSFAGTNNCTNGPYCGGQWGQELWFNNSLPIGARTWYPTAADSLANTNGVVNPAFTPAELGSQVLRIFYQKQVTETKEGRLDGKFDFDDGRFQFGVSSTNTTMQRRVSETNSPLGDWGVANAGNEPGMVALLQPVSITGMFKDFNPSGAASSAWRGGADQLALWGGSQYGATTRYNPQYTADNRVEEKTRAAYVQLEIAGAIAGMTTNTRLGLRYERTDVESTSQVATPTALLWLSNNDFQLIRSTDQQPFSEKTSYNYILPNMDFSIDFTDSLKGRASFGQTIARAPYNNLIAGPTPNTPNGSILINPSNRAGGDSQTPTLDPLESDNLDLALEWYFADASYVSATFWNKRVSNFIGNTVTRESLYGLTDPTSGPDAQAALAFLQSGACAAQVGAAGNDVAGACSANDTSLFAAMALLRNAAATGGLSAYNGSSAQSLALENAYDIAGNASDPLYQFDVSRPINQNKANIHGWELGGQYFFGSTGFGIYANYTIVEGDVAFDNTVIDRDQFALLGLSDTANVMLMYEKYGWSARLAWNWRDEYLIAANQDNANRNPYYVEPYQQFDLSVSYAFNKQLSVGFEAINLTGEDVRWHGRSEKQIIRLIDQQPRYTLGVRYAF

SEQ ID NO: 9811 - protein, 894 aa, Xanthomonas oryzae pv. oryzae
MALAFTPTAVFAQDIGEPDADLVEGADVEDQNVIIVTAQGRSQVLADVPVAVSAVSGETLQNSGASDIRELNQVAPSLLVSSTGNEANGSARIRGIGTVGDNPGLESSVAVFVDGVYRSRSGSALSELGPIDRVEILRGPQGTLGGRNSSAGLINIYTAPPEFDFSAYGAFTYGNYDAIRVEGGINAPLGDRVAARVDGVYFERDGFYNDVTNGGTINNRDRYLVRGQLLFEPNDDLSIRLVGDYSKKDEACCAATFVQPEFAPLARVSAGLDPFTRPSGGPALTSTDNPIIPILLALGQDSRALTQDTFNRDLYPTPGRSYEGETEDYGISGELNWDFGNVTLTSITGYREYANSQGSDTDYTTVDILYRAPTEDALAREFETFTQELRLSGEAFNGKLDWLIGAYYANEKLQVRDNLRFGTQYGNFVACRIAIAINPALVNPGASNCLGANVAALDGTLTGTPAFGAATPAVLAGINNLASISDLGGTREVYNQKSENFALFTHNIFAITDTLDLTLGLRYTNETKDFDATFGNDNTVCPTNRNLLGGFLGVPTLAPLAGGIIALSCQGNSTAELDGVSLEDSRDEEEFTGTAILSWKPTPDLLVYGSYSRGYKAGGFNLDRSALSNPLAFDPANISAAALQFDEETVNAYEIGLKYSGREFGVSIAGFRQEFSNFQLNTFNGAFYIVQTVNSCDSDLGGADTDASATTGACSSDEVAPGVIAQGVEIETYLRPARDLDITLGVTYSDTSFEDNLIGDDTGAPLDPALRLLPGDNLSNAPEIVATSSLTWTPPIGDSGLEGLVFVNARMAGDYNTGSDLLFGKEQDSFVVVNGRVGLTNIADRFAIEGWVNNLFDVGYTQVAFNTPFVAPQQTFSAFLAEPRTYGITVRGKF

SEQ ID NO: 9812 - protein, 1030 aa, Xanthomonas oryzae pv. oryzae
MKGMNRQLRGNLPPNEKANGKNRFLSLLLLFMAFISVQVYAQDVKVSGTVIAEADKFPIIGANIVVKGTTIGTVTDIDGNFSLDVPQNSTIAISYIGCETQEIKITGAKTLNIVLKDNAIGLDDVVVIGYGSQRKSDLTGGIVAVGEEKLQMVTTNNLMDKLAGQIPGMNVTTSNAKPGEDQSLRVRGENSLSADNSPLIVMDGIPYSGSLGDIDPDIIENMSVLKDASSAAIYGSRGANGVILIQTKKGKKGAPTVSYKGQVGMQQAQHRIDMMKGAEYVKYTQDYNRMKYGYSGDQLDPLVLLNPSERANYQNGSELDWQDIMFRNALTTSHQISISGGTEATTYMASISHLREDGVMENTGLKRTNIALNITQVLNKWLTVGMGTQAIQKEFGGEQPYLEAGLKMSPYGIYKDENDRYVDYPMDQTLFYNPMANIDATNDKTNRNVFISTFAEIQFPIDGLSFRTNFGYNYRNNFVGSYYGRNTLSGKKVNGSASIENIHYYDYTWENLLKYNKTFGLHKIDATALFSMQETTKKEAKESGESFVNDDSEYHNMAGAEKNKEITSKLTETAMLSYMLRLNYSYANKYLLTLTGRSDGYSAFGKNNKYAFFPSVAAAWNISSEEFMESQTNYLDMLKIRLSWGSNGNQAINPYQTLDRLTLTNYIWGDNGTVVNGAYLPTNGVGNPNLRWETSRTINAGIDFSFFNGRLSGNIDMYVVNTSDLLMSRTVPYMNGYKSIMDNVGKTRNKGVEIALNSVNFQNNDFRWTTNVNFSLNRDKIIELRGDGKDDITNKWFIGEPLRVFYDYNVVGTWQENETYVENGHTISWDAESGKFLNEEGKEYQKGAVPGSAKLEDKDGNGSITADDKKIIGSKLPSFLLSMGNRFDYKNIYFSFLLNGVFGQTKELHDYNFDRWMPTYNYISGMDYWTPENPTNEMTSPAYVPYDKHSFYKKMNYVNIKNITIGYTFPKTTLSAIGISSLSINASVNNLYTFSNIDNWLNLEDSDANRNVLVTYPTARSYMFGLNLTF

SEQ ID NO: 9813 - protein, 632 aa, Xanthomonas oryzae pv. oryzae
MVLSRSSSTTYLRLCILSAFGAFAMSANAATDVNVISDSELPQVELDKIVVTATRTPTKTSNVIAQTRVIDQEDLKRFQGQNALDIIKRQPGISHYTNGGPGTTSNFYMRGYDNKQILVLIDGVRYSSISAGGATLSLLPADQIDRIEILYGASGSSIYGSDAIGGVIQVFTKGSNIEKSQVSITAGIGSHNEYLYGASAQLNSGNGTTMSLSASHNETDGINATLPNAYGYNSDDDGFKSDNVSLALTQRINEQWLTGASALYSKSTTDYDDGAANAYSKQENGSAQAFVDWRYMPGSSVKLQYGHSIDKSDNYGSFPGVFDTKQNQVSLVGQHKFQVGQGIYGLEYLNQGLDSTAYTVDDRDVKSAFLGYLLAKNQFDAQANVRFDDNSQYGGETTYNLGGAYHINPNLRAGANYAKGFRAPTFNDLYYPGSGNTNLKPETSDNYEAFVEYDTVLQSTRLTGYHNKVDDLIGYVAKPTPGNPWGGSSENVDRAKIEGITLTSDWVVDSYLFGGSYDYQQAKNASGGASDGNFLAIRPEHKGLVYAGYRLPSLDVRAEYQYVGDYYSGVANTDSQLVDSYGLLNISGNYKLTDNLSMTARLNNIANKKYITLPGYNTDGINFFTSLTYNWF

SEQ ID NO: 9814 - protein, 482 aa, Xanthomonas oryzae pv. oryzae
MEPRDENYRKDQLFQRIPFEIFHAHRFEKKLHNLRTSLIFKSIWCSICIVSLVISTRSTFADDAIPESLPEEPRVEKPAYEQTCSSCECSGPDFWNQTTLTENLFQRRPYLAEQGITFEADVTQFYMGVASGGEEQDFRYAGHGDYVLNLDSGKLGGPQGLFVKLRAEHRFGEGITDATGAIIPVNLVADLPVADSTELYLTNVLFTQMFSESFGVFAGKMDTLDGDMNAFAHGRGKTQFSNAAFVATPIGLRTIVYSSLGTGFLIMREGEPIFTFTVINSTDTSGTSGFKELFANGASVIPELRLPTNLFGRPGHFLFGASWSSRDYAALEQDPFIVLPDIPISRKTDSWSLYWNFDQYLFVDPCDATRGWGVFGRAGIADAETNPIEWFLSFGVGGNSPISSREADTFGVGWYYSATSDRLSPFINTILGGVGDGYGVEMFYNIEVNKWFHLTADMQVIRPAHETVDTALVVGLRAVIDL

SEQ ID NO: 9815 - protein, 713 aa, Xanthomonas oryzae pv. oryzae
MPVFSRHRTLHALPLLSLLACTCGTACAQAAQSQARDLDAVQVRSQYTPYRALSITGATKTDAPLRDLPISARVLDRTLLEDAGVTDLAGALELASGITKANNLGGLWDSYSMRGFTGDPNFSSDYMVNGFNASRGYNGLRDAANTQSIEVIKGPASALYGRGEPGGAVNIVTKKPLFQPQHSVDVSAGRFDSYRAAIDSTGPLSENVAYRLNVMHKDQHSFRDTVDSDSTLLAPSLLWMPTPDTTVSYELEAVRLHTPFDRGVTAIGGDANRLPASRFLGEPRDGDIDLHSTGHQLFVVHGLDQTWSVQGGATYRDSGMRGFSTEPWTLQADQRSLRRERRYRDYQGRDIAARAEVLGSLQAGRVTHNVLFGIDGNRFDDSRFQQRARSAATPYSIDVLAPRYGLAQPGRLSTITATDERQQVWGVYAQDQIDLGARWKALLGLRYDHYRQDLDNHLRGTTQRASDGVASPRAGMTFHVDDALSLYASAAAGFRPNSGVGANGQSFAPEKSRSLETGLKYVQPGDGLEATVAAFRIDKKNVLSLDPADTSFSLPVGQMRSQGVELDLLGRLSTHLAASVGLAYTDSQVTRSSAAAASTGLAEGRRFPNVPRLSGNAFLNYEQPLTGKRSAALGVGVLHTGERLGSVDSNTDFVLPAYTVWRAVGHYDLSQRLRLYAKVENLTDRRYAAFSYSEQWVYPGAPRSWTVGAQLRF

SEQ ID NO: 9816 - protein, 743 aa, Xanthomonas oryzae pv. oryzae
MRHHHPHSAGPARKLLRCALASCLLLGAAPAFAQSTAATIRGQVTIDAAPAAQAQVTATNLATGLTRSVQVSNGGYSVGGLPPGSYRIDVTANGQTSSQNFTVQVGQTATLNLGVGGEPATAAGGNATTLDAVQVKAPPVLVETRTSENVTYISNVQIQNLPRATRNFLELADTVPNVQFTREANGTTKVRTGATSAEGTNVYIDGVSQKNYVLTGGVSGQDSSRGNPFPQSAIGEYKVITSNYKAEFDQVSGAAIVASSKSGTNDFHGSFFWDTSNDSWREESPLEKKAGVRDDFEETQYGATFSGPILKDKAHFFIAYEAKEYTTPNVVIPGSIYSDRVDQLPVQLQPLVVTSSTPFKEDLYFGKIDWTIGQNNLFELTGKYRKEDELNDVGQTATYEHGSINGQEEKRANLRWQYSGANVLNEANLSYESAFWNQAPINNGNGYILSYPPVRGNETDILAAGAGSSFQRKGQKGWTFQDDLTLNSLEWHCAHTVKMGVKFKSIDLDSTQFNPVNPQYYYNILTDVETPYRVRFGAPLVEGGGSVVSKNKQYGIYLQDDWEVNEHWTLNLGVRYDYEQTPAFLDSVTPSDVASALQNWPNLRNANYTINDFISSGNNRQAFKNAWQPRLGASYDLFGDQAHVIYGGAGRAYDRNIFDYLALEQLNNSFKSYSYYVTSANNGACLGDPCTAWNPAYNNQEGLNTLTDNSTGGGGREVYLIDNNLKTPYSDGGFNSDSQHQRL

SEQ ID NO: 9817 - protein, 175 aa, Xanthomonas oryzae pv. oryzae
MRLNDRAGETRYIDPVTEQERSSRFWLRQIGGHNAWRDSNGQLRTTSAQAIWMGVDHNVHTEANGSRIENDANNNIQTRLGFHTFIRTQEKNSGPHGDDFEPFVEMNGIHNSKDFAVSINGVKVEQAGARNLGEMKHGVNGNLNPAASVWGNVGVQLGDNGYNDTAMMVGLKYKF

SEQ ID NO: 9818 - protein, 397 aa, Xanthomonas oryzae pv. oryzae
MSNDTLRLRALGACAAICLAPAAHAADEAGPVTAEVGGRVHWDFTMFDNDDRGAREHNDTQFRRVWLDVSGKFYGFNYKAEADFAGLQYEAGSRGILARDVYIAKKFSAGTLTVGQFKQYFSLDDRTGSNYGPFLERGYASTTLAPIYRKAISWQTSRPNATWSTSAYSLESIDNSSTKGGALGTRLTYAPEMGQARLRHLGVSLAHERYSHPGSGGASSLLIRPRPENDLANNSRITLARFADGRDTDFDKWSLEYAEVLGPWSWQSEFSGGLLDDGAQHAKVLASYGLVSWFVTGESRGYDRKTGRFSRIATPNRPSGAFELALRYDYMRGGQHLDRQPDFINASTQSWTLGGNWYFKPNLRVMLNVIDSHNRDRIANAVVDHTLAVTGRFQYDF

SEQ ID NO: 9819 - protein, 814 aa, Xanthomonas oryzae pv. oryzae
MSTLHTLRLHALACAVVSCLCAPAALAQDTAAAARAADSAAVNLDSVFVTGTSTATTKLKSSVSVSTVGAEAIEQSAPRSTAEIFRNIPGIRSESSGGEGNANIAVRGLPVASGGAKFLQLQEDGLPVMEFGDIAFGNSDIFLRSDFTLDRIEAIRGGSASTFTSNAPGGIINFISKTGDTAGGSVGVSRGLDYDNTRIDFDYGAPFAEQWQFNIGGFFRQGDGIRDAGYGTDKGGQLKANLTRLFDNGYVRLYGKYLNDRAAGYLPVPASVRGSDGSPNLGRLPGFDPGRDTLYSPNFRSDIGLDGNNGPRSTNLSDGMHPISRTLGAEAWFDLGNGWNLSEKFRIADNSGRFVSPFPVEVSDAATLAAAIGGGGAQLIQATGPQVGQAYSGLAVRTHLFNVAINDLGNVVNDLSVSREFGGDGRTLNLRMGYYTSRQTIDMDWTWDSYVQSLGRESRLLNVVDANGTSLSRGGLYAYGTPFWGDCCVTRSYDVRYDVNAPYVALTFDSGKFSVDGSLRYDMGDARGSYNGTAIAQNLDVNGDGVIQPVEQRVATVDTANSRPVNYDWNYLSYSLGGNYLLTDDLGAFARISRGARANADRLLFGVVRDDGSVSTNEGVNVVRQAEAGLKWRRDGLSLFATAFSARTQEQNFEITSQRFFNRSYEAHGVELEASYRYQGFTVNGGLTWTDAEISRDQITPENTGNVPRRQADVVWQLTPSYRGDHYQFGVNLIGTTDAYTQDSNQLKMPGYTQVNLFGDYRVTDALTVALNVNNLFNTFGLTEAEEATIPANGIIRARSIAGRTTSISLRYDF

SEQ ID NO: 9820 - protein, 777 aa, Xanthomonas oryzae pv. oryzae
MISTRRFHVTPLALALATLLPVVAQAASPAEPFTVAPAAEAAAPADAATNATQLDAINVVSQGSTRQVQRISRQDIEQLTPGSSAFKAVEKLPGVQFQSADPFGTYEWSTQVTLHGFDQSRLGHTLDGIPLGNMSYGVTNGLHITRAIISENLGSVEIAQGAGALGTASNTNLGGTMQFYSADPQTTPGARLVQTMGSDATRRTFVRADTGDRDGLSAYLSYANASTDKWKGDGDQTSEQANLKTVYQWGDGNRLSLFVDTSRRKEYDYMDLSLTSQRALGWDYDYLQPDWATAVQMARAYQNTGATSGVANGYPQSLAGLPSDYSWLDAMYYAGGGLRRDNLAGLSGTFVFGGATLDGSGYYHGNRGEGQWVTPYVRTSADIPLSMRTTDYRLDRFGGTSALKWSWGNHDLEVGAWAENARTSQGRNYFALGNEGQTSLYKVYEAQIPFRHDFLQRYTTQTRMLYLQDTVRLLDDRLTLNYGAKALSTTTRAQSLVPTTALAQGRIPAEDHFLPQVGVNYKLDERQDLYASFSKNIAAFGFTPFATSQAAFDRSRSTLEPEESQTVQVGYRVQDAQFQLSADAYFTRFSNRLLTTSPCTAVQTCAAILSNIGAVHSAGADLTLMWHPTEGLSWLNSLSWNRSRYQDNYLNNGVVATSGKDVVGIPALMFSSSASYQIGNLRLDLDGKYVDKRYITFLNDSQVPSYWLLNAGARYDFGRVGGVADVALALNVSNLTDKRYFASTGTNGYVASDPDGYNQTMVVGAPRQYFMSLDVKF

SEQ ID NO: 9821 - protein, 707 aa, Xanthomonas oryzae pv. oryzae
MTPRLLSAAITVALLAAPIGAASAADADSERTTDLDTVNVIAKLEAARNALSPDIGSSQFAITADDIDRLPLGAATPLNQVLLQAPGVVQDSYGGIHVRGDHANLQYRINGVIIPESISGFGQSLEPRIIKNLKLLDGALPAQFGDRTAAVVDITTKNGAELGNGGSVGITAGSYGTINPNASLWGSSGRLSWFVSGDYDQNKNGLENPVDSLNPLHDKTHQGKGFADLTYLVNEDTRLSLLVGYANNRFQIPNNPGQTPAFDYLGTTDFDSSRLDENQRENTRFGTLALQGTLGDTNYQLSAGQRYSSVAFSPDVAGDLIFNGIASQVDRSNRANTVQADFATPWGGSHTLRYGVYGNFEHAIASNNSYVFPANDDGSQSSNVPLFILDGSRFHASTYALYLQDEWKIGEDWTVNYGLRGDKYKAFGTTEGQLSPRLGVIWRASDSTTLHAGYARYFTPPASELISTSDIALYDGTTNQQSAGDGPTTPLSERSDYYDLGISQVVTDHLTLGLDTYYREADRLQDEGQFGAAYVYSTFNYRYGRIRGAEFSADYTNGPVTAYFNLAYSKAMGKRVMTSLYNFDPDALAYTYDNWIHLDHDQKLTSSGGVNYAFSEGSKVGLNYLFGSGLRTDTDTVPNGASLPSYFQLNASVGHDFDVSTHPLHVQLAAVNVLNRSYQLRDGGGIGVFAPQWAPRRGVYVSLQQDF

SEQ ID NO: 9822 - protein, 1012 aa, Xanthomonas oryzae pv. oryzae
MDNKPKPLQHGRQGLRTFSALVCLLLMTTSLFAQEKTVTGTVTDSTNEPLIGASVVIQGTSNGTITDIDGKYSITASPDNVLEFSYVGMVKQDVTVGSQHVINIQLKEDSQMLAETVVIGYGSAKKRDLTGSITNIKGAEIANKPSTNPLSSLQGKVAGVQIINSGQAGSDPEIRVRGTNSINGYKPLYIVDGLFNDNINFLNPEDIESMEVLKDPSSLAIFGVRGANGVIIITTKKAKEGQTLVNINTSFGWKHVVDRIKMVNASQFKELYSEQLVNEKNPAFDFSGWNADTDWQDEVLQNGFITNNNISVTGASEKHSFYLGMGYSYEQGNIKHEKFSKITLNASNEYKITDKIKVGFQFNGARMLPADSKSVLNAVRTTPIAPVFNEEYQLYAALPEFQKAQMMNPMVDVDLKANTTRAENYRASGNIYGEVDFLEHFNFRAVFSMDYGSNNGRTYQPIIKVYDNTVKGNVATLGTGKTEVSQFKENETKVQSDYVLTYTNSFGDHNLTATAGFTTYYNSLSRLDAARGQGIGLVIPDNPDKWFVSIGDLATATNGSTQWERTTVSFLGRVIYNYKGKYLFNGSFRRDGSSAFSYTGNQWQNFYSAGAGWLMTEEEFMKDISWLDMLKLKGSWGTLGNQNLDTAYPAEPLLENAFGAVFGNPSTIYPGYQLAYLPNANLRWEKVEAWEAGFESNMFRNRLHVEGVYYKKNTKDLLAKVPGLSGTIPGIGNLGQIENKGVELSATWRDQIGDWGYNVGVNLTTIKNKVKSLVQDGYSIIAGDKSQSYTMAGYPIGFFYGYKVDGVYQSQADIDASPKNTLATVTPGDLKFADVNGDGEITPADRTLIGDPTPDVTYGISLGVSYKGWELGIDMMGQGGNQIYRTWDNYNWAQFNYMEQRLDRWHGEGTSNTQPVLNTGHAINFENSEYYVEDGSFFRIRNLQLGYTFDKALISKIGLKALKAYFNIQNLKTWKHNTGYTPEFGGSAIAFGVDNGSYPVPAIYTFGLNITF

SEQ ID NO: 9823 - protein, 799 aa, Xanthomonas oryzae pv. oryzae
MRLGLLALFLLFFSVTFAQEITVLDESTGEPVSEVAIYNKDKSISAVTNGVGKANISDFTDTEVIIFKSMSYVEAYRRKREILNNSNIVLLQSIENQLDQVTLSVARFKLKKDEIPQKIISISPSEIQMASPQTSADLLESTGQVYMQKSQMGGGSPMIRGFATNRLLLTVDGVRMNSAIFRSGNLQNVISVDPMMVESAEVILGPGSVVYGSDAIGGVINFYTLKPKFSFNEGTSFSGNIYTRFSTANNENTVHADLNIGRENWAFRTGITYSDFGDLRMGEHGPDDYLRREYAERQNGVDVMVPNADPLVQKPTGYDQLNLLQKIKYMPSKDWDINLGLIYSETSDFPRFDRLYRKRDGVLRAAEWYYGPQTWFLGNVNVNHRSNSILYDKMQFTAAYQFFGESRNDRDFGELILFNTEENVDAYSANLDFEKDFSTSKLFYGFEYVLNNINSEGSFRNIETSETGVTASRYPDASQWQSMAVYSSYQWKLNEDLSLQSGIRYNHILVDAAFDDRFYDFPFERADISTGALTGSLGLNWRQNSFVGWRLGLSTAFRAPNIDDVGKIFDSEPGSVVVPNPDLKSEYAYNAELGADFNFSDDIRLGLNGYYTYLDNAMVRRDFNLDGVTEIDYQGEPSSVQAIQNVANAYVYGVEAGLEVDFSVALRLKSQFSYTHGEENEGDEYVPLRHAAPMFGNTHLIWNKRKLRLDLFAEYNGEFEFNDLAPGEQDKPYLYALDANGNPYSPAWYTLNLTGQYKMNANWLATVSVENITDQRYRTYSSGIAAAGRNLIIALSYTF

SEQ ID NO: 9824 - protein, 910 aa, Xanthomonas oryzae pv. oryzae
MQVSSVSKALEGAAAGVQVINTSGQPGENAKIRIRGIGSFSASSAPLYVVDGMPYDEESVNALNPADIESMSILKDAASAALYGSRAANGVVMITTKKGMVDKSKVTLDARWGVNTRGVPEYDIMKDQREYVLTAWNTLKNQSTGAEASEELIGSIGYNPFIGVANNAMVSADGVVSSAALRHNDDWADAALHNGMRQEYNLSLQGGNAKTTHFLSLGYLKDEGILRHTDFERISARANINHTVNKFIDINGNLAYARAEKNAGQSQNASLSNYSNAFMFTQQIAPIYPVYAYDENGNRIYDEEGNTVYDFGDGTYSTRMGGFSNQNVAANSGLDVHQTLNDNFNGRGTININIIDGLKATANIGYDLMNQIRTDHMNQLYGDAANVNGRTYKYNQRIESFTANQLLTYSKAFGHHNIDIMAGHESYSYTLKYQYAHKYNFYTIGNPEFNNAITMSDMNSYTQEHSMESFFGRVNYDFDNKYYLSASIRSDESSKFHPDHRRGTFWSVGGSWRLTQEEFLKDVEWLSNLKLKASYGTQGNDGILDINGYVVYQPYLKQYSVTNNNGDFSVVETYRGNKDLTWEKSKNLNIGLEAAFLNNRLKLETEYFLKKTSDMLYNMPYPISSGISYVPMNLLDMQNKGIEFTISATPIQTKDFIWNLSFNGTHYSNKILNLPEDKRENGIIHGTASLFRLMEGGSIYDLYTYEYAGVNPETGAAQWYMDEKDANGKVTGRTVTEDYTQASKYELGSTLPDFQGGFSTDFAYKGIDLSIATNFQIGGKIYDSMYSSFMHAGSNIGSNWHKDILNAWTPENKNTNVPIMDGAQNSNSQSSRFLINASFFNIRNISLGYTFPKEWMKAISASSARIYVSADNVALFSKRKGMDPRQYAYGYSAANYSAIRTLSFGINLNF

SEQ ID NO: 9825 - protein, 826 aa, Xanthomonas oryzae pv. oryzae
MSASRFMLRPLTRALLMHGATRTRLAGTGLGLALTLTAAPYVQAQEWTLNIPSQPLAQALQTLGQQTSLQIIYSPESLQGLRSTALNGRYQDDESLKAMLNGTGIRYQRDGNTVTVLGPATGSAMELAPTNVNASRLGATTEGSNSYTTGGVTIGKGVHSLKETPQSVTVMTRKMLDDQNLNTIEQVMEKTPGITVYDSPMGGKYFYSRGFRMSGQYQYDGVPLDIGSSYVQADSFNSDMAIYDRVEVLRGAAGMMKGAGGTAGGVNFVRKRGQDTAHTQLSLSAGTWDNYRGQVDTGGPLNDSGTIRGRAVVTEQTRQYFYDVGSRKDQIYYGALDFDLSPDTTLGLGFAWEDVDATPCWGGLPRYADGSDLHLKRSTCLNTAWNNQRSKRATYFADLKHQFNDDWSLKVAGVYSRNTQDMEYAFPSGAVPVGATATNTLMLGSIYDYDQRDYGFDAYVDGKFDAFGQQHELTIGANASRSHKDDFYAVAALPQRQNVLDPNHHIPQPDESYYLANASRGGPVDMHIKQYGAYSIARLKLADPLTLVLGSRVSWYKSDTDSVQYFRGEGTQVDTKSTETGQVTPFAGVLFDLNDNLTAYASYTDIFTPQGAYKTIDGSTLKPLVGQSYELGIKGEWFDGRLNSTFNLFRTLQKDAAQDDPRCEDSSCSINSGKVRAQGFEAEVSGEVIDRLQLLAGYTYTQTKVLEDADATQDGVVYNSYVPRHLLRVWGDYSLSGPLDRVTIGAGVNAQTGNYRTSPIGGDNIDGAGYAVWNGRIGYRIDDTWSVALNGNNLFDKRYYSTIGTEGFGNFYGDPRNFVMSVKADF

SEQ ID NO: 9826 - protein, 709 aa, Xanthomonas oryzae pv. oryzae
MAVLLGFVGSGPHAARAEEAGAGRDVQLGELSVEGAAAPRGPMPAYAGGQVARGGRLGLLGDTETQKAPFSIASYTDTLIRDRQARTLSETLVLDPSVRATQTTGAPFDSFSIRGFPANENTSGEVAFDGLYGIAPSFRIFTDYVERIEVLKGPSAALTGVSPNGAVGGVVNIVPKRAGADLTRVTLDYGSSAWGGSQVDVARRWGPGREWGARVVGSLHGGATPFDRQTETTGVGALALDYQGDRFRAWLYLLAQTDRFDAPLRPFLLRAGVPVPRAPDGRLNLTQPWEYSDVDDRGGLLRTEYDLTDQVTLFADVGGGQTGVERYFQSAPTILNGRGDTTSTPQFYALGVDRLTYDGGVRARFETGFIRHALTVQGSVYDEATARRFSPGRGAYLSNLYAPALVPYIAPIYGVGRPRLSDSTLSGIAVADTLSALDERVLLTLGVRRQRVEAHNYVSNVGTLASSYDRSATTPMVGLVVRPWDSVSLYGNYIEGLSRGDVAPAVATNSGTILAPYVARQVEAGVKLDLGRFGATLGAFRITKPAGELGPQGRFAATAEQRVGGLELSLFGEITPQVRVVGGVTLLDGRLVRTALAANRGHRPIGVPEVQASLGAEWDLPGLPGLTLNGAVIYTGRQFVDLANTQALPDWARLDLGLRYTTLVAERRTTFRASVLNVTDARYWTGVASFGTFFQGAPRTYLLSMAVDL

SEQ ID NO: 9827 - protein, 823 aa, Xanthomonas oryzae pv. oryzae
MALAVSTASAQSAAEPKANENAGIEEVIVTAQRRAQSLQDAALAVQSFDTDTLTQSGIESATDLGLLSPALGISAGGGPLASFFVRGVGALTVNPLTDSAIAQNVDGVYLGRSSGAAGQALFDLERVELLKGPQGTLYGRNATGGVVNYIPNKPVLGENSGYMQAEVGNYSKLGLQGAANIAVSDDVAIRISGNKLERDGFSDDGTNDQDSFGLRGQLLFNASDKLSIRLAVDHSEVSGKGAGGDLYGTYSNDTGSLSEFTPTGLPIDSGPTDAGANAIRSGILHTPSFAPFQPIDGEDLYQDISWTGFSAEINYQTDVGTLTFIPAYRESEQDYQFSGPGFAPAKTAEENNQTSFELRFATDLDGPLNGILGAFHIEEEISTSTVFAQNYASPIQNYDNGGDSWAVFAQGTFDLSETFRLNAGVRYTEDSKFVDGISDTFVTFCGGAPFTGNFLTPGPPPFNSFANGCASGAMPAQPVTSDRDAFIQYFVDEGLIAADSVADIPGRGRPPVYNFNLPGGVPPTPGRNPEPILGAIVNVGDGELAADLSYSETTYRLGAEWDWAESNLLFATFETGYRAGGVDLAVGPASTYDSEFIDAITIGSKNRFMDNTLQVNAELFLWKYDGQQVTYFTTLEGASAFPIANADATIQGLDIDVIWAATGSTTFGLNVQYLEASYDKLALISDPGKGRFGCSSNGVSDDVESYDCSGSDMLYSPEIGADLNVNHVIDLANHQVSLTAMVSHRSEQQTNFLLLEDTKSDSYTTLNLDATLYSGDEDWSVSAFVRNATDERFSINTNVSNRGLAYAIFSPPRTYGVRFMASF

SEQ ID NO: 9828 - protein, 918 aa, Xanthomonas oryzae pv. oryzae
MIARCSLLAQALCLSLCALCGHAAAQETQATTPAKGEMATLDKVTVAATRYNATDMQMAATNTVNVLSADDLKTTAVHNVAEALGLMPGVNVINTGQSYFGGIDGAARGEGMFSSVRGLNAEYNVNLINGINVAQGMPYSRGVQLSLLPPSGLQTIALSKTSTADMDGDAIGGTIDYRTPSAFDSTDRQGGSVTLSGRLESRARDYGDSGLGSGAAGDWHARFGDAGQFGVAVSAYYDERHFVNSEVAAASAARNDGAWKFGRADASGKLAAGADPQDVLQSTGMNIGYSQGDTRRYGGNAAFDWRVDPSLHLYARMTYAFAKTEQNTGYAQFVPANVSFTQIGTSGVYQPQINRVAVRYWYETNPEKADLATVQFGADKQLGHWTFSPNIFYGTGNNDRPDHVEISARNDQYSSTNFAYGANRFISYDGNGFPTPLLTPAMQAQASDVESLYARRTGQISKQYSGQDKGGGKFDAAYDFDAGLLSRIAFGVKYVDSSRNFTDRDWTNAKYTDRTLLRDTGLIAQRYDSVYPGQYAFPTVRLSNAALNDLIARTLTPASFDSCGKLAINNLNCNTMRATEAVSAAYAMATLRSGNWEILPGVRFEHTAITNTFWAQPAAINGAEQVGAFANNHSRYNVALPSVFVNYRPDGDGAVYRGSVWTSYTRPAFVQLGGGRSTDISSDGQTTITEGNPDLKPIKSLNVDVSGEWQNDSGGHAMLAGYYKRLTDYIYESGSNAANPGESVTASTRFVRPQNGGDGRVLGMEAAVRQTFQGLPAPLDGFGIGANVTRQTTRVDLGTEGFAHERIQNAPNLLANAELFYEKGPWSVNLSYHYSGEYVSVYDYLNQGAQWDNLWIKPITRVDLHLGYAPTDHLRVDLSVANLTNQHSYWAHVGHNTDAISDIVDSGMTSLVTAKYVF

SEQ ID NO: 9829 - protein, 385 aa, Xanthomonas oryzae pv. oryzae
MRSIRVILSTLITTAAALVCQSGAHAQSSVDLYGVLMSGFIWTNNVAGGKSVSPAEGPSRWGLKGNEDLGGGTKAVFTLESGFAMSSGQSFQGGRLFGRQAFVGLSNDALGTFTLGRQYDFANDWLAQSSAVYRWNGYFAHPGDNDNFNWQFRVNNAVKYQSPVVGGLQIGAMYSFGGVAGSFGNESAMSFGAKYENGPAKIQAAYFHMNHPALAASEGNWNTMLFPHISAASPNEANALNPQSMDIYGIGGTYQIGKTTLGLLWSHSDYDKLGDQGDGLADADARFDNIEANIAYNLTPQVQFVGAYAYTIGKVHPTDFAPQYHQVDVGVNYFVSHRTILYLAGIYQRAAGDATYANIECAGSSCAASSSRNQVSALAGIFHMF

SEQ ID NO: 9830 - protein, 751 aa, Xanthomonas oryzae pv. oryzae
MRHTAATLPLAMLALAISGQLAAQNTSATAGTRQLDAVSVTAVRGARSVAEIAGTVYAIEREQIAPQITAGRSTADILGQLVPSLAPASGTTSNYGMTMRGRSVQVMIDGVPLTGARDGSRQLNSISPTMIERIEVISGATALYGAGASGGIINIITLQPGEQPVQLASQFGLRSPSHLSSDTLAWNAAQTMTVRGDQFSGAFGFAYGRQGASLDAHGRRIGPEIAQTDRQDTETRELNARFDWTLTDSQRLSVGVRWFDDQQDSDHGPDYGPRLAALFNPAFTPSHQALPGLQLEAQPRTRHQGVNAQYRNRDVLGGQELSVEAYYRNEQGRWFPSVSTLVHPALRGGFAYVAMQSNTEIDVWGLRSALHKDFQVGGRSLQLSYGVDHEREQDSQRGQMYDINRFIASNGLDYRPTAQYAMGPDVRVDTTGLFLQADHSLGERFSVQAGVRHQILRNRVEDSLPYTEAITADAVAGYTPRLLQGGRVRHAQTLFNAGVVYRLDASQQLFANFSQGFSLPDTQRMLRDVPASFVIDSRNVGPIKVDSYELGWRRSDASLQSAVTAFYNRSDKTVQFNRDYSVSVADTDERVWGVEANLRYTPTAQLELGASLASTRGQYRDAAGRWRELNAFRVSPLKAGVHGQWRFANDSLLRLQGQVVGGTDRAWRDAPLAAISPSIRATPAAKIHGYAVFDLIGEVPLAGGRFSAGIYNLADRDYRTVYGQQAEATYGKMSSLPAAGRTFSIGYRVEY

SEQ ID NO: 9831 - protein, 1071 aa, Xanthomonas oryzae pv. oryzae
MKNRYGLSSRWPVPLFRLGIVRPDISSFAAPALAAQADNVQVQSPVLSDNIPSVINLSDAPKTSSTDKKTDKTKDKDHNSTSDTNTITVTGTRLSKSRLSNVMAGSTLGEEQIKTRGYSDIGLALLRENPAFSVPNNSPIGSQSSYGAGQSFVSLFNLGDQRTLTLINGMRMVGGATASIFGAGSGSQVDVGTIPTSLIKKIDTKYGGAGASYGADAVAGVVNYQLDDHFKGIDFNAQGGFTQRLKAPQEKIYFKGGTEFNEGRGGIVFDVEYRHSGGVLAKDRNNVFGSEKTSYSHRPIGSTSPYSYVFTKGRRYIQSSVTGMPLTAGTMGSYPTYLNQIDLGVPSGSGNQAAMFSQDGKSLVPLTADTLIRDNYYGLGGNGIALSDYSQIYTPSKTLNLTTLGHYDLSDHIHATWQGWYQRGEAKSQVGQGTWQDTGFQGPMTMDSYLNGDSYTGYTDVNGPLTLSTNNPFLTAAERTTIVNALKAAGQPTDTFYMERLNQDLDAGMFRTKDQMYRLQGGLDGDFNAFGRHFNWKIAGEYSQYFNNTWQPSINTQNFINALNATTDAAGNIVCAAGYVNSTAATRSSTCSPLNPFGFNQMSQAAKDYVISDVHSKNRNSQRDIQAEINSTIAKLPAGDIRWDIGYEHRRESYNFNPGSFAEGELLSDGTRRRYGNSAPITAVSGAYHTHEAFGELDIPLISPNMHMAGAYNLSVTANGRYINNSMTGSYWTYMFGGAWWPTRDFGFSGNYAQSVRNPSVTELFATKSTVYGSANDPCSYEFLDSGPNPATRRANCAAAGIPTNFQSQIVNQTMPGTSGGNTHLKNETSHSFTAAVDFTPHFVPGLTINGAYIDVKINNEITSLGLGDLMSACYDSSSYPNSSYCGAFTRDPSTHQVTDFAEGYYNVASQHMQAVQGKINYVLPLRRLGLPDSAGTVELTGNYIHYVKNEQKILTSTYDMFGTTTQPQDNFTINMNYTRDRLSFQWQTIWYGKARYAVQVSDKTYENNRRPDFAYFNMTVGYRITDHIDASLIVNNITDALPKYPGSISVTRYYESLMGRSFKMSVGVHF

SEQ ID NO: 9832 - protein, 1128 aa, Xanthomonas oryzae pv. oryzae
MKKKDDFCRESNHFLKSVCLALCLISSGGSAVYAATLQTEQTTLTVRMNNCTIKDVFDHIEKNSEFVFVYHGANIDLHRRVNFDVRDKSVEVILERLFKGTDVEYIINNRQIIVRRNEKKENSSLSIQQAKKITVTGIVKDTHGEPLIGVNVLVKGSRTGTITDMDGHFLLNEVSPNAMVSISYIGYKTEEIALNNRSSLTITLTEDSEQLDEVVVVGYGTQKKVNLTGSVSSVKFDEELANRPITDASQALSGKVSGVWISQNSGKPGDDGAQLRIRGWGTLNNSDPLVIIDGVEGVFSQINPSDIESITVLKDAASAAIYGSKAANGVVLVTTKMGKNNEKTHVELNSYVGVQQLGRRFDLVTNSAELMTMANQALANGGESPLYPESLISDFKNGTDPYKYPNTDWYEHVYRNALITGHNLSIRGGSEKLSSFLSLNYLKQEGIITNTDAERFGMRANLEYKVNSWLKVGARLNYIRRNSQEPFDLSRVFFIQSGAAPFIAPYTRDGRFGSVEAIAQDGTLLYDNRNPLIDASNGATKTTLDYMSLNAFATVDFTKDLNLQVTWASNGNWKMVDKYNETLYGYTDSGIETMTINYNRDGLEMSREQISTMRNNFHATLNYSKKFVEKHSVAGILGAQLENYNIKNVYARRTDPAKDGLTQVDAGTNGIQGKGNMQGLRMASYFGRLNYAFADKYLFEMNLRADASSRFKRGNRWGVFPGFSAGWRLSEESFIKNVNIFSNMKLRASWGQLGNQTIEGYWPYLTVINQNYNLSYNYGGSLAPGAAVTALVDEDITWETTSSLDIGLDLGFLNNKLSIEADYFNKKTTDIIVQLPISNILGDKTAPFENVGEMKNNGFELVANYDNLEASRDRLGFNVGFNFTYINNEVTKFQGGNSPDQLYLIREGYPYKALYGYKAIGIYQSDEEAVEHMHNNGYKPAMGNLKYEDVNNDGKLDYQDKQVLGNTIPKITYGISAGLRYKGFDLSLLFQGLGKANVFTQNEMTRLGYEYMRIAGFWRDAWTPENSGSSIPMLRYDSTWDRYDSSFWVHRIDFLKLKNLQLGYAFPERITSKLKMQRLYVYANAQNLFTVMWKKGYEGYDPERNTFDAGGSPYPTPRIFTFGLNLNF

SEQ ID NO: 9833 - protein, 824 aa, Xanthomonas oryzae pv. oryzae
MPPSRRSRATKKTGGAFMPMVTTRGRLVRGTAVLALMAGAPPALAQSAPPGGSPPPQGGFIEEILVTARKREETLQDVPFSINALGQAQLRARGAETLEDVSRNVVGLTIENLGPGQSQVAVRGISAGQIVRDQPGVKEQVGVYLDESVISLSLFTPDLDLFDLNRVEVLRGPQGTLYGSGSLSGTIRYITNRPTTEQVEGTAEAGIETLKDGGTGWSARGAVNVPLAEKAAFRAVGYYTDYAGFVDAVRPDGSIDKNVNDGTRKGFRLSALVEPTEGLSVVPRVIYQKIETNGFNREDVFNILANDLTPTTDPQRLYRFDERQQFTQLEEQFEDDFLLADLTLEWELDAVTLTSITTYTDRDLLVVRDASPLTGSITGQPGSFAPGGLPRSVYSIATPLNDTTDLEVFTQEARVASNGDGPFQWVLGAFYSDIERTYAQRLDVPGFEALTGIPTAGPLAPRDVLYYSLIPYDFKQLALFGEGSYDLTDQLSVTAGVRWFDFEEERVLNFDGLFADQSIGQAGKTSSDGFSPRVIVSYAATPDLTLNAQVSKGFRLGGINDPLNAPLCSAQDLVTFGGRSSFDNETVWNYEVGAKLGFAEGRGQLNLAGFYADISNLQVTLDAGTCSSRIVFNADARTMGGEAELSFQVTEALLLAVSTSYTDSEFTETVSSVGAGGAATVVGGIKDGNRLPTVPRFQFNASANYEQEIADDLLGFVTATYQHVGSRYTQAVDQDPAAVGTVTRIPIGGQPATSFSFDPKLPAYDIVNLRLGVRRDTWEIAGYVNNLFDENARLSLDRERGFRARVGYQVIKPRTIGLNVLTRF

SEQ ID NO: 9834 - protein, 793 aa, Xanthomonas oryzae pv. oryzae
MRFSSPRYTLSLAVAAALLAPDGRTQTATPASGNQEATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLFRVDDTVERMEVLRGGSSPIFSNGQPGLTVNFIQKKGQDEPEGSVRLTGGNNALRRIDVFNSGPMGNGWYYSVGGFFRETDGVRDPQFSADKGGQFSATLSKRWDNGELSFYARHTDDNNAFYTAIPLLSRNNGNDLSSFPGLNAQTGTLLGRDFRNVDLLVGPDGQTLRRDLADGRGVNIDVFGGEWNWESGGWTVADRFNVISGSAPTYALFTGDAPQRLGDFIASYGSSGSASYTNGGGVVDANQQVLEAGWWSVDKRLNSFTNDLRLSRELFAGNTLTVGAYYAKYSSADTWYLGNTMLLTAQNNARRIDVALDDGRQATRQGFTSTAFLNLRAKYDGENIAAFVADEWELSERLRLDLGARYERQSVTGDVHDTTTVDLDGNPATLHDNATSLALATTRRIDQNDEALSWTAGLNFTLDQHNSLFARVNSGVKFPGFDNLRDGQTRVQDVDQYELGLKSGTSVYDLYLTAFYNTFKNSPFQAFLANGENFTAVGDSRARGLEVEGAIRPFGGFELAGTGVWLDAKYRNYREFTGNQVMRQPKRQFRITPSYYWMLPFGDLKVFATYSYIGERFADLANSQRLPSYDMLDIGANLHVGEHWEVTASGSNVTDMLGLTEGNVRVPGAATGGVFMGRPIAGRQYQMSVAYRW

SEQ ID NO: 9835 - protein, 876 aa, Xanthomonas oryzae pv. oryzae
MRSSPVWIPTLVLCVLSATGELPVTPPVPLDAPGPVLPTEVPPPEVPATVLLRLTIDRMGEVSQVEVRQSAGVAFDRAAMSAALRWRFQPARRGEEAIDVRVDVPVTFVPPVHGHHIEPVASGHDGADAPPGVAAAHGSGDARAPGGASSGTESPQAASAGTSRGASGTEHSALLGPVAQQPPFFSTTVRGASQAPPPVAVGDFHIPVGQLADVPRRSASDLMLLAPGVMLANHGGEGHAESIYIRGFDAGEGKDVELRLNGVPLNEVSHAHGHGYADTYFIIPELVESLRVTEGPYDPSQGDFGVAGTVEYQLGLARRGLTASLSTGSYAARRLSLLWGPPEASEATFVGLLLRQGHGFGPNRSYANAGIMAQVELRVGDESRLRLFGTSYGSRFASPGVVRETDVVDSRMPCAPDSDSQFFCSYDPNQGGAGQRHILSAELQSRLKRGGRFVQQGYVILRQTRIRDNFTGFLLDTTPPDGERQRGDNTEGYYRGSTMGLRGRYTPGLTLLGQPQPLELGYVARYDDVRTRSRRLRDSGGVPYATVFDNQVRTTNLGAYASLRAAPVSWLTLRGGVRLDTFLFGVDDHNRPTEDRDGPRLPDESLEAYGFFASPRASAEIRLTPRLTWLTSAGLGARSSDAAALSDAELAPYARVASGETGLGWRLDGPLALEARGAFFATRVSQDFVFDETVGRNQPVGASQRLGAFVSARGTLRDQVDIQASLAWARATLPVSGASAWKLWDGTVMPYIPELLGRVDASLRGTTLVAGQQVDWNVALGHSAIGPRPLPLDRYSAPIFLFDVGTRARWKAVEVGLSVENLLDTRWRESEFNYVSNFRGPDAPPSLMATRHFTAGAPRTFMGTLTLHLDLQEDSP

SEQ ID NO: 9836 - protein, 1214 aa, Xanthomonas oryzae pv. oryzae
MNFKNRRKILSFIYRYSLRSFFLLILFNVNKSLANNCQNIGEIGTSGSCNGKLIVSRQNLLDAISDGSYAVIGPGNVSYTFAEGGTGDIYTGNINDFSSLFKGKKTFNQDIGYWDTSSATNMSEMFSNARRFNQDISNWDVSNVTKMNRMFLNARYFNQDINGWDVSNVEQINLMFRNAHRFNQSLNSWDVGNVTQMAHIFRSAKAFNGNISAWNTSKVKNFIAVFDGAKSFNQDISNWDVSSGTRMNHFLRNNAVFNKDLSSWDVRKFRSEPSHFAPNLLTAGGVKPCWGLNGCASADLIPVLSSYSPNNFDVSHGSNLDLELNFNMAVELVSKKSNVILHKMSGSNLKKVATYNLLKSDKVSFSDDKTKITINIGPKITDNTKYVVQIRPGSIKSSSSGAYFQGIQPEYQKSGSIWFSTGSNDQVLDIIGTTPSSGSNSLETENPQIIIRFSEDIALGTGNVTLKKYSDDSTVRAFNVANSTDQEDLQINDTDLTIKLVDTNGDTLVVGSTKYYLQVDATAIDNAGSSKSFAGISNKDAYSYTTISASNCGAITGQAKYWKGKGAASSSVKIYRDNSLVDTKTTDDLGFYYFYPTQTGTYHVEFVKPTSNSNADKLTRAALSIPQGQVNSDDIVPVNSGRWVRNIEITTACEFHTEIDGLLIDPAGVIYDATTRQPVSGATVRLLYNGELVNNDWLDDSGGKNSQITSSDGQYSFTLKADSAADGTYTIEVLPPTAYKFQSSQIPVEGDTYSPQLGGSVEEIQDQEEAPASDQDTTYYLSFSFVFTNEAATTSNGVINNHIPIDPAVDPTTKADVNGLVEAWTNAAIRFNKSSVKAVDKRFDWLRSNQNSEKKSHQGINISFDNQLLEKALNGSSKRFKDLNYRDIESWARSNWSNERLKKESDQVFNDLIDNSVDLAFAELREKTFKPNLNPTGGELIGNWSVWTNGKILFGNKGISSKSSEQDINSLFLTLGIDKPYKENGLFGVAFNYGKDDISVGNAGSGIDSTNLGFNFYSSNLLKDKFPIESQIGFGKMDMNTKRIDNSTSHIGDRDVYMIFGSAKILAEPFKIKNFQLTPYGRLDLAHINLKAFSESGSSLALSFKDQTVNRKMVSLGVNVDRDFIFENWRLKPFLGISYGYDFTGDSIVDMNYVGDSQNYRIILDEFSSNNWNTNIGFEFFRDNDWSGSISYEYEKAGSSSHINSYQFNISWFF

SEQ ID NO: 9837 - protein, 930 aa, Xanthomonas oryzae pv. oryzae
MAAGPGARQWGLLRPLLYLALLAAVLPVASAGEAAGTRDYHIGAGPLPSALQQWARQSGIALLFDARELSGLHSDGANGQADPATALKQLVAGMPVNVLRTPSGGFVIRRIRVAPAPAAATSPATPVAGPRTAPERPPQVELAPIHVTGSRLPRTSVQTTLPVTTIDRADILRSGYGSLFDLLRHLPGMNGLPAMSSARSGDSQYLPVGAAATTSFDGMGPRATLFLVNGRRLPRYPMVSLEQGGLTDLGGIPLSFVDRIELVRGGASAIYGADAMSGVVNIILRDQADGPEAMLQTGLSSRGDAGQYRVQMATGGLREGGDRWFAGLDLHRVEHVAGDRRDWHAETSLYPIGAIFGNWYLPARRCEPPLKRREDGCWFDSARPRSLQPASDTASAYLHYRHERGEGRYAYVEARANHNRQRFDLGPTAIAVVSRGITFNSVLHEAGNVRPSVRATDADITFGLGRDQGRRSWEAGISSQRSDVTLSTAGTVRATRLLEATQARRFTPGFDAPPAAEVETLFPSIRNRGRTEQWQGWWGMQRELMPLPGGPAQLATGIDLRHERWTSRPDALLSQGDLALGLPQQQRRLSRQSSGVYAELGLPLAPTLRADLAARWDRDGGFMAFSPRAGLRWSPTPQWSFLLASGRGYRAPSLFEQRRPPGYFGSITLPASSALPECAMTISDGRCSVTAEVVENDALKAERSRSHSLAASWTPNDTFSVSLTHNIVELRNEILALQPSDAVWNRSTWQLDEDGHLSSLRLSFDNIGRTTSRNWVLRSEYRIDAGSNGQWLFSVDALKQQELRRRRDHEPAVDLRGHVTPEIAAVLNVQWQNSNWDIALRGNQTGRTRAWLPGAECPQEQIELSHCMNPRQLRWNLHLARRLGPRLVAALDVHNVLDTQPVNYLVGNGGQMPGLDDPLGRYYLLTLQFR

SEQ ID NO: 9838 - protein, 390 aa, Xanthomonas oryzae pv. oryzae
MRRCRVARLDLVGLADPAWVRRGVVPQTEHREITVKKALLAMTAAAAASAVSGVASAQSASNVTLYGIVDAGVEVISHVPGSNGAQGTATRLNSGNLSGSRWGLRGTEDLGGDLKGIFVLESGFDIDTGTSGQGNRLFGRQAYVGLQGGWGAVTLGRQQNALYDLFGAFDPMGVGPRYSLNSVDSAFNGRADNAIKYTGKFGGLTATGFYSFGRDNNGEVPGEPKVARNFGGGLSYAAGGFSVGAAYDQYQGATVTLQDRAAKRAAVGTAYAFGGAKVFAGYRWLKDDGVSSASAISTRSNVYWAGAQYRFTPAFQLTGAAYYNDTRNSDADPWMFVLSADYSLSKRTDVYLNVGYSKNKSGSALGLNGVGTVVAGENQTGATVGLRHRF

SEQ ID NO: 9839 - protein, 797 aa, Xanthomonas oryzae pv. oryzae
MSTPKILFFILFFFFSFLSFSQQNKGLTVTGQVVEKSGQTVPFATIVIEKTDLSMISDENGKFIFKNVKPGRYTIKVSAIGFSGFKKSIEVSGTGINIPVQLDNELQELENVSVLGRSAVEKINKQAYNVTAVDAKKLHNSTLDLAHALDRVSGVRFREAGGVGSRSELSINGFSGNQIKIFIDGVPMDNFGSSFQINNIPINLADRVEVYKGVVPIWLGGDALGGAVNIVTNSKPRTYLDASYSFGSFNTFKTAVNAGYTSKSGFTTEINAFQNYSDNNYWVNVETNDLETGKYYPETRVRRFHDNYHNETVIFNIGITGKKYADKLMVGFTAGQNKADIQTGARMVAVFGERYRRGNTLMPTLKYQVKDLFTKGLNVDVTGNFNFGYEQTVDTVNRRYNWFGQYTTNAGPGGEAGRSLYKFKNNNGIATFNATYALGERHSLLLNNTFNTFDRKGSDELYPESITYQQPEKLQKNILALGYKFDYNQKWSTSLFLKNYDLKTTLTRSYNPSGNWGDVAYMELNDKSSSLGYGGASSYYLKQNLQLKASYEKTYRLPTSNEIFGDPNDNLQGNNNLKPESSNNINLGLSYQTSFNDINALTFDVNGIYRNAADFIRTEFNNNQNKTVTVNQGSVRTKGIDGEIRYSYKKRFTSGINMTYQDIRNMTKYEPEQNFVSYYYKDRVPNIPYLFGNLDGTVFFNDVFKKGNNLSAGYNLLYVHAYYLYWPSRGGSNGKHDIPVQFKHDLNLVYTMADGKYNIALECQNLLDNELVDNFSLQKPSRAFYLKFRYFFNKSNK

SEQ ID NO: 9840 - protein, 662 aa, Xanthomonas oryzae pv. oryzae
MTRPQFLLQPMTAAILIATASTFANAQDDIQTKKMAPIVVTAQDTKTANGLIVEADPKQPIQPVPATDGADYLQSIMGFNAIKNGATNGDVTFRGMFGSRIKILTDGTENLGACPARMDAPTSYINPESYDRITVIKGPQTVRYANTGSAATVIFDREPENLTTDKPYRGQASVLIGSYGRLDHNVEAAMGDETKYARINANRSVSNDYQDGNGDSVHSSWERWNADLALGWKPTQDSWIELKGGKGNGEAAYAGRTMDGTQFQRESLGLHAEQKNLTDVIKKVEAQVDYSYNDHIMDNYKMRTPPMMPMAMEVTRRTLNARAAITTEWDRLNVISGVDSQRNKHAGNMYMRDANPIPPLDGDLRFESYGAFSEWTYRLNPNHKLVAGGRFDHVKVDSAENDQQRTDTNPSGFIRIESHHPHGLNTYAGIGYVERSPDYWEISRVSNNLLNYLNTEKTTQLDLGFEFEQGALTSWVSAYAGLINDFILVPYQSNPNGSVTILPARNIDATIAGAEAGVGYKFNEHFQADLSAMYAWGENTTDHKPLPQIAPLEGRLNLRYVQEKYSLGLLWRAVAEQNRISLNEGNIVGYDMSKSKGFSTFAINAAYQYSEVLGFSTGIDNLLDKTYSEHLNKSGAALFGYAANEQFNNVGRNYWARVSMKF

SEQ ID NO: 9841 - protein, 690 aa, Xanthomonas oryzae pv. oryzae
MVAAVLCYSTSSIVVAADDSLWDIPLEELGQIRVVSIASGTETPLDKAAAITSVINADDIAAMGATDLDQVLETVPGLHVNHSDQAFSPKYVFRGITSSNNAQALLLINGIPTTTMMYGNRGNAWGGMPVKAIERIEVIRGPGSALYGADAYSGVINITTKNHQSINGQTVGGRVGSFDTQGAWLESGHQFGDMGLSLVLEYQTTDGWDETIERDAQTNFDETFGTSASLAPGPVNTGVDQVDARFELSGQRWTFRAGLQDRGNLGTGPGVAQALDPEGQFSSRRVNADYSYRWSDLAEGLDVEARVSYFNITQDPENDIVLYPPGAFNGNFPEGLIGSPGYKENQFRFDLNAIYRGLENHRIHTGIGTLWADLYEVTERKNFNPDFSPKGSVVDVSDDPTEVWMPEEDRTNYYAFIQDEWQFAQNWQLVSGIRFDDYSDFGSTLNPRAALIWATTDNITTKLLYGRAFRAPSLNELYVANNPVFMGNDELDAETIDTFEIGVSHQITAQLLYGVNLFYYEIDDLINAVPMSGLIATQYRNAGQRTGHGGELELTYQVYEDLSLQANYAYQTAKDEGTGQSVGEAPNHQIYTRVDWTVSPQWLLSSQVNWVGKQKRAAGDQREPVSDYTTVDMTLRTRGLWQGLDLSLSVRNVFDEDVRDPSPFADPAPPIPNDFPMPGRTVVGELSYSF

SEQ ID NO: 9842 - protein, 696 aa, Xanthomonas oryzae pv. oryzae
MFAKSRLALLVGWVTGSVAFPLLAQDAQKTDTVVVTSQMQSAATKLETPDIETPQSVSIVTREQFEEQGATSVRQAVSYTPGVYSNQIGASNRFDYIVLRGFSDGSLDNVYLDGLKMMGDTNSHSSLVVDPWFLDNIEVVRGPASVLYGRSSPGGIVALTSRKPSFDPGGEIKLFAGNNNQRGAMFDVTGPVDDNDRVAVRLSGMTRYADSQFDPLKEERYALMPSLTWRITDNTRLELMAYLHRDPEGGSHSGLPYDGTVVPHSGKKISNTFYEGEDDYDKYDRRENMVGYNVEHMFESGWSVRQKLRYLHTKVELNQVYAAGWLNDTELNRGYSGSDEKMNAITLDNQVDGSFDTWAVNHRVLIGMDYQDRTNNVTGYYGGFPPIDAFHPVYGAKPDYITQYSREKHKLRQTGYYLQDQMSVDRWRLTLGGRYDQVSVSNVDNFNHTRSDLDKNNFSSRAALLYLFDNGVAPYVSYSTAFTPTSFADEQGNILDPMKGKQWEAGVKYEPEGMNSQFSASVFRINQKNIATKEEPTDPYRSIGEIESEGVELEAIGQLTDSLRMQAAYTYTDIRYKKSSPEEEGKRAVYAPRNMASAWLSYDVKTGPLDGLTVGSGVRYVNGITSDRQNTHTLPSYTLVDMVVGYDLSKVGLTGVSAQLNVNNLTDKSYVAACNSLSYCYFGAERSIVGSVSWTF

SEQ ID NO: 9843 - protein, 602 aa, Xanthomonas oryzae pv. oryzae
MSTAKALPALMLLPLALPAVAADEASDERKLEPIVVTATLGPLTAGESLSSVTVIDEENIREQSPSEFTQLLRGQPGINVTGNGSFGKTTSVYTRGTANDSTLLLVDGVRLRSATSGGPSWQYFPVELIERVEIVRGARSSLYGSDAVGGVVQAFTLDPEDTPAGWVEAGAGNFNTQKGSAGVAARAGNTRFSLSGLHKETDGTAVITDGDDRGFRNTAGIGRVVHELDSGGEASLVMVQSEGNTEYEGGEIDFMIRTIGFGLETPVSDYWRHSLQFSESRDETDNVTPTFNSTFNTRSRAARWDNTFTWNVHELVVGAELMTDEVSGTTDYAETSRTNTALYSQLRLNFGPTDLQLSVRGDDNEAYGKNETGGIALGHALDRSHRVRISYGTSFRAPTFNDLYFPGANPDLEAEESGTVELGASGHYQTWFWDAALFQLDVDNLIAWSPTPSGLWTPMNVNEARIRGAEFSAGFERDGWRGDAALTLLDPEDRETGNRLQRRSGKTLRLDLSKRVGTWDFGGTVVAEGYRYDDRANDDRLPGFATLDFRAGWRFAPDWSTRLTLANVLDKEYSTARYDRQNDLDYIAAGRTAMLTVRYDIR

SEQ ID NO: 9844 - protein, 712 aa, Xanthomonas oryzae pv. oryzae
MSRLTLLAAACGLFATGATSPVLAADPAPPASTPIQRLPAVQVDAARVRGVDDFDLPASFTVVAADDDNRRGAQVSELLDGIPGLVARDRQNYAQDTQLSIRGFGARSTFGVRGVRLLVDGIPASMPDGQGQLSHFNVLGAQRVEVLRGPFSALYGNSSGGVLQLWSADGQPDDPWRLRATYGSNATVNVGAQLLGQQGAVHYNVAANRFDTDGFRAHSRARRDSVNAKLGFDLAEGRRLDLVLNYLDAPDAQDPLGLTRAQFTADPAQATSVATQFDTRKSVRQSQAGAIFTQQLDNQTLRLMAYGGQRSVEQFLAIPVAVQRNPLHSGGVIDLDSNYEGADARWAWQSEALGRPLQLTVGTNVDRQRQHRTGYENFVGDTLGIKGALRRNQRDEVQNVDQFAQLWWQWSERWSALLGVRHSDVRFESDDHYIVGRNPDDSGKRAYSATTPVAGIVFRADEDLRFYASVGRGFETPTFNELGYRSDGGAGLALDLGAATSRNYEVGSKWRAQSGAALEFAVFHADTDDELAVASNTNGRSTYRNIGATRRQGAELSWQQPIGAAQQLQLAYTFVDATVRDGYLTCASSGCATPTALVASGSRLPGVPRQQLFARWQWQPAQWQLAAESVASGATVVNDLATERAPGYALVNLEASRRWTTTQGALRAFARIDNVLDRQYVGSVIVNDGNGRYYEPGPDRTYTVGLQWDFGG

SEQ ID NO: 9845 - protein, 899 aa, Xanthomonas oryzae pv. oryzae
MTTYRSSFARTPLAAAITRYRFVPLWLLALGAPQVGAQEITDEFEQSQAATVVPSVTELQRIEVTGSAIRRADAETAVPITILRAEELQKQGVTTTQELVNRIVGSQTTTTAAQSIGSGTGGASFADMRGIGANKTLVLLNGRRLANNAIDGAAVDLNTIPFAAIDRVEILRDGASALYGTDAIGGVINFITKKSVTEGQFSAGYTYPTESGGAQGRNYSGSWGFGDLQEDRFNVFGVVNYDKQDNLTASDRDFTNDFRPSRGLNGTSGTAYPGNYTQGANATNPLADTGCNGANLIASNGLCRFSTREYIDLIPETEKTSVFTMGTLKLADDHNVSLDYFWARNNNTTTIGPSLLTGLSVGPDTPFYPGNGSTPLPTSFDLITTDPVTVGWRESDAGARIQKDQNTGQRLQLVFDGNLAGAWDYNVGASYNENKVVSSLRGGYLNDELAADAIENGIINPFGPQTQAGQELINSIGVNGDYMTAVGRVKTIDGRVSREIGDWFGAGPAAIALGGEYREEDFHAAYDTGITSLVGSLGVSGDPTVSGDRNVQGQYAELNVPVFDSLELSAAIRHDKYSDVGSTTNPKYSFRYQPFRELVIRGAYSEGFRAPSLYELYDPTYITYSAGSYNDPVLCAGGSPSNGGVANRDCDQQVLNQTGGNTDLTPETARNKTLGFVYQPLSNLSVGVDLWWIDISGQIAEFSETSIFANPELYADRIVRAADGSIDYIITGLSNQGKVKTSGIDLSLDYLFPNSPYGQFGLSMQGTYVTRYDYQDEAGGAYIENVGDFQGNGVIFRWKHNLVGTWNAGPYRASLTNRYMSGYNDYDTEGNARVSSYMMWDLAAGYNWRQTLDLDVGVKNLFDRDPPFTNQAVTFQSGYDPRYTDPLGRTLYTRVTYRF

SEQ ID NO: 9846 - protein, 348 aa, Xanthomonas oryzae pv. oryzae
MTISIRSIPLSAVALSALLACGAARAQSSVTLYGVMETGLRYSTNNDADGHGKAEMAGGYYSGSRFGIRGSEDLGNGLKAVFHLVSGFAPDTGVGSTNDMGLGGYKPTTPATSRLFGRQAYVGLEGGFGSLTFGRQENLVFNTAGQYDALSIGNLGATAWHVTATGVRIDNSVKYVGDFNGWHPGVMVGMGEQAGAFSAGNYSALSLNYASGPFAFGGAWEQQKDLQSVGTRTWTTGGSVQVGPAKLMLGYINYRDGTPTKNDLILGGVKYDFSGQYNLVVGGMATRQRDPDGLRYTAYAIMNYVVSKRTWLYVGMDYTHQKDAGTVLAAALPKASQTGVMIGMRHGF

SEQ ID NO: 9847 - protein, 1036 aa, Xanthomonas oryzae pv. oryzae
MIEMNCMPFARNCSTLSAGIAIALFASAASSAAVAQQADGTPAPAGQAALQATDLDAVTVTGYRYAIEKSLEHKRNANAVVDVITAEDVGKFPDKNVADALQRVPGVVISRDGGEGKNVSVRGLSSELVLTELNGNYIATAESNGDPTRSFNYTLLPSNLLGSAELYKTPEARIDEGGIGGTVILQTRRPLELEPHSGFVSAEGTWSDTSKKTDGQFSGSYAWHDQDNRFGVFVGYTQHKRTARTLNASTESWQWYGRDDVGPAVDVNGNRSDFNANWWGGTGFWDQNGNYATGFMMPTAVSLGVKREERARKGGQLTLQFKPTDDLTLTANYVRFDLSQNSQTNTIKIPEWNIARYDGDGNWRGGRLLDRLQFDPSGTIVTGAAYSLRPGKTYYCSEAQAAAAGLPPGGWGSDDCTVPTPQITGSYNIEKSQSQTVDLGGEWRGEQVDVAFKAGRTWAKGGPELQFSLPIKPRRQNADGSWSNGNLASAWDLTGTPTMTFSPELMQNLRDGILQVDLGSTGSSWTRNTNQQQYAQIDTTWHMDGGFFDSLQFGIKRRDGGIHRNTGNNYWVCPGTDPSDYDNRYWNGRCNAIATQFSPGLLFAQDNLAGGVNASAFPAINFPGYIGYLNQTYGAMQTRSEDNFVYNVDEKIYSTYLQLNFHTERLRGNVGVRVARTGQRADSTDKVTAYNDYFFDGADGNPLACQQSAATPSGAPADTYCGTEGYWRVSDSVQRTESFVVSGLDRDYTDVLPSFNLAYDLTENLLLRAAAAKVIARPSYNDIAAPGSLEFYSPEYVVDRRLTGGASEQGWYGSGSNKTLEPYKATQFDLGLEWYFHPGSVAGVGLFRKNVENFAVDVISDVNMMIDGQQVTVQNYSSQAGGQDAVSQGVELYAQHTLPFGLGVQFNYTYNDASKAAVRLEDGTEAGKTSMPGSARNQTNLTVFYETDRLLLRASYNRRGELVQGLVKGLNVYEEPYYQVDLNAAYNITPALSLTASVLNLTKQESRSHLGDDTRARFYTGGYAGRLAYLGLTYKF

SEQ ID NO: 9848 - protein, 715 aa, Xanthomonas oryzae pv. oryzae
MSKLPFTLSVLALSIATAHAETDTQNEGVQEMETVVVTATRYTQTPDKIAGAVTVIDSEDIKQQSIVSDDLTSILATLVPGMTPSRQKMSNQGENLRGRQALIMIDGVPQVNPLRNGNRYGYTIDPSMVERIEVVNGASAVQGMGATGGIINYITKGAKPGDDWKQTIGTRVTSSLDNDGTGGKVFYNISKYDDEFDLFFGGSWDQQGLYYDGNGNPIGMNDIQGETQDSDATDIFFKGGFNFDEGNQRVELTANTYTIEANGNYKGVKGDFANGIPGTVEPGSPSGQPVSNEAQLFNLQYTNYNLGNGMLTAQMFYQDYDAVFGQATWNPTETKAEDQGAISSQKTGFKVGYETYDLLDLDDTWVFGLDGLHDQTEQTLDQSGLNVTPLMEYYSLAPFVQGDFLVTDALRLSTGVRYESVRVKVSDGQTLYGYGIDGHNSEIIGGTQDSSKAVFNVGAIYTFTDEFSTFASFNQGFGLPDIGRVLRGVWINEENTPPQQVGTPIDFNTMLAVEPVVTDNYELGLTYRGDKLFASASTYMSVAKYGANLELNNNGTYDVKRQRTEVMGYELTSTYQVLDSTKLSAMYAHVEGEVDTTGDGSVDSDMDLKNLSPDRLMLAVSHNFSDVLASRIQYNYLFDAKKSAYKVADEQNFDGYGLVDFSTHYDMRDKGRIAFGIENVMDEQYINYFSQIRNHNSYYFSGRGRTFSLSYEFDF

SEQ ID NO: 9849 - protein, 3497 aa, Xanthomonas oryzae pv. oryzae
MSLALASVSVAAIIAPAAWAVDVGDTVTNPITGATETVEAILGDNVVMTDAFNVIIVNAAVGDTIVDPTATSDTEGSAATYTVTAVNVDPFANIVSYTAEDGDGNSFTFSSVTSRSGDITTASSGVAGSPGSPAGTVNPAIPAGNTNVFSDRQIGASGSDGDNAWGARICIIKCFTIGENGDPGENGDPGPDVIHTLTTSGFGDIEAITDFLPGISAVSIGGNGGDGGNAAGFGFDGYEGGASGAGGIVSLTSYVDVSTSGEQGHGIFALSRAGRGGDGGSGFIWSDGGSSGPAAEGGTVVVVNHGAISTIGLSANGILAQSMGGASGDAGSSFGIVGSADSGSTGGNGSSVAVRNYGSIITTGNYSDGIVAQSIGGSGGDAGASGGLVAFGGGGGGAGNGGLVYVTNAATGTITTRGDDAVGITAQSIGGGGGRSGASAGIAALGAGSGPGGDAGTVTVYNDGAISTGTATTGDRSHGIMAQSIGGGGGSGRGTGGLVALGGQGGAGGAAGIVHVDNDGLITTSGEGALGILVQSIGGGGGNGSSTVGLAAIGGDGDAGGSAETVTVTGDGTISTTGIDAHGVLAQAIGGGGGNGGTSGGIVGIGGDGDVGGNGGAVDITMGSILTEGDRAFGILAQSIGGGGGNGGAGGGIGAIGGDGSGGGTGNTVTVTTSGLIQTQGIGATGIVAQSIGGGGGNGGGAGGVVSVGGQGGTGNSADTVTVNANGNILTTNENSNGIVAQSIGGGGGNGGSAVSGGLFASVAVGGDGAVGGGGGIVRVNSADGAFIETRGHGSTGIVGQSVGGGGGNGGYSVAGSIGAFGSVSVAVGGNAGAGGMGGIVEMDLDGSILTFGDNAHAVLAQSVGGGGGNGGQSFAGAVSAGVGASASVSVAVGGDGGAGGDSDSVTVRTADTIQTSGNNSFGVLAQSVGGGGGNGGWTGTANLAVSSGAAVSLGVSLGGSGGTGGFGGTVLIDATGNVITSGSNAHGLVAQSIGGGGGNGGFSFSGSFSGGGVAGVGVDVALGGNGGSGSYSGQVTLNSDGIIATSGDNSHGLFAQSIGGGGGNGGWSATGTMSLGATAGVGVGVSLGGDGGGGGIVNGDVVVTSDGTVFTFGNVSHGILAQSIGGGGGNGGFAFSGSLAAGGTAGGAVNVALGGAAGDGAHAGDVRVSSTAIVETTGTGSHGIAAQSIGGGGGNGGWSATGNVAAGGTAGVGVGVSIGGGGGAGSFARTVTVTQTDHIITRGDEAHGVLAQSIGGGGGNGGFSVAAGAAGGMSVGGAVNVSLGGTGGVGGAASTVNVTVEDVETSGDGAIGVLAQSIGGGGGNGGFAVAASLVGGGSVGGAVNVGVGGSGGSGGSAGNVTVNAEQIATHGDGAHGISAQSLGGGGGNGGFSVTGGLSFGSQAAAVGVSLGGGGGTGNTAGTVTVNANDQITTDGDDANGILAQSIGGGGGNGGAAISGTITAGSSNAAGINVAIGGDGGSGGTGGAVNVNTVETIYTYGNQSNGIFAQSVGGGGGNGGMSITGGISLASSNSAAIGVSLGGTGGVGNSAGDVTIDSRGQVGTEGDQSNGIFAQSVGGGGGNGGFSGAFGATGGGSSAAINVALGGDGGSGGVAGAVDVTVSGNVQTLGDQSSAVHAQSVGGGGGNGGASFAASMALGDRAGGVAVALGGSGDSGGNASTADVLNSAVLASFGDNSHGILAQSVGGGGGNGGWAATLAGGFGNSTAGLGVSLGGSGGVGGTGNRVEVTNNGQITTAGDNSIGILAQSVGGGGGNGGFAVSGALTAGDRSVSIGVSLGGSGGTGGTAGTVDVSNAASIGTAGDMSSAIMAQSVGGGGGNGGWTGSMSGTVGNNRAMGISFGLGGSGGTGGAAGDVIVDTTGTLLITEGNRAHGVFAQSVGGGGGNGGMALTATFGASDSVNVAASIGGTGGEGGTAGIVNVTSSSIIQTAGYRAHGIYAESIGGGGGTGGSSGSLAAGGSDSVNLSFAVGGTGGTGNTGNTVTVNNFGLITASGEASHAIFAQSVGGGGGDGGFAGLDSSAFGTHIIGDQCLPEAEAPCEPAGAGGAGAAGIGSNTFNLATSVGGFGGTGGHGGDVFVTNTGTLVTVNKDAHVIFAQSVGGGGGNGGPSMSATGAAGASQSASIAITVGGSGGAAGDGGDVSVTNEGTVISWVRGSIGVFAQSIGGGGGNGGSATGFAITRDAAGIDDSDKNLELVAVVGGFGGAAGDGGGVTVLNEGDITTLGAGSDGIKAQSVGGGGGNGGGTSLDGEELDALLSSSDSDSLSFTLGGFGGASGDGGDVRVTNNGNITTWGDGARGIFAQSVGGGGGEVGKGGATATGTIAVGGFGGAAGDGGDVTVINTGSIQTSGTRFYSADDDPNYGEDGDLSYGIFAQSIGGGGGNGGAGNMDSARDTRNALIENNGNLQDTFQPDISIGMGGFGGASGDGGDVVVINTGRITTTGDNAHAILAQSIGGGGGNAGDGYISNAGAVSFGGAGGNAGDGGDVTVTHSGDITTHGIGAYGIFAQSIGGGGGNAGDTTIGVQEAGVDLAINPFGGNSGDGGDVTINSSGTINLLGGGAIGIFAQSIGGGGGTFGSADGQGFFGSVGGEGEAGRVTVNHTGAIISTGRNAIAFFAQSLGTTFAPAEPIALIASAQAAAQSSADIVGPVSDVADTSSEMPSFADRFGPAGLAEFVDPASQSDEVDVMSALAAAAITVTLDNDIRGGSDRGIGVFFDGGADNTLFTSGSVSAVSGNAIVTTTGNDLIENTGLVVGNVDLGSGVNRFDNQAGATFIAFDTIDLRDGSASPQTVLRQGNVIPVVETARASASQAASAPQASEAATPAALAASDLASASQPEPVAIGEMDISSKQPVQAELATASQPGPVSMGQMDSSTKRPVQADLATGSDPAPATLSPANTGSMEAVETKGAPVQAVLPTSFPSTSAQGVSVDVKPTVQVMADLDPADAAAQLAGESTTVVSAAGPVGAATFRNAGHFVMGLSASAYPIDLLNGATFGNFDAIGDPTTNLLYGARVINTVELDGHFEQTASGHLVFDVAYGPYASDRVNVTGGAVVDGTGDVTLTWLQDREAVTLFAAAEGGVDNGLIIRDTLAVDYSIAADAAGIHLLIDTDFGLPSLNRNGRALGGHMDSALEVGGSAGIGRLLALLGNMQADQLDLYEEIFAQLNPEPHLAVMHGQLNSADNFAEDLFNCGSPIGRRDDQCAWSRLEMTASARDASVENLHTESESMRFTGGFEQRVGDDWSVAAGVSYEQTDPIRIDGHRARTESSGFVVGLGAERNPAAGPYYGASVSGGWSWHETERAVEVFTSGVGTSSPETGHARLDAHVGESFRHGNIFARPQVSASVTALHHDGLIEEGLDGLGVEVLSETALVGAVTPQLTVGHVFRETEDMVGVVSITGGLQLSTRDRLELPVRFLGANPLADPAVIGTTLDHLVYQLGVDLEIAGNERVGLSIGYQAEFGEETERQRAGIDVRVRF

SEQ ID NO: 9850 - protein, 425 aa, Xanthomonas oryzae pv. oryzae
MTALAPRRARPRLLCLSLTLALTPLAHAQDAADAFKLKLGYTGEAASMIDGGRKSGDAYAGQLMVGTDVDMDRLFGWNGATVKLYVSNRHGTNLANSSIGNSTSVQEIYGGQGTRLPNFTLLQKLFNDRLELEAGRSVANIHFLGSDLCQYFQGNSACGNPTFVFRTSNFTYWPVSSWAAHATAWVTPKVYLHVGAYEVNPIQAQDGQHGLNWSTNDTTGVVVPYAVGYKNKGGDGSMAAMYELGGWQDNSDYTDPLRDRNGNPAVLSGLGYENKQGRSGMFARFEQQVTNPDPSGTRGLTVFGAMLKSTGGQAIEDHFIQLGLVQKGTFASRPQDNIAFVITQQKYSDEAIENLRLARASAGGTGTPADNQIMMELSYGIQVTKRLRIAPNLHYVINPDQFNEPTRTNDLKNALIAGMRIDWNL

SEQ ID NO: 9851 - protein, 610 aa, Xanthomonas oryzae pv. oryzae
MTIGSKTKLALGIALAMPAAAWAYTFYALGDSLTDNGRVVRLTGILPNATSTIFRGGRSSNGPVWAEYLPGLIGARFAPDDDYAINGALSGHGGYLNIIPTRPTWRTLPGFVDQVEQLIAAHPRLRRDDLVGVWIGTNDQDLTKASLNGIEPFLGVPRPANIAEMSAYTLTNLNAQLQRLIGAGARQFVILNLNDAGGTRPGYVDYNGKLPEDLARFSRQGVNVHLFDVSALLNQMRRNPSAYGLNDTPDVQCRYVPSCSGGSVELQNTYLTADGTHMMTSVHEYIARYLANQLNAPAAISTAPVLGLDVARAGALSALNAADGGPLGPARVAWSDRLSLFADVGYTRNFHGAAGGMNAFDSDVEMFSIGADYKLSEASRAGALLSSGNANGSLAGGQGRIGLHAYRLGVYHAFERAGLFVRAYAGAGWSRYRLDRAAVLPGAVRASTSGFDFGALVKAGYLFALGGVRLGPVADVGYTQLVARGYTEDGDPILAQNVGVQRLKGVSAGAGVRFAAPLAAIGRRAGELSAEAQLRHDAFGDRTLVTAQRYAPGLPIGTAVDGASATYERLSVALTVNPAKRWRGKLVVQTDLGTAQRRSYTLLALLGGTF

SEQ ID NO: 9852 - protein, 843 aa, Xanthomonas oryzae pv. oryzae
MAIAGFATQTVAQDSSSSGMEVFETFTAVGQGESRANNSLNLEALEIAMPGALPEKMVDKIPGVNVVTRDPFGFYEFGNDIRVRAFNISNLGVTLDGVPVGTSDPRYGSPIGRLVDSQNLTAIKVSQGAGDVTTPAYQALGGSLQYFTKDPSSEKGAYASVAYGSFDHISLFGKYELGEIFPGFTGYVSGSHFEFTPRGLEGLGKGMARRYEAKFKYELPSDKIDITYAVTYNDRDDFDTAGLSYDEWVDAEAGNYRGTGQGYVEFTPWDYPGIGNFNYGDLSDQGRNLGPVKYLDSTVGAGEGVNAIYYDKWKNGRMDTLQRFKFDFDFDDGKTMEVVTYYQDKDNYGLWGRDRAYAQNQVRAAYMNDPSRTDIWGQLWYDADDNAISETGEIVEAYSSEHAIVAPGTPTYSAGVEFVAGIPGRTARDENFGGHRYGLTASYTWETENNKLILGGWYEFDHHGTERPNFNLDGGSILGAYRYDQFNFTNYTRYIDQDVMQFWVQDTYTAMDGKLDIIAGAKAITLDRDANGFLSIGEWLKNEETFRSTSYEDYFLPQFGLLYALGDSTELFFNYSENMATPNSGTITTAGDTFNPDILKPEYSENFDVGVRGNLAGGSYTLQAYHVSYTDRILASAVPIDSANAGAAGNSVYQNVGGVDSWGVEASGDWMTAIEGLKFSGSVAIQETTFQEDLLDSVVFIEEGDPIPTADPGYRVAATSDPLAYEIYEDISGNDLGNTPFLTANFDAIYTKGDFRFNFGGKYYDEVYVNTLNTQPLGSYTVFDGGISYSGRSDTALEGWKVSLNVSNLFDQYFWYARSYNDEDGQVLADRGRNFVLRMETEF

SEQ ID NO: 9853 - protein, 973 aa, Burkholderia phytofirmans
MKTSIRKFLISTTLAPCFASTAFTVEVIMPSENFDGSSGKIFPYTTLSDPRGTLCIFSGDLYIANLDNAISRTSSSCFSNRAGALQILGKGGVFSFLNIRSSADGAAISSVITQNPELCPLSFSGFSQMIFDNCESLTSDTSASNVIPHASAIYATTPMLFTNNDSILFQYNRSAGFGAAIRGTSITIENTKKSLLFNGNGSISNGGALTGSAAINLINNSAPVIFSTNATGIYGGAIYLTGGSMLTSGNLSGVLFVNNSSRSGGAIYANGNVTFSNNSDLTFQNNTASPQNSLPAPTPPPTPPAVTPLLGYGGAIFCTPPATPPPTGVSLTISGENSVTFLENIASEQGGALYGKKISIDSNKSTIFLGNTAGKGGAIAIPESGELSLSANQGDILFNKNLSITSGTPTRNSIHFGKDAKFATLGATQGYTLYFYDPITSDDLSAASAAATVVVNPKASADGAYSGTIVFSGETLTATEAATPANATSTLNQKLELEGGTLALRNGATLNVHNFTQDEKSVVIMDAGTTLATTNGANNTDGAITLNKLVINLDSLDGTKAAVVNVQSTNGALTISGTLGLVKNSQDCCDNHGMFNKDLQQVPILELKATSNTVTTTDFSLGTNGYQQSPYGYQGTWEFTIDTTTHTVTGNWKKTGYLPHPERLAPLIPNSLWANVIDLRAVSQASAADGEDVPGKQLSITGITNFFHANHTGDARSYRHMGGGYLINTYTRITPDAALSLGFGQLFTKSKDYLVGHGHSNVYFATVYSNITKSLFGSSRFFSGGTSRVTYSRSNEKVKTSYTKLPKGRCSWSNNCWLGELEGNLPITLSSRILNLKQIIPFVKAEVAYATHGGIQENTPEGRIFGHGHLLNVAVPVGVRFGKNSHNRPDFYTIIVAYAPDVYRHNPDCDTTLPINGATWTSIGNNLTRSTLLVQASSHTSVNDVLEIFGHCGCDIRRTSRQYTLDIGSKLRF

SEQ ID NO: 9854 - protein, 633 aa, Burkholderia phytofirmans
MKNVFIAMSVLCIMMCANRTLADQVNDDQEVFETEKMVVTATMTEKIMKDAPGAIEVISAQEILEMNAQTVSEAIEEATGLLVTTETGRQKRPSIRGTGDKHTLVLIDGRRVVAGFKDLLSINQLPVDLIDHIEVVRGPASALYGSDAIGGVVNIITRRPTRRLALGATAQYGQNGYHEGEKTRGRAYVGKATERFGVFLAGGYQKQNAFDRDGVTPDDSDTIKLKSVGGRFTFSLAEGHELLAGFEAMDRELSGLRDLMNMDRLRTVEEERLNGFLQYDAKITSLSRLMLRFNHSEQENEVDTDPAIPEVSGAIGNESDAKRWLDQIEGRYSGLFYDRHLITVGTEYRVEGRKDDAGLDDDIHNLSFYGQDEYRVFDPLYLVVGCRWDEHSEFGSEWTPRVSATYHILDNLRLKASYGRGFRAPGFMELYVPTYMKQGKQICEPNADLDAETSDSYEVGIEGEYGRFQGRFMWFYTEIDDLIDAVWYMSTGSGKKKKDYYQYQNIAEATMEGVEFEGRLKLPYGFALTGNITYLDTEDKDTGKDLEGRPDYKGTLKLSYRQPLSGWAANIRFNYIGERYYSGGDEDDVFLVNTYLAKNITRQWKVFAGVDNIFNTGTTREPMFWYSGVSYDY

SEQ ID NO: 9855 - protein, 683 aa, Burkholderia phytofirmans
MTHKKYLAVCIAAASMGITSLQVVAEETVQNDKVTVVGQESKGLAQPLEVEAQVSKVGAPIEELPYSVAVIDQDFIQSTGAKNIQDALLYTSGVNAGNFGIDTRIDSAMVRGADPLKYLDGLRSHYSHYNNVRPSIFALEQVEVLKGPSSVLYGQSTVGGLVNAVSKRPKEEQQGEFWAQVGSFDRKQLAADWTGAVDDEGKVLVRFVGLARDSGTQVDYADDDELLFMPSVTWRITDKTQITAIANYQKREGAVNAMFLPQQGTLDAHPLGFIDPSRFVGEPDWDKYDREQKALTLEFEHAFNESWRLKSVARYVDANTETREIFTAAPWGATANASGDIVRRATMSDRSTEGFSIDTRVNGNFKIADTEHKLTLGIDHQDITTDEWNKYSQFTSSINLFNPVYGSLPVIDPSDITDPDAVTTKQLGVYVADHIKIGNNIISTALRHDRADTNGSVKSALSKHLGYMYQFDSGISPYVSYSESFEPNTDSDGAGGILEPTEGEQMEYGVKYLSPDSSTSVTLAYFEIEETGRVSSGSTPGGLAQSNAEIDGWELEARKNWDRFSVLFNYSDLNTKDENGPRIPYLSERQASLWSHYQFPSNWKAGFGVRYTGDTVGWGGTGPAVPGVTLLDAMVGYETGDWEFTADVKNLTNKTYVAWCRSAGTDCGYGEKLNATLNARYKF

SEQ ID NO: 9856 - protein, 377 aa, Burkholderia phytofirmans
MKKSLLALAALGAFAGAAQAQSSVTLYGVVDANIEYVSNMSSVTPSAANGLAVGPAENVFRLTSGGLSGSRWGLRGVEDLGSGLKALFVLESGFGLDDGRSQQAGRLFGRQAYVGMESDRVGRFTFGRQYTTLFDMMANFSPTGYATQYEPVVAQLGLNFRSDNTAKYTGKFGPVTAIAHWSFGNGVAGGGEVPGQFRRDTGYGAGLSWAAGPFGISAAYDQYNPTLNAAGGTGDFKKAAVAASYAFGPAKLMAGYRWGMNKAANDNNILKDNYYWVGANYQVSPALGLTLAYFYDDVKNLNLAANGATNNIKNPWQISFVADYNLSKRTDVYLTTAYAKNAGVNFDTSAISFANGYFLGTGKDNMVAVAVGVRHKF

SEQ ID NO: 9857 - protein, 211 aa, Burkholderia phytofirmans
MRSIRILSLALLTSAAFAPAAFAQDSSTTDTASGKHFAVVGGVALLQPKNDPIDGIKKVDGGPAPTVSFSYYINDNWAVELWGAADKFDHKVKGPNNARLGNVEQQPVALSGQYHFGQADNVFRPFVGVGYYQSSFSNETLADGSSSDIRLKDAKGVIGTIGVDMNINSTWFARADARYMRSRPDVKVGGEKIGEAKMDPWTVGFGIGARF

SEQ ID NO: 9858 - protein, 1009 aa, Burkholderia phytofirmans
MYRAVPRAFRPRRLAVSVLQALAVPSLLLTTASVAWAGCNSPAPTAGQTVTCDTNAPNPQATPVTANGAAGITVNVAAGAQLQQSGGGSAIALVGAGGHLLSNQGAISSVGGVTVQLGGGSRVDNTGSISTGNNTALQFVGAGDSVLVNRGAISGRTGVQFDAGNDRLEMQSGSISGGVLQGDGNDVLLLSNGTIDSVDQGGGDDQMTVTGGAVTGVVAQGSGRDDFIMSGGTIGALQQGDNIDTFRMSGGRIIGAFEDGDQAWMTAGRIGRVNMKLDKNLWDQSGGTVDGNVVTGFDTDTIIISGTAYIGGNISVSGGNDSVTITDGTVRGQVLLSTGSDTFNWSGGGIVYGAIDMGTDNDVANLSSLNQGNLGAVPLFDGGSGIDQLNFNNVKTTGVGRFQNWEAISLANSTELTFDGDLVLGDSSTGTGTLTVDDTSTVYAGSGGHAIRPFNSGALVEMVNAGRIDLTGTGAGDVFTVRGNYRGDGGGLYLRTVLGADNSTSDRLVIDGGSATGTTGIGVLNAGGSGAATLADGILVVQALNGGRTAPGAFSLFAPVAAGAYEYFLFKGGVSAGTRENWYLRSTLVAGPAPAPNGSGINGVPPPPTPPVAPPPPITPAPPPPPEGSTDPDLTAGETAPPPPPPEPAPVAPPSDPAVPDVPVAGGALPGTGTPPTPGARPAEGAVVPLYRVETAAYAVVPPLLRETSLASLGTFHERQGEQRLLYSQGAFRTAWGRLVGQSSEIHWKGDAQPGFDGDVMGLQAGLDVWAAASDNHRNQIGVFVGRTRAQGKTTGLALGWENVQVGQNRLDDKHVGLYWTFTDSSGGYIDAVAMQSRYDGRVRSSRGLGFGIKGDGTSVSVEAGKPLLHFGQSAWWLEPQVQVIWQRTSLDDRRDAVSSVRFDNDNAWTGRVGLRLAGDYQLADNGWQPYFKLNYWHGRSGEDRIRFDDDVIFNSQRSRALEAGVGVVGRFNRTISAYAVADYTRELGGDRNEKRRIIEGNIGLRADW

SEQ ID NO: 9859 - protein, 312 aa, Burkholderia phytofirmans
MKRIIVVSALACVAADAVAQSSVTLFGYIGAGVRWTDGVKGGSQIGFDNNAISGNIFGIKGAEDLGGGMQAIFMLQSGFLTGTGALAKSPGLLFSQMAYVGLSGPYGRVTFGRQLNALEDIGIALDPNSAQGQSLSTIPGVVWGGNFFTNDSRFNNTIKYVGTFGGATVRGSYSPGGVAGNQRAGSNVAVGTSYRFRTLLLGAAYQTTWNADASQWARTIMGGATWQVGPARLYLSYSDLAVSAAKAGAPERRDRIPAVGIVYQVTPFLQLSGATYYDFAQNLKNTGGADGRKLTSYAMLQYFLSKRTSLYA

SEQ ID NO: 9860 - protein, 769 aa, Burkholderia phytofirmans
MVGGRVFMKTHLIALFAASALVSPVVAFAQETPAADDQGGLEEIIVTAQKRAEGLSDVPISISAVSGKQVENYGQTNLEQISSSVPNLKITQTAIANRIAIRGIASGDNKGFEQSVAMFVDGVYYGRDQLSRLPLVDMERVEVLRGPQPTLFGKNAIAGAVNITTRGPTDTFEGSVSGLYEFNHKELQLTGVLSGPLSDGVEARVVGYHRSMDGYFYNQELDRDEPNVDEYYFRGKVELDKGGPFAAELKLEYADFEMKGQPRDVFGAVGNYNAVFQGPFFVSTDPDFVREDNGYESRNKVFGATLNVDFEIGDHTLTAVSALLDYKTREIVDVDFSGISFLDGTNLREDYRQFSQELRLTSPGGEVFDYIAGVYYQHAKLDVQDFTLFNPTFLALGAPFNALGDTSNDRDYTQKSDLISAFAQGELSVTDQLRITAGARFNHEKKSGSRSLAIVQGPLSTAPAAVVAAVFRALNIETHSISGKISEDSFNPMVNVQYDATDDLMVYASYAKGTKAGGFDIRSNSLPTSTTVARPGAFVFEDESADNFEAGLKYKGRNVAFNVSLYRTDYKDLQVNIFDGTLNFNVRNAAEARTQGVEADFRAALAPGLTVSGAVAYLDFKFTNFTEGQCFYLQVPGPNGLCDYSGKRNALSPEWSGNLNLDYTTPVTNEMKVALNINADFSSSYIAAVNLDPRTHQDGYVKLGARFALADVDDRWEVALIGRNLTNQRILQTASSMPLATTITRGAGNAYNGIVDRPRTIAVQLTGRF

SEQ ID NO: 9861 - protein, 623 aa, Burkholderia phytofirmans
MLSPIARAALLAFAGLPIVAHAQAANSSSASAVEASPAVLSPIVVTAERGPQALADAIPQTALFDQQDLADTTATDLPGLLQLAPGAQISRTGGPGSTTSLFLRGASSTQSLLLIDGVRVDSVSLGSAQLAQIPLDQVDHVEVVNGNVSALYGSGAIGGVVQVFTKQGGDHPPRFNFSLGYGSYHTQTQQAGVNGALDKDGKTTFSISLARSKDDGFSSLNPNEAPGANPNANGYLNESISASLRHKFNDQWDAGASYFQSNGNNSYDNAYGVPTDLNNLYSKVRQVSVFANGKLTDWWTTHFIVSEGDDRSVSKTNGVYNGRFDTDNRQYTWQNDFALAAQQKLQVGYEHLDQSLDSDTFAAPDRHVDSGFVGYTGRFGRNQIQANVRRDQYSDFGGANSYYLGYGFDITGHWKVSASYSDSFRAPSFDDLYYPLSGNPSIQPERSHSIEAALQYASNALGVMRLTAFQTRYSNLINYEQVTPGIYLAENVGHAKVQGLEGSWSGHVGKTDVRASLTLQNPVDLDNDVDLVRRARRFGSLTVNRSIAGWRVGGEWIVSGPRDDSSGKLGGYGVVNLSARYNITKAWYVAAQIQNLLNKDYETAYSYNSPRRGAYLTVGWQQQ

SEQ ID NO: 9862 - protein, 374 aa, Burkholderia phytofirmans
MKKALLAAALMSAGVVAHAQSSVTLYGRLDAGLEYISGLPNANYTGSTSRFRAESGDWGTSLWGMKGVEDIGGGNKVLFQLEGSFNTMNGQGPGGGGLFNRWATVGLSNSAYGTLTMGRMLFISNGVWDFDPFGQSNWSSASLVRGRNWPQSSNNIAYQSPKFYGFDVYGQYALSNATNWNGNGTTPQGREAGLQVTYTSSLFQLRGMYDEIRNNTNGNFTDPFTASREYTAAFNVFLGQFKIQGAYQAVRTSAAASAVNAAPTSLDHEWGGVTWQATPAAALIAAVYHVNANKGGGNATIYTIGGSYNLSKRTLLDIQVATVRNSKSANFGLDANNAGRGGNITASDGTVSYNENPLPGHSQTGVYAGIQHSF

SEQ ID NO: 9863 - protein, 913 aa, Burkholderia phytofirmans
MKQRALALAIRRIVWAELALSAAIAVPAFAQSQPATTGTAAGATTESAPATGAAATPSTDNNTATAAGKGVQQLKKFEVTGSLIRTSDKVGNTEVQTITPKEIQQSGYTTVADFLRGTSANSGSSWGQTTMNSSAQGGGGIALRGLSEKYTLVLVDGQRVANYGKAVNFTDTFFDVNSIPLNMIDHIDIVKTGAVSVYGSDAIAGVVNIITKKDFQGLQIDGQLGKAQHPGDAQGNFSVLGGIGDLNGDRFNVTAAASYYRDTGSSLGDRDMTANQDFSQFPGGLAGPLGPNQQSYWTTADGTNMALSPCPPGSVSANGASTCKSNPASTTSLVPAITRLNAKVRGTFKVNDDVQAYADLWVSRNETVQNEGPAVLSSQTNAFNPATGSALPLSRTVSGTNPYNPFGVPTLINYTFPNTVSADTVSTFWRAMTGVKGSFTTAKFGDWDWSADYGHSQSTVDTTYGNALNVAGVENILQNGVFNFSNPSATPNGLNGVFQNDYEQAISKLDSVTAKTSTGNLFNLPGGPVGVGFGTEFRHESNLINSRTDSALGITAPANVQTVDGERNVAAVYYQVDIPIIHNLTFTQAGRYDHYSDFGGAFSPSFALRFQPVKMLTTYASYSRGFRAPTLVENSQATYLAHQNLVDPNDPSGTPTKHFTTEQVNGNPALQPEHTKNYNIGFELSPDSSTDIGAAFYKIHIDGVIGTNDPNAVMDANNPSNVIRNPDGTVAYIKEQFVNLGSLDTDGFDMNFRKSVGTKYGTFTLAGDWAYVWHFKLNSPGAPTQDFAGNNLALLQPFGASNPRWKGNTSLSWDYRKLTTTLTWQYTGPYTNAVASEFGDGGTLSVASYSQFNLMATYRGFKNWTIYGGINNIFDRKPPFDVEWQATPDITGYDQSLYTNIGRFFQVGASYRF

SEQ ID NO: 9864 - protein, 1398 aa, Burkholderia phytofirmans
MKTKTFTRSYLASFVTIVLSLPAVASVVRNDVDYQYFRDFAENKGPFSVGSMNIDIKDNNGQLVGTMLHNLPMVDFSAMVRGGYSTLIAPQYLVSVAHNTGYKNVQFGAAGYNPDSHHYTYKIVDRNDYEKVQGGLHPDYHTPRLNKLVTEVVPAAVTNAGTSIKPYLNEERFPMFLRAGSGTQALRGKESNKTTGIAGAYEYLTGGTTLQLSKSSPDHWLDYSSNLYQVSYGPLSTYALPGDSGSGSYAYDMNEKRWVLVGVLNFYNGMDNQFNRSAIIRKDFHEKKFAEDIAGTINNTVQNAQFNWTAQGKSSSLSQSNNVQKLNVDLKDSSIANQNTSLPQENHGKTINFNGKDATIVLKQDIDQGAGALNLNANLTIRPETDQTWQGAGIIVGKDKKVNWQVKNPQGDRLSKLGEGTLYVNGRGQNLGDISVGDGIVILNQQADHQGRKQAFNTVGIVSGRPTVVLGSADQVNPDNIYFGFRGGRLDLNGNSIAFKRIQNSDKHARIVNHNRDHISTLIIQGQDPLTSNDLIWGKWASNSPADIYEYTNPYQNKRKDYFRLKGNSRVYYPTNATSNDHWEFLSSNREQAIQKILDAKNLRQRYDTFNGFIGEDASNKTNGILNVVFDTKTEVNTEQDKLKNIYTMSGGFNLNGELTLKGGTLLLSGHPTPHAYDIKNKHDVVRENDWQDSHFTAKNITVNKMAQLYIGRNVNEVNSHFTATDKAKLNLGFINRSTPSCYDSEYTGTTHCEVQAVISDNIFANLATTAIKGNVKLQNHSQLNLGKANLTGSVQADQTTHITLANHSHWLNNGTSQIGHLTMEKGSILSLNDKFATTEIPVRFNKMIIQGNLKGNGRINYTANLAKGESDHLQVDGIAEGNFVLAVRNSTTEANPKSSLNLLSLKNSNQEGNKASISLENNYVDLGTYRYVLENRNHNYHLFNPLIPNSTSKEMNATSVSSIPKKESVTNVPTLDKKETEQNLTQLQKDFSAHQLENQKAKQSMINAQSELRRLNSQLNVLQKYVNSRRLGYYTQQAVLEQISIIQNKIKQTQTIFNDANATVKLTDQKLEEAKLALGSVNDLVLIKASAPAMQATNQDTSMMNIIQADWISQYANTALSELSAQANSALQISNSLDRQLFKQSDKFNVWSSVEHQKTEHKSDLYRPYKQQTNLTQLGIQMPIDNGLMFGVALSKNHANAEFNEGVNGKSNLLMASLYGKWQSQQGTFISLDGSYGKAKNQLYLFGENHFTRRISSIGANIGHQFDLAGVQIQPTIGARYYHFSGQDYTLGGAKISSPNTHFMTYQAGLKASKTFSLDDWKVEPSITTHYVDASNKRLAVNVNNNNINQRFGRYLKTEAGIRFEHNQWQFDLHAGFINGNEIKKQHFAGVKLGYSW

SEQ ID NO: 9865 - protein, 369 aa, Burkholderia phytofirmans
MNVRPMPGCFKKKTILVLGIAMLPAWTWAQSSVTLYGTLDTGFLYTSKTRNAATGGNSGKQFGLINGGLEPSNFGLLGQEDLGGGMKVTFKLENGFSVANGGNDNSNGNFFGRQAWLALSGRYGELKAGVQYSPFVLAIYESDPRNAGQFGTAFSVYADQTFVGTFNPNAITYTSPQIAGFSARAMYAPGGVAGDIRAGQQYSVALRYAYRGLFINAAMYDSSSGNSTATLTAFQQPFFGRMIGAGYTFGPVTVKGSFTSFKVPTTIAGGAVNGGTNNIWNLGFDYYPVPQLDINSGVWYIRDPHNSDNRSIMGALTTRYFLSKATSLYWEIGAANNRGTEKTGLSIDNALYGTRGTTIGTIVGINKKF

SEQ ID NO: 9866 - protein, 334 aa, Burkholderia phytofirmans
MKKNQFLKESDVTAESVFFMKRRQVLKALGISATALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPYVDHPRWSQATERFIGSGGILDVQRQPTLLFNGYAAQVASLYRGLDLRENF

SEQ ID NO: 9867 - protein, 709 aa, Burkholderia phytofirmans
MADSPLREIVSDRTEYVDAASAFHNYSVYGTGYLHSDGAAIKRISSYGGRTELTGNTLVKDGMLSDGDARVSVKDSTILSDSTIALVVQGNSNMTLEHSVVEGKGGGITVAEDAFALISNTQVGSLQGEVGRHTGWGVGIFGARADITSRSYIKGLSHGVWFTHPRLTVGDGTQFNYGQLSIDNSTVEGLTGAAIRVEGREGISHLADIEIKNNTLLLSGNGMLLEVLNQSTANFNVDNSTLNGNLVADDTSTLNITLQNGAQLNGDIVNGNRLAITSGSHWQMQGDNAVRSLSLQGGRVSFAGEGFHTLSLNELSGAGTFGLRVDLDNGVGDLIDVNGQASGQFGLRVRNTGVEVVSADMAPLKVVHTEGGDAQFSLLGGRVDLGAYSYLLEQQGNDWFIVGKDKVISPSTQSALALYSAAPAIWMSELSTLRSRMGEVRASGRAGGWMRAYGNRLNATTSDGVDYRQKQSGLSLGADAPVEVSNGQLVVGVLGGYSTSGIDLSRGTTGKVDSYYAGAYATWLSDDGYYVDGVLKLNRFRNKADVAMSDASKAKGDYTNNGIGGWVEFGRHIKLADDYFLEPFAQLSSVVVQGQELRLDNGMKAKNDQTQSVLGKVGTSLGRSVALKDGGVLQPYVRVAIAQEFSRRNEVKANDVKFDNSLFGSRGELGAGVSVSLSERLKLHADFDYMKGRHIEQPWGANVGLRLAF

SEQ ID NO: 9868 - protein, 159 aa, Burkholderia phytofirmans
MKKTLLAVALLGASSAAMADSWIYGGATVGQSDYKGETDTSYSVHVGTGILPIIGIEAGVTQHGEFNVNGQDTKLTSYYAALKPSIDFGPLHVYAKGGIHQWDKKVKGGKDDDDFDLMYGVGAEYFIFGPMSVGASYMNYTAGKDDIGTFSVNATLHFL

SEQ ID NO: 9869 - protein, 1013 aa, Burkholderia phytofirmans
MNTHINFKKSLLTSSISMLLSSAAIMPSVAQGQIAPEDVEVIQVTGIRGSLLRAMDIKRDSSGIVDAISAEDMGKFPDSNLAESLQRITGVSIDRASGEGSQVTVRGFGAANNLITLNGRQLPTTTGSRTFDFANIASESVSGVEVYKTADASVTSGGIGATINLSTHRPFHSPGTKATFGAKLVDDKSTDKGDVTPEISGLYSQTFADETVGISISGSYQERESGMQQFLADQGYRASEYTNTGWGGVPAGAEGGINRPTSGIYSNPQQPRYVFEERQRERTNGQLVLQFRPTDNLTATLDYTLIRNDIEEQHTDASVWFNYAGDRSESVWAGAPNAVPLIYSEIYEINSEADLQDTSLTVGAWGREESIDSIGLNLDWQVSDALQLTLDHHSSEAEMRASDPRHGTRNNLQLPSYTRTRTGLDLTGELPGIATGNIENFNPNTMRLSGSWFANDFYTSEIDQTQVSGKYFLTDEASIDFGVSVNTVNNRYRHTQVQRADWGGVGEEGDFADVDWTEDTILDKFNANAGNFEGTATQGDYDLFNRIWYADFDEIVRAAEFADPVANVDTVWGDCLAPEGASAGPNGEGHFCASTDWDADTNRFTEEETTAAFVQLHYDGELGDMPYDAHLGMRFEKTDVTSTASAPGYNRVEWSEDTSTAVTGLTGIETLSQEADYSQFLPSFNFNISVTDDVIMRAAVGKTISRAGYGALQGGTTINTSGSLSGYSGTSGNPGLRPLESINYDLSAEWYYDEGSYVSLGYFRKDVTKWITTGTTNSTVFNLANPLNGEKFDAAVAALGAGASNQQIRTYIFENYADDPNVTPNFDENGELDGGIILGDPATDNTVNFRINVPVNGDTEHTIDGIEFNVQHLFGESGFGGIANYTMVDSGLKYDKSSLGDTESLVGLSDTANLVLFYDKEGLQARIAYNWRDEFLNERRVNGDLTAPVFTDTYYQIDFNLSYEIKQLKGLTVFLEGINITDEYTNEFGRDSQLIYKLTQTGARYNIGARYTF

SEQ ID NO: 9870 - protein, 429 aa, Burkholderia phytofirmans
MKHASLAMTTLSAALAASAAGTVHAAGFQLLEQNASGLGNAYAGSAAVAENASTIYYNPAGMTYLPGFNVSAGVNAIQPSFKFHDNGNSRNPGALGGGAPTGGNGGDAGDLGVVPNAYFSWQLNEKWFVGLGVGAPFGLMTEYDDNWVGQYHSTKFDIKTVNLNPSVAYKVNDQFSMGFGVNWQYIDAQYTKKVVVPVTPMGPFLPGDADLNLDGDAWGWNAGFMLQPTEDTRIGVSYRSKIKHTARGDTKIDGYAPGQSLSYDAKASVTLPDTLILSAMHRLNSRWELLADVSWTGWSSLPELKIHNDGGPTDTLPLDFRDSWRVALGANYQFAPKWKWRFGVAWDQSPVHSASDRPTSLPDTDRWWFSTGVQYQASKDTRIDVGYTYLYLRDADIDNDSGNDLTRGRVAGHYSSKGNILGIQVSTRF

SEQ ID NO: 9871 - protein, 389 aa, Burkholderia phytofirmans
MVWRRNEMKTKTRNGLLAAGACCALAAPGAHAQSSVTLYGIIDTGVEFVSHANAAGDHVVRMPGVTGELPSRWGLRGSEDLGGGYQAVFTLESGFNVRGGDLGQGGRLFGRQAFVGLKSGFGTLAFGRQYTMTYLALQGADIIGPDIYGLGSFDAYVPNGRADNAVTYLGTYRGVTLGAAYSFGRDGAGTGNSPGQGTCAGQVPGDAVQCRNWSVMLKYDSAYFGAAASYEEQRGGTAAAANFFDGVAPVPFTSSGGKDARTHVSAYAQAAGAKIGAGWIGRRVSTGSPAAAGAHSDLFFVGASYAVKPDFIVDGEGYRIVNSAHDTRATMATLRATYLLTKRTAVYAQSSYLWNSAHARYSVSGGGPGTTPGAGMGQLGAMVGMRHMF

SEQ ID NO: 9872 - protein, 387 aa, Burkholderia phytofirmans
MKKTLMVAALSGVFVTAAHAQSSVTLYGLIDAGITYTNNQRVNATQHGANVAMTSGSVNGSRWGLRGAEDLGGGLKAIFTLENGFGINDGTLKQNGRMFGRQAFVGLSSDQFGAVTLGRQYDSMVDYVGPLALTGTQYGGTQFAHPFDNDNLNNSFRINNSVKYQSANYGGLKLGALYGFSNQASGFANNRAYSFGASYNWMGLNVAAAYMQLNANGTTSAAAAFNSGGAVSGDNTFFAQRQQTWGAGANYAFGPATVGFVYSQTNLHGLVGISQGSSGVSGGIGFPSNSAQFQNFEGNARYALTPAISIAAAYTYTRANLSSSHVHWNQVDLQTAYALSKRTDVYLQGVYQAANENSIVPAFINGVGNASGNNKQVAVTAGLRHRF

SEQ ID NO: 9873 - protein, 407 aa, Burkholderia phytofirmans
MKKIVYLSLFVCTLNLSAQTNNSPNSSSFKFDDKGFNFSFDNGAYEFGINGFIQPNISVEKTKGIESINKFNVQRSFFIVSGKAVKEKVSFLVQTDFSTADPLLDAWIAYHPYKNITITGGQKQTFVNNREMTYREDKLQFTDRSLLSKTLSKTGREFGLFIETKFKLTNTFAIAPMLAVTSGDGRNSFGASSTDTDLGGVKIGGRLDIFPLGYFTEGNDVFSADLAHEKTLKFVIGGAVSKNTGVSNAIGEGHGDFLLYGANGKNNLPDYSKVNIDFLLKYKGFSLLGEYANATASGLDLVFVDANATQILVPQEISEYLVLGNSYNFQAGYVTKKGVSFDVRYETAKPEFELNPNSILTDFNSYTLGLTKYFKNNNLKLQASFTNIDYAKAENTTLGQLLFQIGF

SEQ ID NO: 9874 - protein, 763 aa, Burkholderia phytofirmans
MPFIKSRKHLITATASSRHLTAAALLSSFSFSFSFVAQAQAIPITTLDKIDVQAEQLKRYSADKPTYGKYTQPLIDTTQTINIIGKTLFNEQGATSLTEALRNSPGVGTFYVGENGTTSRGDSVYMRGFDSSSSIYVDGIRDLGSITRDVFNLEQIEVTKGPSGPDYGRTSPTGAINLITKQPFLHNANTASISYGTASQRRITSDLNLIVSPDSAFRLNIMGQDIGVPGRNNVKNKRWGLAPSAAFGLGTSTRVFVNLQYINQNNIPDGGVLTIGLPGYSTPDSTRTQISAAPRVDSKNFYGTGSDFEHVKSSMTTVRIEHDINDKTKLQNTLRWGRNEQSYLLTSYRGNVENLITPDLADPSTWTINREIPIFKNQTNTILTNQTNLNLTLKTGPIEHNIATGMELTRERMQGYGISSSGRWPAANLYHPDPDVSGLHWAANGAYANGRTDTTAFYLFDTLKLNQHWQLNSGLRWDRYNTDYAALLCDPVRSRIYCNTTPITLNRFNGNTSGTLFGWKTGILFKPTKHSSLYINYAVSQQPPGGSSLDLSAKPQDANNPKYQPQTARTAEAGVKWNSSQEGLQLTAAIYNTQVKNDIVQDPIDLQYYQNGKKRVRGVELSAVGKITNAWSISAGFTTMDAKVKQGPSVSADGSPTLAYTPNQAFTAWSTYTLPFGLTIGGGARYVGEMKRDSKTAIGTPTYIKSYWALDMVLSYRLNEHLDLRLNSYNLLNKDYVAAINKSGYRYAPGIPRAFLLTANFHF

SEQ ID NO: 9875 - protein, 703 aa, Burkholderia phytofirmans
MKLKPVSLALLSLGLPALAMAQTTNNQLEEVEVQAREQGSYSSNAVQVGTFRDTAPIDVPLTVNSVTREVLDAQSATTLFGALRNTAGVTRSQLNGSTYDNIAIRGILVENRGNYRLNGSLPIINLVDVPLENKQQVEVLKGASSLYYGFIPPSGVVNLVTKRAGNKPVLSLSQSVNEHGGATTHLDWGRKFGDNNSQGLRVNLVKGSEDIGVNNYSGERELASIAYDWKITDRLSFRFDVEHYEKSVSEQAAIRLLPAVNGRVTLPPVPDNKTNLAGEWQQYDANAQNYLARVDYVLSDSWGVLFEAGYAETTRDRAFSRFQDYDLNTGEGQLQIFYSRDQQFDNTNYRGEIYGEVVTGPITHNLSFGYTTNTRASNTPGVTGTQSLFNQNLYNPREIAPQNVTFTGAYSAVTIDDQGLYVFDRMQLNEQWQVLAGLRRGDYRTEDLRVAADGTRTVRLYNAQETTPSAAVVYKPRQDVSLYASYVEGLEESGQAPATSTNAFQLLDPAESEQVEVGAKFNVGQNSLAQIAYFDIERASTFEDPSNGVFGLNGKANYSGFEMAWTGELNKQLSLAASALLMNAELQNDGNPATVGRVPENTAEKTASLFAEYRLISVPGLSFSGGLYYTGERAVNDQNQAFIGGYTVASLGARYSTVIGSTPTQFQLVIDNPTNKNYYSTAGNDLIGVGTPRTIKAIVSVDL

SEQ ID NO: 9876 - protein, 716 aa, Burkholderia phytofirmans
MCKCIATMLNTNDNYHHYQMRFVAPQEEMMNTTRLLPSLLLAPWLAAPAHADEAFQLQTVSVSAAAGGQAYQSRQAGIAGQPRDVIDIPQAVQSVGPQVLRDQQARSLGDALRNVSGVVESNTLAGIQDSFTRRGFGSRGDGSVLRDGVRSALLNNFGPTTESVEVLKGPASLLYGIQEPGGVINVISKKPQFADEGSVSVRGGSFGGGAGFDLTGPLSDHFAYRLIGDLDESGYWRNFGNSRRKLIAPSLAWQDGADQALLAYEYQDFLTPYDRGTLFVNGAPLNIPRERRLDEAWNVARGTSQSLNLSHTRELGGAWQLTTRLGWNQLRYSDRQARPSSYNAKTGELKRRADGNAYDNSVMLFSSRLQGRLQLFGQMHEPVAGVEAERRRELRGDTYRGREVGGFNVYNPAYGGLPYPSQLSAAQSDNRSDIDSQALLLQDNWTLSERWIANLGARYQHYRQEDGAGRPYAVTARSGGSQLLPQAGLLHKLTPQLSLYGSYSESFKPNAGSDGQSFSPEKGASREVGVKLDRDGLSASLAVYHIEKSNVVVTENNVSRAVGKARSQGAEVDVSGQLTRRLSAIANVAYTDAKVTEDIAANVGKRLFNVPRRSGSLSLAYDFGADRRGHRWRAGGGARYVGARPGDSANSFELPAYSVADAFVSWQGKLGRNPLSLQLNVKNLFDKTYYTSSSGSALQVRVGEPREVALQTRLSF

SEQ ID NO: 9877 - protein, 815 aa, Burkholderia phytofirmans
MNNKSTCFKQSLLAFAIMGVISSAANAEDAKQKPQKNADDIERIVVTASKRAKGLQESPVAITVVSSKAIEQAKVMDITDLQTLVPTLRVTPLQRSTNTNFSIRGFGNGTNNTGIEPSVGVFIDGVYRSRAASQIGDLPRLQQIEVLSGPQSTLFGKNASAGVISVTTREPAYYQEGKIEVGVGNFNQKEIKGYYTNGITDNLAFSVSGGVNTRDGFTESVVGLDDINDRDRWNIRGQALYEPTEDVKLRLIADYSKIEEACCSVENSINGPTTAAVRALGGMDLDETGSFAYQSTLNSDPDNNVKDSGVSLQLDVDFDGYSFTSISALRTNDSDFMNDVDYTSLDILNEGGYTDIETITQEFRLTSTGDRQLEWMFGAFVFHEEVTTGDTLYYGNDIRNYFDVLMAAGGAPGLLAGVEGAYGLDPGTFFSGDSAVSSEFEQENDAYSIFASFDYHINDDFTAIFGVSYTNDQKEINISQQHSDVLSALDLATVPTLYGVPIGSIPQLAPAVPVIESLQFLPPMLGLPNAVENNKSDDSKTTWSLRLSYEITDNVNIFATAATGFKATSWNLSRYSSPFASDQSALETAGIALPNQVYGGRYASPEEALVYELGIKTQFEHGSFSATIFDQTIEGFQSSIFIGTGYVLANAGKQSTQGLEFDSNYNLTEDWSFTLAGTFLDPVYDSFVGASGLDGPVDLSGEKPAGIHEVSITAGIVYNFEVFNGADGYIRTDYLFESDTKLAENTPESLSREVNTFNASTGLAFDNGVSLQLWVRNLTNDEYLLSAFPPPIQAGSFNGYPNQPRTFGANISYQF

SEQ ID NO: 9878 - protein, 381 aa, Burkholderia phytofirmans
MKKSLCALAAILLAGAAHAQSSVTLYGVIDGSVEYVNRVASAAATPTQGGSRFGMPSVGGLSASRWGLRGVEELGAGNKALFVLESGFQFDTGALQSAPLFNRQSFVGLQNGDYGKVTFGRQYTSFFDGMANFAPLRFAATYEPGIWWMGLNYREDNMIKYTGQFGPLQAVGHFSFGTGVAVQNAAIVLANGGAGEVPGHFSDNTAYGGSLMYLDGSGLGFSVGADIWRPAAVTGQPGKMSKYGAAALYTTGPFKFTLGYRYNKGEFPNGNTLLRDDYWWAGVNYQATPALVLSMAYYYADAKGARTAATSPETNPANMQQVSFIADYSFSKRTDVYLSLGYAHNGGLSFDGLATAYAFKYPTMAGQTNMVGVTVGVRQVF

SEQ ID NO: 9879 - protein, 1050 aa, Burkholderia phytofirmans
MRLKLILLIVFMVPISFLSAQEIEVSGTVTTAEEGMPLPGTSVFVKGTSNGTSTDFDGNYILQNVPEDGVLVFTFVGYKETEVPVNSNTTVDVALQADAALLDEVVLTGYSRERKVDVTGAITVVETAPIEGQSRSSGNAMQALQGRVPGLFVEKSGDPTGASSRVLIRGITTLGNNDPLYVIDGVPTQRQEVFSSLNPDAIESIQVLKDASASSLYGARAGNGVIVVTTKNKSGRVEKVSVSFNSNFSVQSEKQQRYDMLNALQRGEVLWRASVNDGADPASGYGEIYNFDWNMDFDNPVLNSVTVRPFVGGDETVPAGDTNWQEETYETGYVYNNELTVSANSEKSSFLVNLGHLKNTGILKYTNYERYTAKINANTSLFEDKVRFGVNTQFSTSDETLASPDVGSAPTPGLAISLAPTIPVYDINGNFAGPIGAGYSDRNNPVLIQYLNRWDNAEKNNFFGNIYVEADLLENLTFRSSFGIDFSDFKRKDIEPRVNNGFITRSNNSLTFDTNKYTSVVFTNTLNYKLELGDHNFGVLLGVESVKNDFDRVLARAEGFAVEEESYFVLDAGTGARTSNGNSSGSRLLSQFGKVNYSFDNRYLASVTVRRDGSSRFGKNNRYGVFPAVTAGWRISNEDFLNESEIITNLKLRAGYGEVGNQSIGDLARFGLYEARYGSTLSQFTGGFFEQYYNVGTAYDINGNNTGNLPSGFVSVQAENPDLKWETTKEWNFGVDFGLFDNKLSGSFDYFTRETVDILTTPPIPSVLGEGQQRVLNGATTETKGWEFALAYTNTLENGLTFSVSTNLSSFSDEITFLPEEVRAGFSGTAENSILGQSQFSIFGYRSDGLFQSQEDVDNSPEQVGARPGGIKFQDLNGDNVIDTDDRDFIGTTLPDLEYGIRVDLGYKNWDFSVFGSGVTGRIGQDPYIFWNNFVQGRENAGLGVLDAWTPTNTDTDIPSLSLAFNDLRTSDYLYRKNSYFKIRNAQLGYSLPETLIERIGVLESFRIYLQGENLFWFTPNDYIGSDPERTDVNRIPVPTVVSLGLNVNF

SEQ ID NO: 9880 - protein, 916 aa, Burkholderia phytofirmans
MNKRIGSGMESRFVSALVLLAGSFTVGWTSAVSAEVPPPVLARASAPEPIRAQDLLREHTGRQAIDLKAVPSAWDWTQPVIEPQVGQAPPAAPTPAPAATAEEPATAQQTDEGDFLDEVAVTATRRPTRARDSTQSVNVIKREDFQAQGAVTVSDALLLIPGFNNSTPALGGQSNLSANFLRGFGDTQYVVLRDGVRLGSPFNGRSDVSALVLDDLERIEVITGGSTLRYGSGSVGGVINLITETPKGPPKLSLSYQYGSYSFNRFVGKYSGGDDTFSYNLIFTGIAAGNNYPFGFTLPTSPQFYGPNDVVTGSSCVGPLGRACGDGSLPNGTNLYGFLKPEVGPPTKVQGINDLSHVGNDNYMGKFTFKPDTDNKLTLRLNQHNLSIGDRSPGYFDYNICGFFTGPTTTSNGTYFNNDFGVAARFLPLNAQGQEVRCPVQTYLPVTPSSTLAFPFNYSRNYAGNLSVPTGTAFPQAERAQGDDSFFRQRSLSETEASLTWDWDISPSQSVNSYLAYYKQSLNFFRPNLYYYNTDVLGGQAANGPTASGVGELQVGPVFRPYIEGQRFEVQSTYNVQLSPGQILSVGANFVQDRIYVQTNTDRDDFNVLTVSYQDVATSRTSIFIVDDISFSDLLKTNFGVRYTYSDQFGQILTPAAGVRVNLANNLSLRGNYSQVFNAPSLNNLYISTGTYGQNTGIPNPNLKPETGITFDVGVDYSPLRNLFVKLTYFSTYVDNTFQRRIFLNPNFTPGSTTESIIIDQTINLGSRRGNGIEFSADWRFADQWQLRAIWTNVDARPYGNYSDDIDSFTYPNFKEYQDYNIPYNSAIGALTYANKGLTATLLARYDDGKYRFRGDNSTRVPSWFTLDLNVEIPITPLFTLTGSVFNLTDTQYEYLDANPAPGTTFRIGGRFDIGG

SEQ ID NO: 9881 - protein, 405 aa, Burkholderia phytofirmans
MKKQAWRTALTSGVAFAVAAPAFAQSSVTLYGIVDNGIGYQSSATTVGSTSGGKSLVKMNQGVWAGSRFGLKGTEDLGGGTKAIFTLESGFNSGTGAAQYTDAMFGRQAWVGLTNATYGTLTAGRQYASYYQTMAPFSPITWITGYYGAHPGDVDGLDTIYRANNTIEYTSPKWYGLTLSGSYSLGGVAGSTNAGSTWATGIQYAAGPLGVGVAFERINNSNTAGGTWGANSTTSNGGSQIGVSAVTNGYQTAKAQQRFAVGLSYRFSDAWDATATYTNTQYIPGAASKFFNTAIFNTAGAVLHWKPSAVWDFGAGYAYTRATESNGITDSAQYHQFNLSQYYSLSKRTGLYLLEAYQHAKGKTLGTNGAGNIVNATATLGDGLNTAPSSTGNQFAFGAGIIHRF

SEQ ID NO: 9882 - protein, 783 aa, Burkholderia phytofirmans
MRQMLPRALMSGCSAAAILCILSAPARADDPKQATELPEVNVTAPSPIRARKPVVPRPNAGARVARSGTRARAPAQTAQSAPPPPQQGVTPVVTDQFATVTVVPNEELRRSGAATLGDLLNSKPGITGSSFAPGASSRPIIRGLDVNRVGIVENGIGGGGASDLGEDHFVPIDPLTSDQIEVVRGPAALRYGSTSIGGVVSATNNRIPSALPTCSTAPFQTYGLPASAPVAGSAPCVTAETRTSVSSVDRGVEGGVLLDAGSGNFALHADAFGRKTGDYAIPGYPYRFDQTRPVNGRQPNSAVQNDGVSIGGSYFFTGGFIGAAIQQTDALYHIPGIDGADSRTRIDAHQTKITAKGEYRPDSAAIDAIRFWAGATDYRHNEIGLADPADPTTDGVRQTFTNREQEARVEMQMMPVNLRFATLTTAYGVQAGHQELNAPSPDNPGSVFNGLFGPNTNNRVAGYVFNELAFTPSTRAQIAGRIEHVSLNGSTPNFPVDYLPDGTPQANIARNPSYTPKSASVGVLQNLPGDLVASITAQYVERAPKAAELFSRGGHDATATFDIGNPNLGIETAKTIEAGLRKATGPFRFEATAYYTQFSNFIYRRLTGVMCDNDFASCGTTGTALNQAVYSQRNALFRGAEFQSQFDVAQLGGGIWGIENQFDVVRATFPDGTNVPRIPPMRVGGGLFWRDANWLTRINLLHAFAQNDVAAIAETPTPGYNLLKAEVSYRTKLDPNMFGAREMLVGLVGNNLLNEKIRNSVSYTKDEVLLPGIGVRIFANLKF

SEQ ID NO: 9883 - protein, 380 aa, Burkholderia phytofirmans
MKKSLIVVAAAASFASVAHAQSSVTLYGLLDAGLTYTSNVAHNSKWAAGSGGIQQSMFGLRGSEDLGGGLKAIFTLESGFNINNGKFANNNGMFNRQAFVGLSSSQFGTVTLGRQYDAAQDYLAPLTATGSWGGTYFAHPFNNDNLNTNGGLSVNNSVKYSSANYAGFTFGGTYGFSNQAGGFANNRQYSLGAAYQWQGLHLGAAYAQQNNPAANTSGASDGVLANTSGVLTGNFRQRQFGAGASYGFGPALVGVAWTQSRVDNLVGAAAGQRQGHTNNYEINGKYSVTPAMALGVAYTFTDARGYGINADGNDMKTRYHQIGLQADYSLSRRTDVYAQAVYQHAMGDGGVASIYSGDNTVPTSSSKNQTAATVGLRHRF

SEQ ID NO: 9884 - protein, 676 aa, Burkholderia phytofirmans
MNRLAKQCFMGVFALSACVCLLIQTGFAEEIAEPKTDETIVVKSTKIERKLENVTDSVTVISEYDIKSKQFTDFTEVLRFTPGVEFKQAGGPGQFSYPKMRGYGEGHFLVVIDGVKINEGLGGSVGHFLGQLDPSIVENVEILRGPQSALYGANTTAGVIAITTKGGVEGQQINFGGEYGSLDWKKAYASSRGTKDNLKYGVNVAMTDSGGVHKFETYDNQTASANMGYTLGSVELGASLTYMKTEFNSAELDESSDDCSQANTTHWAFQTPDPHNTNTYDHWIGSLSVNHTINEKFSQKAMYGWFKKESTGIDINDGFLGYQEAPYDGFVFGGAPPYAAGERVPIKDGGNGLSSNTKNQNYQFEYNFIYDANIGQNHANTLLLGYEYIKQEGQKWGRYGEAEAEAKNDSFFLNDQLLLMDETLILSGGLRFDDHETYCDQTNYKLGASYLFKSVGTTLFTNYGTSFRAPTVSNMYDPKYGNPGITPEDGWTYEGGVRQSLFGKRLNAEVCYWKSELDNIIVYDSKQKRFYVNGTGAYVNRDNGETEGVELGLSFMATHTVTVSANYTYCDSYSFEDGEKFRNVQVARNKANLDIAYDDGKYTFNIHPYYTGPRLRWNGDIEMDDYLRVDAAASVRVLNNVKLYTRLENLTDDKTQEGLGYEQPGFYGIIGVEIEH

SEQ ID NO: 9885 - protein, 872 aa, Burkholderia phytofirmans
MKHIFNKITGVLFLSFTLVSFASFAQTTVSGTVKDENGEGLVGINVIVKGTVTGAATNLDGKFTFTTNTAPPFKVQVSGVGYETQIIDVSNSSQNLDITLKEEISVTMQVVVTASRVEESILQSPVSIEKMDILDIKNTPADNFYDGLANMKGVDLVPSGMLIKMVNARGFGGPYQTRFVQRFDGMDMQTPSLSIPFGNIAGIHDIDVESVEIQPGAASALYGPNAFNGVMNMTSKNPFFYEGLTVQMKQGFNNVNTTTVDEEATPYSEIALRYGKKLSDKFAVKVNFSYLRARDWAANDQRLLSLNNDRLFAVSSSNETPINGNAINTYGDEAAIGQVGGVNIHRTGYKESELTDYNVQNIRADATLYYRITDKIEASYMVKYADGNGVLSGGNRYSYRPQFVINKLELKGSNFFLRAYNMDQRMGSGSYDLSTAATSLQNQSKDNTTWLTDYTTAYNSNGGNHALARAAADKGRLTMSSPEFETIRNKIPAEGGGAFIEEGRITHVEGQYDFTSLFNDVVGVTVGASYRRFQVESNGTIFDDRGDKGPVSYYDIGGYIQVTKSFLDEKLKVVASGRYDKSEFFDGLITPRASLVFSPTKQHNFRASYQTGFKNPIFQEQSIFFPIVPGALVLAGGRQGFQDAAHTGTRFDINTFSATGEPITVPFVQPEEVTSIEFGYKGMLTPALFVDASYNRNTYTNFIGLDLSRGVLASDGVIYAFYENLPGTFSTQGATFGTNYTFGKGFTASANYTWTTLVDELPVGFAPSFNTPEHKVNLSFGNRKLTDKLGFNLAWRWQSEFDFLFNLSGQTITGKIGTFNTFDAQLTYKVRQGFTAKIGGSNIFNQYYTQALGAAAIGGMYYITFTFDQFGR

SEQ ID NO: 9886 - protein, 732 aa, Burkholderia phytofirmans
MFNHTPLATALALAFAVPFATPAVAQTAPQSASQPSTANTNSTATTTADSGTLPAIGVSAQAEQQDFQAERATVGAKTPTALRDIPQTVTVINKAVLQSQGATSFQDALRNAPGVTIGAAEGGQIGNNINLRGFTAQNDIYLDGFRDRNQYYRDTFDLEELEVLYGPSSMLFGRGSTGGVINQVSKKANLKDSAEVTGMIGTDDKYRSTIDVNHKLTDTSAIRLNAFGQSLGSTRDEMKNKDYGIAPEVRFGIGTPTEVTISALIQHNYDMPDYGVQALNGHPSPVPKNTFYGLTTDRTIQDVQTFTAAVKHKFSDNLVLTNQTQFSHSMTDARETAPQSVLTGPLATSPALSNGNFTTLSPSQLFIKLQSHDRVIENHSLYNDTMLEYKFVTGPIKHDLIAGVDLGHDSYSNQAYTRNNLPVVSMVNPAYLSSPAGVTTTVGNYADSGSNEIGAYLNDTVSIGRQWKVIGGLRWDRFQAQIHNSISAPGYATQTNFFTSVRAGVIYQPTDWQSYYVSYGTSFDPSLEALTVTNLTQNLAPESTRSYEIGGKWDLLGGNLSVTSSFFREEKTNARTQVSPTEYELDGDIRVDGFQAGVTGHITDKWQVFGGYTYMDAVILSARDGTQGHVPANTPRNTLTFWTTYALTPHWEIGGGPTYMSPRYASNTNYVQVPGYTRWDATAAYHAKKYDVRLNLLNLTNKQYYDALIPSDGGRSVPGIGRTLLATFDYRF

SEQ ID NO: 9887 - protein, 380 aa, Burkholderia phytofirmans
MKKSLIVVAVAASFASVAHAQSSVTLYGLLDAGVTYTSNVAHNSKWAAGSGGIDQSRFGLRGSEDLGGGLKAIFTLESGFNINNGRFANNNGMFNRQAFVGLSSAQFGSVTLGRQYDAAQDYLAPLTATGSWGGTYFAHPFNNDNLNTNGGFAVNNSVKYSSANYAGFTFGGTYGFSNQAGAFANNREYSLGAAYQWQGLRLGAAYAQQNNPGATNAAGTASNGGASDGAFAGLTGNFRQREFGAAGSYSFGPATVGLAWTQSRIDNVAGVQQSLRANNYEVNGKYNLTPALGLGVAYTFTDGKGYGVAANGGSTSVRYHQIGLQADYSLSRRTDVYAQAVYQHAMGDGGVASIYSGDITQAPSSSKNQTAATVGLRHRF

SEQ ID NO: 9888 - protein, 428 aa, Burkholderia phytofirmans
MHRLSFLPRRNALGYALLLALPATAVAAGDTTLTGDWGGRRSAWTEQGVSVRGDYLSETFGVVDGGYENTSARYAQQLRVGVDLDMAKLAGWGGGSLHVTINDRRGRSTSADLVGNRFPIQEVYGGQYTRLSEFSYDRSFNQGKTYLKLGFYAMGNQFASHTLLVNFVNAAFCAHPLAFSANSGWYNYPAARWGIEGAQQLTPQLNLHAGWFQVNPNLGFGARDTYAFEPFASGTTGAIFPLEFTWKPATARYPGRVQVRRLLRLLVGTRRGLDTSRSTGRDGAYLLVEQKLFTPGADPSIGLTGFAQYMASDHDSALMTRWYSVGGVYQGIGTRTQDRIALGYVAGRINHRLLDARRAELIDAGVSADSPLVGLSAAEELYELAYSAQITPWLMLRPDLQYIVNPGTYAYTHTRNAVVVGLQAKLTF

SEQ ID NO: 9889 - protein, 1124 aa, Burkholderia phytofirmans
MRKQRISSCRRYLKYIVLTLLFYPLSVLGAQGQVSVKGQSITIKQAIQLIEKNSSYTFFYNAADLKNTKTRNINCSGTINEVLNEVFKGSGVSYTIKGNEVILKVEGESTQQAAKHKIIGVVTESATGDPIPGASVMIKGTKTGTTTDVDGKFEVMATSSDVLVISFIGYSSKEIKVGNQKVLSVTLSDDAEQLDEVVVTAFGTGQKKETVTGSIQSVRPADLKVPTANLSTAFAGRLSGVISYQRSGEPGNNGADFFIRGVATMNSATPLIVLDGVEISKADLNALDPEVIESFSVLKDATASAMYGTRGANGVLIIKTKSGSDLEKPIIGVRVEAYVNTPIKRPKTVDGVTFMRMYNEAVTNQGTGDALYSDDKIYGTANNLNPYIYPNVDWYDEVFKNATFNQKANFNVRGGTSKITYFMNVNVNHETGMLKDRSSNFFSYKNNIDYMKYAFQNNVDFHMSKTSTLSLHLNVQLNNMHGPLTTSEGAGVDNIFGAIMGTNPVDFPVMYPQEDEKWYRWGSIVAGNYNPVNPVAVSSMGYKDTFESTVVANLDFDQKLDFITKGLSFKALISFKNWSYNSKYRLQGYNTYQLTDYTKNEDGTYNYTVNSIGDATNHTLDSFFGTDGDRRFYIQGYFNYDRAFGDHHVGGMLLYNQDEYNSNVNSSLLNSLPKRRMGIAVRAAYDYANRYLFEFNAGYNGSENFAKGHRFGFFPSVSVGWNISQEKFWEPIRNIVSNFKIRGSYGLVGNDQVPYTRFLYMGITTLNDSPSYQTGYGSHKESHNGPTFSRFENEDMTWEVGHKLNVGADIQLFNSLNLTVDAFREIRSNILTTKGSIPNYLGAAKTVIYGNFAKVKNWGVDLAVDYGKQINRDLSIQFKGTFTFARNRVMETDEAADIRPALSAVGKPLNTLWGYVADGLYIDEADIANNPTSTLGNITIAAGDVKYVDQPDVNGNYDGQIDSDDRVAIGHPTIPEIIYGFGPSITWKKWDFSVFFQGQANVSLMMSGFEPFGTQSKNNVLEWIAEDYWSKENQNPNAKYPRLTKYNNNNNMQSSTYWLRNAAFLKLKNAEVGYNFKWGRVYMSGTNLLTFSPFKLWDPEMGGGKGMAYPTQRTFNLGVQITFK

SEQ ID NO: 9890 - protein, 358 aa, Burkholderia phytofirmans
MKKSASLWLLAATVVPGTTYAESGVNLYGIVSSAVRYTSNLDGRHHDQVALVSGGMVGSRFGLRGSEDLGGGNRAIFQLEAGIGSDDGRAAYNAFFGRQAWAGLSGNWGSLTFGRQYNALNNIGWAFNPLDQGWGNFWSDPLYVGGDIFFQDYRINNSVVYQNTVGPFSVQLDYGAGEQPGNQSRGTTLGGGVKYQQGPLALGVAYDQRSSTDGTNTIRNYSVGGSYAFGKATAYLGHMGRRETASDASFATSFIGLGYQLTPALHLSGAYYRYQQRGAVTTQFQETPILLGSGNADSVALVGDYALSKRTSLYVEADVVYARGGTVGRETEYWAGTPVTDIDSTTRVGVMVGMRHQF

SEQ ID NO: 9891 - protein, 879 aa, Burkholderia phytofirmans
MKFADTIRTSASLAALAVAALAAPALAQDSAQADGAAAADNQIVVTGVFSAKSIENAPISISAVTAEELSQQIANSSADLIRNVPGVFVNSSLGEIRNVVFSRGVSANSLDGDGGYYYVSMQEDGLPVEPITSGNFGPDYFSRPDIMLDRLEGLRGGTATVTGNNAPGGIFNYISRTGKSHPGFEVQGKLGLEGDGKNPYYRVDAYAGGEVGNGLYYAIGGFYRKSDGSRDPGYALNKGGQIRANLLWDYGNGSVRFDAKYLNDHNGWFEFTPAFNYDDPKIAAGFDNTSSVLPPANAHSFTNPDGSTGSWDASDLVHARTLSFGMTWDHELADGIKVQNRARYSENKTDWSTGGLIFPLGVDDFFLSILTGTLGLPGTTTYKVRGTDQVAAEVFSFSGFDHSVVTNNLPNQHILENGVLSQAALSTKYRSRSFQDQFTLSASLGDHSLAAGASFAHSRYSQANGAAGIGVSALTPTPQVYDITHTLPDGTVLQVTDPAGFAAQGGGLLDGDGVRGTQRQISVFAGDEWQVTDRLSVDGGIRYEDIRYDITNLTLGAAVAVNGGGGADGNPLTLWDNTRNTYGAPTNTKRNFHYLNYTGAVNYEVSDNFQAYVRYTRGKKAPDFRGIADIDTPSEISTQFPEPQVITQVEVGLKYRQDNLRVALFPFYSKLSNVGSTQTFTDENGKFYTPPTVYGQIETYGVEIDADADIGSMLNLRTAITLQNPKASKFGLWIANDPGSADDELQSTPKGDADNNPKILTRTTATLTPVDSLSLFLTHSYTGKRAANRANAWYLPGFHTFDFGAAYEFGPDKRFKLQANVNNVFNQFGIMSWARSGGFLASLDRQGLTKEAVAADPNQLLSIVAVQPRSFWLTGTVKF

SEQ ID NO: 9892 - protein, 830 aa, Burkholderia phytofirmans
MAAKTRATLRSRLACSISVLALPLAGMAVAGTAQAQSTGTSQDVIVVTATRRSETVQDVPLNIAAIGGSQIEEQGFEDLADALAYVPGINIVDRGGRQGNPIIVRGLNADPIGSGDGDNSGGGTVATYLGEIPLFIDLKMNDLERVEVLLGPQGTLYGAGTLGGAIRYLPNRPDFDSNMLQVRSSFYQYSEANSPSADIGFTFNHAVSDTFAIRGSLDVLHDSGFTDYNYRVREPGVSNPNPDFNDPADVAANLAPVADADGEEALSGRIAARWAPTDWLDATATYYFQNQDIEGRQISSRRSPVPASAYESALRVLEPIERNNELLALELTADLGFAELTSATGFGRYSEDGQRDQTDLLISLEYSYESFPNFTAFTHELGEDEFFNQELRLVSTYESQFNWIVGYYYNKAEFVGSSQEFTPNYSEYVNDNFGFGLTENPTDLEYFSTGNTQLTESALFGELGWDITDRLSVTVGGRYYEYELESVSTVDFPLFEAPTYTPLTIDEIRDLAFDPALAQSDDGFLYKFNIAYDVSDEILAYFTVSEGYRIGASNGLGTCAAYDPAATQGACALAPGQQYGPNAGDIAQFDERQYGPDQTTNYELGAKTTWADGAIVLNGAIFLVEWTDPQVSSATVNANIPITVNAAGAESKGFELQGSWQVAHNFELRGTYSFTQSELTADVPFLIRTINTPGFGSAFEDGQSGDRLPGSPETQASVFGRYSVDMASGAQLNYNLGISYQGDILTRTGGRGSSSTLDSYFVANGSINYDAGDWGATLFINNIGNEYIETGIRSTALSNQTINGHSVRSHYANVAPPRTIGVRFYYQFGD

SEQ ID NO: 9893 - protein, 1049 aa, Burkholderia phytofirmans
MKKIRWNPRLVTSLFITLLMCTLDCLAQEVIKGFVKDGNDEPLPGVSVAVKGATNVGTITNVDGKYSINAHKNDVLVFSYIGMVSQEVKVGNKTNINITLKEDVSSLDEIVVVGYGTQKRGSLTAAISTVSDKEILKAPTMGISNIIGARVAGISAVQASGQPGADNASLSIRGQSGIIYVIDGIRRSASDFNGLDPNEIESVSVLKDASAVAVYGLDANGAFIVTTKKGQTDKVTISYTGTVGISQNAEEQEWLDGPGYAYWYNKARLLQGDTEVFTVDMVRKMREGVDGWGNTNWYDKVYGTGVRQHHNISASGGSEKIRFFTSIGYLEEKGNIDKFKYRRMNLRSNIDAQLAKGLSLSLGVSGRIEKRDAPKFSADPDDWMNIPQQVCYALPYVQDTYEYNGKIYDVSTPTSGSPVAPIASIYDSGYNRSNQSYMQSNFSLKYDTPWLKGLSLKFQGAYDLVHGMTKQLTKPNEVMIMDLPNAATTTLTYHKDYSVLKDTPILSESASRAQEFTTQTSITYDNKFGDHSIGVLLLAETRERNSNNLGVTGTGLDFIQLDELNQITGFTKEGKEQPAIPSGSSSQTRVAGFVGRLNYNYADKYYLEASLRHDGSYLFGGMNKRWVTLPGLSLAWRINNEKWFHATWVDNLKLRAGIGKTATSGIQPFQWRNTMSTSPNSVVIGGASQTAIYPSVLGNPNLTWAQCLNYNIGIDVTLWNGLLGMELDAFYKYEYDKLSSVTGSHTPSMGGYYFSTANVNKADYKGFDVTFTHQNRIGSFSYGAKLIWSYAYGRWLKYAGDSENTPEYRRLTGKQIGSKMGFIAQGLFQSEEEIANSATMPDRPAYPGYIKYMDRNGDGIITVNQDQGYVGKSSRPTHTGSFNLFGNWKGFDFDILASWGLGSDVALTGVYTATGSSGIQSATAFTRPFYQNGNAPVYLVANSWTPENTNAEFPCLEINPRSLNNGLASTFWYRNGNYLRIKTAQIGYNFPKKWLSPLGVEALRLYVEGYNLLTFSAVSKYNIDPESPAVNNGYYPQQRTYTLGAKITF

SEQ ID NO: 9894 - protein, 399 aa, Burkholderia phytofirmans
MKKALATSALGLVALGAHAQSSVTLYGIIDTGIGYQSSQTSPGSTSGGRSAVKMVNGIWAGSRFGLKGAEDLGGGTKAIFQLEEGFNSATGAQSVSGLAFNRQAYVGVANATYGSLTAGRQYTSYYTLLAPYSPTTWLTGAYGAHPGDIDSLDTLYRANNSLVYTSPTMYGLTVSGSYSLGGVPGSFNAGSTWSAALQYLNGPFGIAAGFQRINNSTPGGGAWGADSTTSNAGAQAGVSGINNGYQRAQAQQRVAVTGGYAFNAQWDVSFSYSNVQYIPGINSPFRTTAIFNTGGAVLHFKPLTALDLAAGYSYTRATEANGISSSARYQQFNLSQYYSLSKRTGLYALEAYQRASGQTLATNGVSIINATADIGDGQNGAPSSSRSQFAAGVGIIHKF

SEQ ID NO: 9895 - protein, 392 aa, Burkholderia phytofirmans
MNKQVFALAVSITASAVFAAPVSAQTSVTLYGVIDEGINYTNNVGHGHVYELASGFAQGSRWGLKGAEDLGGGLKAVFQLENGFDLNSGRLGQGGRMFGRQAFVGLSSEPYGTLTFGRQYDSVVDYLAQTTANGSWGGELFSHPYDNDNTDNTFRLNNTVKYTSPSISGFQFGGTYSFSNDTSFANNRAYSFGGQYTYGGLLVAAAYLQANNPGSSANGAVATNDAGFVAKRMRVFGGGINYTFGPATAGFVYSNSNYLEPTANGFLGIEPLVPLVPVTPPGVLLNQLKYQNFEVNGKYQISPVLFVGAQYVYTMETYDASNGGVKPRIHTFGLMADYNLSKRTDVYLQGAYQQVTGDSTLSILDFAFIPGTQSPSSTSKQVVVRAAIRHKF

SEQ ID NO: 9896 - protein, 1166 aa, Burkholderia phytofirmans
MKKKLVRVSQYIKIRSIKTVGLALFSSLILAPSLYAQISLDVQDQSIRHILKEIEKAGEYKFFYNSDLSNLDHKTSISVQDKNIDEVMSLLLANTEISYKKEANNMIVLTVKSSSSPQAPRKTRKITGTVVDPDGLPIIGANVIEQGTTNGSITDLDGKFELIITENAILNISYIGFSDKQITVKEETSLQVTMTEDTQKLDEIVVVGYGVQKKVNLTGSVSAVKGEELSQRPVANATQSLQGLVPGLTVSNSNSGRPGASGALSLRGQGNLANTANPYVLVDGVEMDLADVNPNDIESISVLKDAASAAIYGARAAYGVILVTTKKGEEGKMRISYQGTVGWSSPTVMPEMANAYDYATFFNQACTNANVIKQYNPEKLQQLQQYMKDPASVNPWAELNGENNLVGAFENTPKGLGNVDYFDLHYKNSAFKQNHNLSLSGGGKKAQYYISTGMYTEDGILRYADIKYKRLNFNANIASQITDWLNLKVNTKFMNSDNDTPFGKGALSEGFYHSLARFRPTISPIDPNGHFTELTMIPYLQSGTYTNTQKNNLTLTGGLEAQPIKNWRIFFDYTYRQNNENYEALNVAPMIPGADNETLYKGTRQELGVMENGQFTRSSALSQYQSINLYSNYMFSLADKHNFTVMAGYQEENYAYSYLYESVTDMISTNNPGLNLGTGEKSTTDTRNGWATRGFFGRINYDYDGRYLLEVNGRYDGSSRFASDHRWGFFPSVSLGWNITRESFMEKSLEVLSNLKLRASWGLLGNQSGAGLYTFTSIMGIQPLGNWYFQDGRDMYINAPGVIDPFTTWEKVESKNLGLDFGFFNNALTGTFDVFQRDTKDMLGPSADLADFFGAEAPNTNNARMRNRGWELSLQYRGKIGKDIHYSIGGSLADATSEVTAYENPTGTNPQDNWYVGKKVGEIWGYKASGLLQTQEEADTYNNTYDLSFLSGQKWMPGDVKYMDLNNDKKINNGNNTLEDMGDMCVIGNTTPRYQYTLNGSISWKGISLSMMFQGIGKRNWSPDLGTVYFWGSGAYAQVTVFNDHLDYWTPENPDAYYPNPYTGAAGSINQFRNKTSQKSDRYMQSAAYCRLKNLTISYDLPNSWSQKIGLSKAQVFFSGENLLTFTKLPSMFDPEAIFTGNDYTSEAGKNYPMNKVLSIGVIVNL

SEQ ID NO: 9897 - protein, 1056 aa, Burkholderia phytofirmans
MRNIFKYGLLAMAIAVTSVGVRAQDIPVSGVVKDKSNNSTLPYASVIVKNESGKTVPQLSTTTDDNGRFSTKVKSGYRLVFSFLAFDSLSVKVTKPSERMQIYLSPTENMLDETVVVGFKRVSKAAVTASVTVIKAEDLVNTPVANPMELLQGRVPGLNIQMNNGTPGGLPSFSIRGVSDISVQSSGDGEFMMGLTPPLFVVDGIPQEDVTGYDAAGLLSGATVSPLAMIPLEDIANIQVLKDAAATSLYGSKGAYGVILIETKRGETAKPKVSYSANFVVKTPPRLRDVLAGGAERALRIMQILGNDTSAYHGYNEIHKLQALSDSLNPYYNNNTDWQGVFYQTTYNQTHNLSFSGKPNEKFDYKINANYYTEKGIVKNTDFNRYGIRAAVGYKPNDRFHLDLNLATTLTRNSNGSGNAFSQSGVAAGSAASSLLPPPSMYTASNSALSVFSVQADNQNVVYDASMNIMYLLPFDIRWRSTLGYKYGTVENEKFTPGILNANRATWNNGSEYSYNMYVRSLLSRTVKLGIVNFDLQGGFELSSEKYSGNFIMLNGLASDHIWSSGMPSMAAGRSNFSDKKNTFALIIDPQLSLPGGKYVFTPNIRPEINSSYGSQAKWAINPSLGFRWNFSRESFAKKWKFLDAGALRVTWGRSTTYKASIYDIWGSYNLSKDTYNGVSIIPIDKNAMPNPDLKPVTSTSWNLGTDLSFLNNKIMFVAEAYYKQIDNQLSSIELANHNAFNSVRSTKTSLVNYGLEFSLNVRPLSRQSNWDLNVATSLAINKDVIAKLPNEVRQIINSDAEVVNKLGSNAMGNYLYVYKGVYATDEDVPVNPLTGERLRMGGNTSTQAYFKAGDPIWVDVNGDYIIDEKDKVIVGNSQPRMTGGISINLRYKAFSINTNCSFTLRRDIINKALADRFRAYGTPVAGKVNLTGSGALTPIEAYNFWTEDNIYAQYPNPFDYTRSSIIQPFRYDQTLFMEDGSYFKINGISVAYTIPKKMLDFFRISRCQLNFSMNNIYTFSKYSGINPENVNNLGYDTSGGYPNGRTVTFGVSMDF

SEQ ID NO: 9898 - protein, 785 aa, Burkholderia phytofirmans
MTIRSVITRAALLSGSAGIALIAAPATAQTTSADDDAGESVGQAGSNQIVVTARRREERLLDVPLSVTALSGEQLEQRGIQELTQVAQEIPNITLEVSRGTNTTLTAFIRGVGQQDPVAGFEAGVGLYIDDVYLNRPQAAVLDVYDVERIEVLRGPQGTLYGRNTIGGAIKYVTASLPDETSVTVRGTYGSYDQADLIVSASTPITPNLKIGASGARLSRGGFGDNLTLGTENYNKDIWAARGTIEFDNGPVFVRLSGDYVKDNSEARQGSRLIPGLFSGAPVLDDVFDTRAGLNVVDQEVEAYGGALNIAIELSNTITLKSITGYREDSSTTPIDFDSLPAADLDVPAIYENDQFSQELQLLYEGDRLSGVFGAYYLNASAFTAFDVALFTTGDLIGLPGLNAQTLGDVDTETFSFFGDFTYDLTDTISVSVGGRYTNDKRTSRVLRTTFIGGFSDLFIPNSPAVAIATTSDFQGSETFEDFNPRASISWQPTPDHNIYFTYSQGFKGGGFDPRGQTTAAPDLDGDGDIDFDDQFEFLRFAPETVDSYELGWKASLLDNRLNVSLAAFIGDYNDVQIPGSVGLDTNGDGINDSFIGITSNAASADVNGFEFEGNALVGEDFAGDGSRFSVNWSLGYLDASFNTFIDAFGNDVADQRVFQNTPDVTAHMGFVLGIPAAEGMIDFLGSASLRSDASQFETPNPFLDQDGFVLVDASIVYTDDSDRFSIGVHGKNLLDKEYIVAGYNFVAGGTPPGTPFVPTLGLEGTLTGFYGDPRRVFVTGEIRF

SEQ ID NO: 9899 - protein, 381 aa, Burkholderia phytofirmans
MFNCRRFLQIGTLSALLAGCATSSQTPQAQHLPAQAATGQADRVRIGPDKPVSSDEGPATLTPTGELRPDVRAFAEQLAAQRELPLPQVLASLESTRYNATVARLIAPSGASGKKIWRSWLTYRGRFVEPKRIAWGVEFWNANQDLLNRAAQRYGVPASIIASIIGVETLYGRNVGNFRVVDALATLAFDYLDPAKPERADMFRGQLGDFITLALQDKLDPETRGSYAGAIGMPQFMPGSIMRYAVDGDDDGHIDLTNSVADAVMSVGNFLVEHGWQRGLPVFAPVALPADPAPLVAGGLTPTLDWNGLQAAGARPAAGAGRGAWQEHPMGIVDLVEEARGTVQYRTATPNFFALTQYNRSYFYATAVADLAAELQARTGY

SEQ ID NO: 9900 - protein, 165 aa, Burkholderia phytofirmans
MKIKHTLSILTAAMTLSFSALADDSFYLGTIYSTVRAADESVDKSTSNISNLGLQAGYSFNQHFALEGRYFYALNRSSSLPQHQSQIYAKASYPLNDTFSIYALAGVNFAKEYSASSQTKGYFSGGAGVSYTFTDKLKGSLEYVSLAHSKFYKGNAVNIGLSYCF

SEQ ID NO: 9901 - protein, 422 aa, Burkholderia phytofirmans
MKKQVYQWLASVVLLALTISGYAELPLSEQKVKSHTYTTLDEVKDYLSKRGFVETRKQDGVLRIAGDVRARWLYFREDIKNPSDKDKYNPLPVNRYRSEFYLYIDYRAERNWLSSKMNWTAIAGGENTAAGVDINRAFLGYRFYKNPETRTDFFMEIGRSGLGDLFESEVQFQSNFDGLHIYWTRELSKDYPYQVIVHGGPFVVNMTKKHYAWVVEGILNRLPKQFFVKCSVVDWNTFVPSETSTTEKAATNAMKYKYCVWQWLVGKHSQVPWINGQKKPLYLYGAFLMNPLAKATKTTLNGKENLAWFIGGTLGGLRKAGDWSATVRYEYVEALSVPEIDVSGIGRGNLLKFWFAQAIAANYDPKEANGFTNYKGFSALYMYGITDSLSFRAYGAYSKPANDKLGSDFTFRKFDLGIISAF

SEQ ID NO: 9902 - protein, 393 aa, Burkholderia phytofirmans
MKRIALSTLSLALLSATGVAHAQSSVTLYGLIDESIQYAHNTVDTNGKNSNQVGLVGGNLQGPRFGLKGTEDLGGGLKAIFQLENGFDVNTGKLGQGGRMFGRQAYVGLTGDQWGTFTLGRQYDPLVDLVQPLTADNYFGSTFTTPGDVDNNDNSSRTNSAIKYTSPVWSGFQFEGMYALGGVAGATGSGQSWSGAATYATGPFSVAAGYFRLDNGNTLASRTSAGAVGWNGSTSDGTFDNQVNGAYAAAKSIGIASVAVQYVAGPFTANLRYSNAQYKPDANSGFGSTEKYNIGGAYLGYQATPAMLVGVGYIYTKASGDSSATYHQVSLGGDYNLSKRTDVYLVGAYQHASGQQRTSGGGLVDAGAAIGSYGYNSASSSQELVSLGIRHKF

SEQ ID NO: 9903 - protein, 393 aa, Burkholderia phytofirmans
MKRIALSTLSLALLGVTSVAHAQSSVTLYGLIDESVQFAHNTVDSTGKNSNQVGLVGGNLQGDRWGLKGTEDLGGGLKAIFQLENGFDLNTGKLGQGGKMFGRQAYVGLTGDQWGTFTLGRQYDPLVDLVQPLTADNYFGSTFATPGDVDNNDNSSRTNNAIKYTSPVWGGFQFEGMYALGGVAGQTGSGQTWSGAATYATGPFSVAAGYFRADNGNTLASRTAAGATGWNGSTSDGTFDNQVNGAYAAAKSIGIASVAVQYVAGPFTANLRYSNAQYKPDAFSGFGSTEKYNIGGAYLGYQATPAMLVGVGYIYTKASGDSSATYHQVSLGGDYNLSKRTDIYLIGAYQHASGQQRGADGTLVNAGAAIGSYGYNSASSSQELVSLGIRHKF

SEQ ID NO: 9904 - protein, 1066 aa, Burkholderia phytofirmans
MQARSCRPAQEAGARLSAARLSVAIVLALHGVGAAAQTVGPPATPADAVDLDRVQVKATYRESLQQSLDAKRYSVEQVDAIYAEDIGKFPDLNLAESMQRIAGVSIDREGGEGKQISVRGLGSDFTRVRINGLEALATAGSGSDGVNRSRGFDFNTFASELFSRVTISKTQSAQTDEGSLGATVDLRGSRPFDFDGFEAAASTQYGYNDLSREQDPRFSGLISNIWADGRVGALMSVSYSERHLREEGYNPVRWEHGNYRNSNQSTATNNGTYGFCSPVGYNPQTPRNPLSNETRAGVGSQANQDRNNGWGSYGISATTCGTGIARPANTPENIQAYETATDAWIPRYPRYIRTDHEIKRLGVTGALQFKVSDDTLLNFDMLYSKLDKDQREDSVGANLHRTANFGGKTQIAVREAQVDEQNRLVYGVFDNVDYRTESSSIEESTEFKQFSLDLQHRFNDQVRMTALVGHSTSDYERPVFSLVSFDNTNLDGFVLDRRGGGDYPSMTFPFNAADANNWQWLGYGAVPVNSNGTARGTNISEVRLNPQSVSNTFDTAKVDLEFNISPTFTFRTGLAYKDYDMETSESRHVSYGRLAQGLPAGVGVGDLSTTLDGFGRSLNGNFPTSWVIPDFQKVADLLNINCNCDTGVPGGDYRLADVGHFGSSNNNFQVNEKSLGTYLQLDFNTDLWGRALRGNLGVRYVQTQIAASGYAPCTATASGAISPACESFFGVASATAAAGERLLVPTTVNHNYRDILPSLNLSWDVSDEVVLRFGAAKTMARPTLAYLSPSVSGGPTQFFDDGRFFSINLGNPKLDPFRSTNYDLSAEWYFREGSLLSAAVFYKDIDSYVQRTRVLTTWEAMGYSLDLLPAGFTPDTIFNVQSYFNTPGGPLKGFELTYQQAFDFLPGFWRNFGIQLNYTQVDSKINYLFSTAGNSNTSITTTTTERDLLNLSPQSYNATVYYDDGRFSARVFTSYRDGYINNILAQEDVYDLDGRRLVTADVTGKYSVENVDFNMSYKISDHLSLTFEAINLLDTPDRRYVDSALELPDKYTVTGRQYYVGARYKF

SEQ ID NO: 9905 - protein, 447 aa, Burkholderia phytofirmans
MKKSRILGIAVGATLAMGLSASAFATDGYQLIGIGQYAVGMAGAVVAAPDDPLSAAMSNPAGLALMTPQAAFSAEIFNPVRKTNLGFGEIGSHSNVYGVPAIGWVAPAFAKNWVFGGGVYGTSGLGVNYLQNLGPAGYAQAYSSITFMQMAPSVAWKANDRLSVGASLNIAAEQGSFQQTFSQNAPVVVGVGPNGPITQMMPQQGGLNLATPSWAYGVGATLGVLYKVNHMVTLGATYKSPILFTPMTWQAGLQNQVSPATGNGVIGAPGQYSGHLNYPQQIALGLAIRPIRQWLVSIEGQWINWHNTMNNFTIFGPWTAYQGGAAVGGLSSIALPMHWSNQWVANFGTQYDVNNWLQVRAGYTWGSNPISNNTIASNLIFPAIVQNAITFGATQKLGMGWKLTEAYMHEFSNTNTGPAGSSPFGGPMPASATMYENSYGIQVGYDF

SEQ ID NO: 9906 - protein, 750 aa, Burkholderia phytofirmans
MEWATGTRLRAIAAAASVTFGMAAGHAFAQTAPAVNAGAATSTDSARNGAAASAGASAPNGPATGTLPAINVNAGSEGDGTVGLVAKRSRTGTKTDTSINEIPQTINVVTAQQIEMTGATDVNAALRYVPGFSSYGSDNRSDWYAALRGFTPTAYVNGLQVPNTLNLSSWRVDPYMIDSITVLRGPTSVLYGAGDPGAIIDVQTKTADGERVREAGVQFGNYARKQFMIDVGDKLDADGKYAYRFVGVARDGNALTGPNNDQRVALAPTFRWRPDADTSLTLSATYLQDWGDISSNFLPAQGTVLPNPNGQLDKDVYGGDPNFNYYRKKQWSLGYQFERNLNSMWTFRQNVRWMHLSLDNGSVFGAGFADGSLTDINRWAGVFQTNYSRFDIDNNLQGRFGTGPLEHTLLLGFQYNRQTATDSEWLAAAPTLNIYNPVYTPVTLSVFSPPNTTYRTNTYTTMNTFGLYVQDQIKWNRWTLTLGGREDWVNQRLDDRAGGTQSKADITAFTGRVGLTYQGDYGLSPYISYATSFNPLIGVNLYGGGLPQPTRGKQIEAGLRWQPPGKNLMLNAAIYQINQTNVLTSTPLNLDPSGTTSIQTGEVRSRGIELSATGKLTRNLSLIASYVYQDVKNVKANDASLNNWPVDIPRPRQMASLWADWTWHTGPLTGFGLGGGVRYQSAAAGAADNSLTVSSYTLFDAGVHYDTRNWRFAVNGTNLFNRHYISGCQSTSVCIFGTDRTVIATAKYNW

SEQ ID NO: 9907 - protein, 216 aa, Burkholderia phytofirmans
MQKEQLSALMDGETLDSELLNELAHNPEMQKTWESYHLIRDSMRGDTPEVLHFDISSRVMAAIEEEPVRQPATLIPEAQPAPHQWQKMPFWQKVRPWAAQLTQMGVAACVSLAVIVGVQHYNGQSETSQQPETPVFNTLPMMGKASPVSLGVPSEATANNGQQQQVQEQRRRINAMLQDYELQRRLHSEQLQFEQAQTQQAAVQVPGIQTLGTQSQ

SEQ ID NO: 9908 - protein, 671 aa, Burkholderia phytofirmans
MGWPARAGLGVCLALSISGAVRAQEAGGDPGSAGASADEPGVPVFSVPTVEVQAAPEREPSDSAAQRDPSGALTLIQTADFGGAARDTAEVLSTAPGVVVQDSGGYGQSKSLVVRGASSNGTLLLLDGIPLNGAGGIADLSRVPLAVVERFEVLRGGAGARYGSGGLGGVVNVITRRPGSEAQVAGEATYGSWDTVRGWVSATGPVLEGEALLLIHGGRSTGDFPFRFDASPALPGDALVERRRANNDAWGAGGLLRVRHGLGESLELDAMAELSTDDRGLAGTAQNPLPDARQGGGRAAASLRLSGEQGAVRGSARGWFRGDRIELSGGPVVTQGRQVLRLGGGEVEARTLLGERHGVSAMVSVSAEDVTRAEGAPEGGSRPGWWRASAMVMDEISLAGERLSLAPSMRVERAGSYTLLSPKVGATLRLPEGFELRANGGQAHRAPSFQELYVRQGLLLPNPALRPERVLYTDAAVVHRTAQSLASVGGFYSLYENLIAYELYPPFAAKPYNFASARVVGLEAEGEWRPFPWVAGVFSYTLLVSRNLRDDPRYYLKELPYRPRHKLSARASGGPRWLTGRMEVATQSSQFINRTEEAVLPGRTFLHAGLSSTFGRFPELTVSLEFKNLLDAQAEDLDGYPLPGRSAAVTVAASFGGPSRASSKGARTNTP

SEQ ID NO: 9909 - protein, 254 aa, Burkholderia phytofirmans
MCNKSVITALFGAIFVSGSVYADVNKTSVDLGYKFYTNDTKNDNPGVFNQPFVKLNHLGIADWGSYFANVKLENPAELAENQKNIDGKTTIKSLMIIENRLGESQFNFWTQNFVSASETLVEDNLYFGLTHNAKFKDLSLNYGVGLNYTFGNFSPTSAKFNDLSGYAVVLNAKYPFDFLGFNHSLSLNYEAQIDRDEVHQELFSYNSYGHQIITTIQTKLTDSIYSKLHLTHYDSWGSQYNDGLEYGISIGYQF

SEQ ID NO: 9910 - protein, 383 aa, Burkholderia phytofirmans
MKKTLIAAGLLGAVAITAHAQSSVTLYGTLDAGLVYSNNQGGHSNWQQGSGVASDTYFGLRGNEDLGGGLHAIFTLESGFNLNNGKYSESNTMFNRQAFVGLQSDRYGALTLGRQYDSVVDYLAPLSAAGAGYGNNLAGHPLDNDNLDNSFSVKNAVKYTSANYAGLKFGGLYGFSNSAGDFSNNRAWSVGASYENGPLNVAAAYLQLNKSGSSNLSGAVSQGDGTAAVAADLQRTFGAGINYTYGPATVGFVYTHTQLDGISGVDVGGTTLPGVAGTNLHLDNYEVNGRYALTPALSLAASYTFTDGKMSGSNGSGDPKWHTVSLQGDYSLSKRTDVYVEGVYQHASGELGNFGANVAAINTLAPSSTGNQIAAAVGLRHRF

SEQ ID NO: 9911 - protein, 1193 aa, Burkholderia phytofirmans
MKDTAEGLVANKSASIEMMNGSITVRKTAVKASNEGSIKLLGDLEVISQESDGLWAEEGATIEMTKGLITAKGVAVRASDRGSVKLLSDVTVRSRRSDGLVAEKGATIEMIKGSVTARYTAVNASDKGSIELLGDLEVISQKSDGLWAEGEEATIKMTGGSINAQNTAVRASDRGSIELLSDVKVISKGLDGLWAEGEGATIKMTGGSIDAQKTAVNADMGSIELLGDVKVISRGSDGLFADGEGATIKMTKGLITAKEVAVIASHKGNIKLDGVGDSIKVWSQGNIGSLASEEAKITLKNVKIAVLGEGDGSAVMKSENSGIIEADGVKIVAHLTESVETTVENVGRRVGVHAKDKGVVRLNNTTLEGVHTGLRADGKEANIEMTDGKITAITGIINEGGAVTLKNTEVVTIGDSAGFIMGKGGKAEMFGGSLNFSNHGISLRDASFAAKDVSITGTGEKVMDMVFGAAFNANKTGLITLSDSKIDVTHHHGLYITNDSDFDRSDNNYGLNLPKSLGINVGRSELLVNGGASYGIYVMGSTLLPEHTKQVWLAESPIRERVALGTSFVSLQETTLKVPDSAAIYSDHGRAYIQLSQGTEISGSLLLETKEGKDEIIIVADNSSLIGGTRINDNSNVGFYLSNNSKWTLTKNQYEMLNGSDSKKPRDAGLPDSSISFIHLDRSSISFASQSVAPQKYQTLRIGKPGAARGDIAYYVSGGAHLYLNAYVDEKGQLDNQKTDRVLIEGSVAGRTTKVHVNGHLDVNDKKPVTKNDGKKKGISLIQVSGEAYKDSFELESGYITLGGLPYQYRLKAYGPNHSDTKKEKSVKRQRFVSGNGDNFWDFRLQEVMFGENGEELDWDEFGEDEDSLYGRHGRAFRAVAPQVPVYLVLPNAFFHTDLMDIDYQNKLLETMQVDAGDLSNKISIQGYDGSHRYTSNLTENEYGYGADVGYQGVQGSALLKTVENKHSNMFFGVMGNFGHLSLQPRQVAKGLKSTLDKWSLTAYGRVQHDNGFYANGTFSYGFLAGDVLTAERGVTVNLRGQPLSASLTTGKAFVTNYKGLVLEPQVQLIYQSVSFSEAVDVDGLNVQFDRPDQFTMRVGGRFGKTMATLQKGHFVSFYGRAHLTSSYGRDQFMYIHDAFRLGAFGSAIEGGFGVNAQLTSAVMVYGDLVYKHKLGTFGFTGTSVSGGLRYRF

SEQ ID NO: 9912 - protein, 676 aa, Burkholderia phytofirmans
MKSNHNKIKKLSLTLLVPCISFAQTTVLDEIEIKEKKELKTNSMNIDLEKTEQEQANSFKEIFKNNSSIEIGGGAINVQRIYLRGIESSNLNISLDGAKQGKNMFQHRSNELGINPDLLKIVDIKTAPDATKNSALGGSIEMSTKDAQDFVKGNKNYGSIFKTGYNTNAKQKYGNATTYQVFNDYVGAYASVSGVNSDNYKDGNNNEEIATAYHDRDYLFKISMLNANDHDLRLTINHNENSGDTRWRGTEYRPLPSELEKIVSSTTNYALQHNYNPNNLINLDTDLNLTNITLEREDENQKYENQNIGLKVQNHFDFDISSSSNRVSLGAQLQKENGEGPLIPHNLDKNITQYSDLDSSTKSLFVQNRTQINSLGIDYGLRFDKYDFETGLGKASDDTFSPNMGVDYSITPNSLIYANYGKASRMSGLIPFTWALNTKKGSTYSKDLEAEKSTRYETGYKYEKRDTFLNDDYITFNVNIFKTTIKDLIVSKDTNCKNGICGSGEGGRTLQDIYNREDDFESKGFELKLSYNYDIFSTSLAYTQIDTNNVNSDTNGVANINEDQNIRRVGGYDSKKFIWNSGIEITKDLAIDYTLNAVASSDVLDSNNNEINRAGYTTHDINMKYKLNSDWTLFFAVNNLTDKQYAKATTISTKNQADVYRYEMGRDYRFSVKYEF

SEQ ID NO: 9913 - protein, 228 aa, Burkholderia phytofirmans
MKRIATALLCSSVPCAAFAGAYVETREAYNTASELHEVILRAGYNFDMGAGLMATNAYNVGKWDEIKHSYNEIEGWYPLFKPTENLTFQPGGLINDSIDGSGGALYLDTNYKFTPWFNLTVRYRYNHNNYDTPDFNGKMDKNDTHEFANYWNFKVTDKLAYTFEPHFFQRVNDYHSKNGKDHHWEITNGFRYKLDQHWLPYVELQWLDRWNEYHREQYRLRLGLRYSF

SEQ ID NO: 9914 - protein, 1025 aa, Burkholderia phytofirmans
MNKILIFCSLLLFLSVTGYGQSRPISGKVTDQQMLPLESVTVTVVETGKSTQTNKEGNYSIAGITGQTLRFAYAGAALKSLAIPSGNTLNVQLETTTDLSEVVVTGYQQERKKDLTGAVSVVSVKDIKDIPAGNPIRALQGRIPGVFITAGGAPDGGASVRIRGIGTLGNNDPLYVIDGIPTKRGLQELNQNDIESIQVLKDASSATIYGSRAANGVIIVTTKKAKSGYSRVDFDASSSLQYYNTKLKTLDAEGRGRAYWQAAVNDGANPNQNQIYQYDWNNDFNNPLLNQVIIPEYIDGAKTMRSANTNWFDEISQTSLLQSYNLSIANGNEKGNSLFSLSYFDNKGIIKETRDKKITGRINSAYHLLNGKLTIGENLSGTYKKDVLIPTGDITNLSLIVFPIVPIYTVDGGWGGPAAGMADRQNPMRLIGDNKQNYNNFWRVFGNVYADLEIIPSLKFRTSYGIDYNGNYARTLRKSYTSGFLSDPSNAVNTNSNYEGNRIWQNTLTYALKKEKHQFDFLAGHEQIDIIYQGHSGFRQGLALENMDYAYLDAGSTNKDNGGNGTSSALLSYFAKANYSYNDRYLFSATVRRDGSSRFGKENQFGVFPAFSLGWRLSEEDFIKKNVPFVSDLKLRYGWGQNGNQEIANNATYTLYSAVYGTNAIGNFDGGTAYDIDGKDTGQLPSGFALIQQGNPTLKWEATTQSNFGLDFGLFDQSISGSLDYFVKKTSDILIKPAYLAVIGEGGDRYANGASMQNKGLELLLSWTKEVSPDFSLTLTGNVSTYRNKITELPEEILTSYAGNGTDKNILGRPIGSFFGYVADGIFNSVDEVNAHAAQPGKAPGRIRYKDLNKDGVIDPLDRDYIGGGDPKYIYGLNTSMRYKNFDFSFFLQGVQGVDVSNSYKGLTDFSSLQPGANWGVRTLDAWTPSNTGSSIPALTLVDRNNEGRFSTYYLENGSYLKLRNIQLGYNLQNVFKKVQQARVFVQASNLFTIKGKSYTATDPENPGNGYPIPVISTLGFSVSF

SEQ ID NO: 9915 - protein, 213 aa, Burkholderia phytofirmans
MHKSIRTCVTAAAIAASLAALPSLSHAASPGDGVNQGDVLVRLRAISIQPNERASDTLGAINTGVNNAIVPELDFTYMIRDYLGVELILGTSRHQMTSSLGNLGGVGVLPPTLLLQYHFNHAGKVRPYVGAGLNYTYFYNNGLNVGGEGVSINKSSFGPALQFGVDVQLTKKVFMNVDVKKIWMSTDATLGDKGIGTLHIDPLIVGVGVGMKF

SEQ ID NO: 9916 - protein, 1160 aa, Burkholderia phytofirmans
MRTFCALFLSVLVLFTGLCFGQTQAARLQGIVHDASGAIVPNAKVIAVNNQTKDASDATTNASGLYVLPALRPGTYTLMVEAAGFSKTTVTEIELAVSSNIAQDVTLEIGKLTEVVEVRANAVSVATTDAQVSSAVSMRDIDTLPQLARTPITLAIFQPGVQISQNGSNTGTDTSYSHVNGLRQGSNNSTLDGIDVNDAVAPRLGLAMTATNTDSVEEFRVVTASGKAEYGRNAGGQVELVTRSGTNTPHASLFEYIRNQAVNANDFFSNKSGVAKPMFIQNIYGGTFGGPIRRNKIFIFGNYQGRRTHQAISRNRTVPTDLAKTGIFQYVVGGVTQQYNVLNADPLRKGIDPTIASLLKNYPSPNNNDVGDGLNYAGYRFNNPNNSLEDQFTIKADYNLKDNMHVFFRQSWQRNSSIDSLNSADASFPGQPQGTQGGRRWGIAGGWDWTISSSMVNEARYGHQSATSSFNRPARVAGPMYTFNTWTNPILTNFAQGRNSPVNEYTDNLTKIHGNHTIKIGGNVRFTEQWGTNDAGIYPNESLSTASAGNSPPTSANPSGVTGTALTIFQGMYNNLLGRVGSIAQTYYSDLSTWQAAGTPRVRSFAFHEYGFFLQDDWKVSPRLTLNLGLRYDFTGVPSEANGLAGALDQAAKLNTISQIDNFTIKKGQAWYKNDWNNFAPRFGFAWDPNGDGKTAIRGNYGIFYDRNIGSTSSSVDSGTPGFSSALTVFPNQAAGSDMRIANGPTPPAQPAAPVLTPAANRSISSITVFDPNLRTGYVEMWGLNVQREVAKGTVLTAGYVGNRGLKLFFNQDLNQVRMSSGFISDVKDLANNLNTLGNVSANNVLVKIFGSASAAASAVGTSNLQTNQIRNITDALDQSNNSKYAAAGLSQYYMRNYPQFFQLYFGTNAGLSWYNSAQLTLRHQSKSVRFSANYTFSKSLDNTGAEGNGSTDPIDSFNLGLNKGRSDFDRAHVFNLQSSYTLPVGKGHAFGGNMPRWANTLVGGWDLGGLMIWESGAAITAGSGRYTNVSYNTASWLNYTGTRDIGSVSRQVANYDGVYFFDPNTNFAKFAYPGMADYGNAGRNTFRGPHFFNVDASLVKTFAITERKLVRFRAEAYNLFNNVNFGNPSFSLTNASSFGKISGVVSNPRLLQGALRFEW

SEQ ID NO: 9917 - protein, 753 aa, Shigella boydii
MNVIKLAIGSGILLLSCGAYSQSISEKTNSDKKGAAEFSPLSVSVGKTTSEQEALEKTGATSSRTTDKNLQSLDATMRSMPGTYTQIDPGQGAISVNIRGMSGFGRVNTMVDGITQSFYGTSTSGTTAHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNELEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMAEVIGNDWEGISDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 9918 - protein, 1102 aa, Shigella boydii
MNQIHKFFCNMTQCSQGGAGELPTVKEKTCKLSFSPFVVGASLLLGGPIAFAIPLSGTQELHFSEDNYEKLLTPVDGLSPLGAGEDGMDAWYITSSNPSHASRTKLRINSDIMISAGHGGAGDNNDGNSCGGNGGDSITGSDLSIINQGMILGGNGGSGADHNGDGGEAVTGDNLFIINGEIISGGHGGDSYSDSDGGNGGDAVTGVNLPIINKGTISGGNGGNNYGEGDGGNGGDAITGSSLSVINKGTFAGGNGGAAYGYGYDGYGGNAITGDNLSIINNGAILGGNGGHWGDAINGSNMTIANSGYIISGKEDDGTQNVVGNAIHITGGNNSLILHEGSVITGDVQVNNSSILKIINNDYTGTTPTIEGDLCAGDCTTVSLSGNKFTVSGDVSFGENSSLNLAGISSLEASGNMSFGNNVKVEAIINNWAQKDYKLLSADKGITGFSVSNISIINPLLTTGAIDYTKSYISDQNKLIYGLSWNDTDGDSHGEFNLKENAELTVSTILADNLSHHNINSWDGKSLTKSGEGTLILAEKNTYSGFTNINAGILKMGTVEAMTRTAGVIVNKGATLNFSGMNQTVNTLLNSGTVLINNINAPFLPDPVIVTGNMTLEKNGHVILNNSSSNVGQTYVQKGNWHGKGGILSLGAVLGNDNSKTDRLEIAGHASGITYVAVTNEGGSGDKTLEGVQIISTDSSDKNAFIQKGRIVAGSYDYRLKQGTVSGLNTNKWYLTSQMDNQESKQMSNQESTQMSSRRASSQLVSSLNLGEGSIHTWRPEAGSYIANLIAMNTMFSPSLYDRHGSTIVDPTTGQLSETTMWIRTVGGHNEHNLADRQLKTTANRMVYQIGGDILKTNFTDHDGLHVGIMGAYGYQDSKTHNKYTSYSSRGTVSGYTAGLYSSWFQNEKERTGLYMDAWLQYGWFNNTVKGDGLTGEKYSSKGITGALEAGYIYPTIRWTAHNNIDNALYLNPQVQITRHGVKANDYIEHNGTMVTSSGVNNIQAKLGLRTSLISQSCIDKETLRKFEPFLEVNWKWSSKQYGVIMNGMSNHQIGNRNVIELKTGVGGRLADNLSIWGNVSQQLGNNSYRDTQGILGVKYTF

SEQ ID NO: 9919 - protein, 326 aa, Shigella boydii
MDISTKKVEFSMKLKFLVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGNRNKKGAHPSGERTIDYKQLFKIPYIGLTANYRHENFEFGAELKYSGWVRSSDTDKHYQTETIFKDEIKNQNYCSVAANIGYYVTPSAKFYIEGSRNYISNKKGDTSLYEQSTNISGTIKNSASIEYIGFLTSAGIKYIF

SEQ ID NO: 9920 - protein, 749 aa, Shigella boydii
MNKKIHSLALLVNLGIYGVAMPALADDTAASAQHEDTMVITAAEQNLQAPGVSTITADEIRKNPPARDVAEIIRTMPGVNLTGNSTSGQRGNNRQIDIRGMGPENTLILIDGKPVTSRNSIRLGWRGERDTRGDTGWVPPEMIERIEVIRGPAAARYGNGAAGGVVNIITKKFDDQWHGSWNTYLNAPEHKDEGSTKRTNFSLSGPLGGDFSFRMFGNLDKTQADAWDINQGHQSDRTGAYADTLPAGREGVENKDINGVVRWDFAPMQSLEFEAGYSRQNNLYAGDTQNTNNDNSSSGLVKKNYGKETNRIYRQNFAVTWNGGWDNGITTSNWAQYEHTRNSRLGEGLAGGLEGLFNSNKFTDTDLADVMLHSEINLPIDFLVNQNLTLGTEWNQQRMKDSTSNTQAQQGGTIPGMSDDRSPYSSAEIFSLFAENNMELTDSTMLTPALRFDHHTIVGNNWSPSLNLSQGLGDDFTLKMGIARAYKAPSLYQTNPNYLLYSKGQGCYASSDGVGCYMMGNDDLKAETSINKEIGLEWKHDGWLAGVTWFRNDYRDKIEAGYAPIGQTSTSKVTTDIYQWENVPKAVVEGLEGSLNVPVSDTINWTNNITYMLQSKNKETGDRLSIIPEYTLNSTLSWQVRQDVSLQSTFTWYGKQQPKKYNYKGQPVTGSEKDEVSPYSIVGLSATWDVTKNVSLTGGVDNVFDKRQWRAGNAQTTGNATTGAYMYGAGAYTYNEPGRTWYMSVNTHF

SEQ ID NO: 9921 - protein, 159 aa, Shigella boydii
  misc_feature (145)..(145): Xaa can be any naturally occurring amino acid
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPXWRGQVIFSQLVKRC

SEQ ID NO: 9922 - protein, 368 aa, Shigella boydii
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSTYVDYKINLLDDNQFTRDAGINTDNIVALGLVYQF

SEQ ID NO: 9923 - protein, 662 aa, Shigella boydii
MSDAAPITVVVQGAAPPRSASESVRGQAEIRAAPHRTASDVLQLVPGVFTSQHSGECKAHQIFFRGFDAVHGQDLEIWVAGAPVNEVSNVHGQGYTDLHFVMPEVIGELRAQPGSYDPRQGDFAVAGTMRFDLAYGEPGITATASAGSFGARRLFLAYHPENADDATFAAFEAYGTDGFGPARAAGRASLIAQAVYRPLAGVSARVMASAFASRCGSAGVLRLCDIESGKVDRFASYDPDQGGDSSRAQLVVDLRGSGDDAARGEGLSLTPFVVLRALRLRSNFTGYLADPTNGDATQQLNEAITAGATASYRLTFPLLSDRDTFEAGVVARTDWIEQSQRRLAAVDDRPTATLVDAKVRATDIAGYLDASIRPARRITLRGGLRADGLAYQVVDNLGQGAQARSAQGVHVGGKGTVDVALLPGLRALASVGQGFRSPQARSLGDGERTPFTRVLSAEAGLRYADELVRASAALFHTRLSEDLVFDEATARNEPVPATARTGVALDAVAHPAPWLVSSVGLTYTRAAFTASGGRYAAGDLLPFVPQVVARADLAVTPRLGALFGRRLEARAGAGVTLLHGRPLPFGELGHDALVTDVTAHVRYHRVELGLDVYNLLDAAWFDGEFVYPSSFTRGAAPDLLPARHVTVGAPRSFLASLSLYIG

SEQ ID NO: 9924 - protein, 199 aa, Shigella boydii
MRKLCAVILSAVVWQVAAATPASAAEHQSTLSAGYLHASTNVPGSDDLNGINVKYRYEFMDALGLITSFSYANAEDEQKTRYSDTRWHEDSVRNRWFSVMAGPSVRVNEWFSAYAMAGVAYSRVSTFYGDYLRVTDNKGKTHDVLTGSDDGRHSNTSLAWGAGVQFNPTESVTIDLAYEGSGSGDWRSDAFIVGIGYRF

SEQ ID NO: 9925 - protein, 696 aa, Shigella boydii
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 9926 - protein, 69 aa, Shigella boydii
MSGDSGGQSTGYKDSDRLNYIEIGTWYYFNKNMNIYTAYQINLLDKSDYVLAHGLNTDDQLAVGIVYQF

SEQ ID NO: 9927 - protein, 446 aa, Shigella boydii
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRITLGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 9928 - protein, 732 aa, Shigella boydii
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLSLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYCPGYGPASLYDYKGRGRTFGLNYSVLF

SEQ ID NO: 9929 - protein, 736 aa, Shigella boydii
MAGVACLVPYATMRSQYVMRDTTLMSRLTVLAAACGLFATSATPPVLAADPAPPASTPIQRLPAVQVDAARVRGVDDFDLPASFTVVSADDDNRRGAQVSELLDGIPGLVARDRQNYAQDTQLSIRGFGARSTFGVRGVRLLVDGIPASMPDGQGQLSHFNVLGAERVEVLRGPFSALYGNSSGGVLQLWSADGAPNDPWRLRATYGSNATVDVGTQLLGQQGAVHYNLAANHFETDGVRDHSRAKRDSVNAKLGFDLAEGSRLDLVLNYLDAPDAQDPLGLTRAQFNADPAHATSVATQFNTRKSVRQSQAGAIFTQQFDNQALRLMAYDGQRSVEQFLAIPLAVQRNPLHSGGVIDLDSNYEGADARWAWQGEALGRPLQLTVGTNVDRQRQHRTGYENFVGDILGVKGALRRNQRDEVQNVDQFAQLWWQWSERWSALLGVRHSDVRFASDDHYTVGRNPDDSGQREYSATTPVAGIVFRADEDLRFYASLGRGFETPTFNELGYRSDGGAGLALDLGAATSRNVEVGSKWRAQSGAAVEFALFRADTDDELAVASNTNGRSTYRNIRATRRQGAELSWHQPIGATQQLQLAYTFVDATVRDGYLTCASSGCATPTVPVANGARLPGVPRQQLFARWQWQPAQWRFAAESVASGATVVNDLATERAPGDALVNLEASRRWTTTLGALRTFARVDNVLDRQYVGSVIVNDGNGRYYEPGPDRTYTVGLQWDFGG

SEQ ID NO: 9930 - protein, 1300 aa, Shigella boydii
MNKIYSLKYSHITGGLIAVSELSGRVSSRTTGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKFSYKVDMSGAQVATIENGKLTGTGSDTTDIKNKDLIFTGGGDILLKSSFDNGAGGLVFNDKKTYRVNGDDFTFKGAGVDTRNGSTVEWNIRSDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENHRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSIGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTSDISVSGNLSMTGNPDKDNKFEPSIYLNDASYLLTDDSARLVAKNKASVVGDIHSTKSASIMFGHDESDLSQLSDRTSKGLALGFLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKTTPEKQLNIELVSAPKDTNKNVFKASKQTIGFSNVTPVITTQETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEVGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 9931 - protein, 377 aa, Shigella boydii
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLINGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 9932 - protein, 700 aa, Shigella boydii
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 9933 - protein, 790 aa, Shigella boydii
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKFKRFNADDSSVKLGYRTTRSDWLTSHINENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGMAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHISQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 9934 - protein, 747 aa, Shigella boydii
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPMKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 9935 - protein, 85 aa, Shigella boydii
MKKSTLALVVMGIVASASVQAAEIYNKDGNKLDVYGKVKAMHYMSDNDSKDGDQSYIRFGFKGETQINDLDWPPESPDNQYHLNK

SEQ ID NO: 9936 - protein, 1931 aa, Shigella boydii
MNSAWPDNYGATGGMGEGGAAGSIRTGGSQGTSSQGGAGIIGANIAVINNGTITGGIGGTGGLNAGVQNDAVTFQSGINSLTLTTKSVINGVVSANGNDDTLTLQNTLSKIDGGQSDGANISATQYKGFEHLVVNGGRWTVSGSAIVSGETTLNGGALVVTGPAALGVQAITAQGGAIEASGDQVLDQSFVLKNNPYGASTSGLVVQGADNLVLSGVLSDVGRLTKNGSGTLTLTADNTYTGGTVFAGGVVSVDKEVRLGGGDLTFNGGTLQVTGTGWTSTSRAVSLQAGGGTFDIENAANNFAVTQGVAGAGGLTKSGSGTLTLSGANSYTGATTVSAGTLVVANDNTGGGTTTVDVGAGLQIGTGGVSGSLAGDIVNNGTLVVDRSNAFDLANVISGTGSLTKNGAGTLTLSGVNSYTGGTTVSAGTLAVRADNNLGDASGGLAINGGATLQLTDNLTTARGVTLGAGTATITIDGGKTAQFSNKLTGSGTLAVSGSGTLILSAANDYSGNTTIASGSTLQLGDGSTDGRLAGNVANAGTLTFHNKGGTTFAGEISGTGSLVQNGAGALTLSGDSQGFAGTTTVSSGSLLVSGKLGGTVTVNSGATLDGSGEIGGNTTVNGTLEGASGNGLTFKGDLKLGSGSIINASFDHPGGARIFDVTGDIALDGTVNVSSFGTGGPGLYHLFHYAGTSSGSGLTLGSLPGGVSVDKVYINQQVNDIYVVNTTGATLNYWNGTQSRPQGDGLLHGGNGTWTAATGNFNWTNSPSYDLNGAWDNGAFAVFGGGKGLVTVDTSAGAISASGMQFITTGYKLSGDKLTLVPTTSNPSAKPLIRVGSGSPGDSALIAIISTELTGTHGLEKADGGTLILTGANTYTGGTAISGGTLQLGDGATNGSVQGAISTGADAAHKGVLAIRAAAGTPATIGNTISGTGSVSVLGGTVTFSVANSYTGGTTLAGGTTIVTADANLGAVGTNVALNNGATLRFGANLDATHSFTHAFQLGTVASDVGTLDTDGHDVAMSGVISGAGGLMKSGTGTVTLSGANSYTGGTKVSAGTLVVANDNTGGGTTTVDAGAGLQIGTGGTSGSLAGDIANNGALVVNRSDALNLAGAISGTGSLTKNGAGTVTLSGANSYTGGTKVSAGTLVVANDNTGGGTMTVDVGALLQIGTGGTSGSLAGDIANDGTLVVDRSDAIGLSGAISGAGGLTKNGAGTLTLSGANSYTGATTVSAGILTLTGDNTGGGTTTVDARAELHIGTGGASGSLAGNIVNDGALVVDRSGVIGLSGVISGTGGLMKSGTGTVTLSGVNTYTGGTTLTAGTLAAASDNNLGGASGGLTFNGGTLQVMGTSWTSTNRAVSLQAGGGTFDIEDAANNFAVTQGVAGAGGLTKSGSGTLTLSGANSYTGATTVSASTLVVANDNTGGGTTTVDVGAGLQIGTGGVSGSLAGDIVNNGTLVVDRSNAFDLANVISGTGSLTKNGAGTLTLSGVNSYTGGTTVSAGILTLTGDNTGGGTTTVDAGAVLQIGTGGTSGNLAGDIANNGALVVNRSDALNLANAISGAGSLMKSGAGTLTLSGANSYTGATTVSAGTLTQGAAGGFSTASSRYDVDTDGTLDLGGFDTMLAALYNAGTINMNVGAAGSTLMVNGDYVGHDGTIVFNTVLGDDNSKTDKLMVGGDTAGNTNVQVVNRDGLGAQTVKGIEIITVGGQSNGVFSLVSDYRTKDGQKAVVGGAYAYTLHQGPARGANDGDWYLISQLEDIKPDNPATRRVSDTPDAPDTPAPRYSANVPVYEGYVQTMQALNKPSTLQERVGKRYMTGENGDGRTSGGMVDAHGIWARIQGAHDRLEPTTLTGMKQEINTFILQAGVDGQFYEDENGKLIAGITGQYDTVLHAAILWRGMVMAVSPPMPGASALQPPGLVMTGSMSTPRVR

SEQ ID NO: 9937 - protein, 456 aa, Shigella boydii
MKKTLLAAALLSVTVSQSMAANDLESAFKESKVMGQLRAFYIDRDYDVVNSKNDRSAFAIGGKFGFETAAVNGLKFGIMAYTTNGINTNRESWRNNPPYNGNPHMDPSLFGKDRKSVTYIGQLYLDYKYQNTAVKIGRQEINTPMAGMDDARMLPNLFEGALITNKDIPKTTIIAGHFWNMAYGTFANAYSACSNLGLQSGYGCGGYTTPNQGLAKYDTGNFLNMGKQAIGKANAGVSVIAAIYEGIPNLKLQAWDYYAWDMLNILYLQGDYTLKLSDVKTTLSAQYINETNVGNNIKNIFGKEVGANLFGAKVNFNVPVPVVENFNLYAAYSQTGKDEGKLLNGGLITPWGGTPGFVQGTVTRLGYVADTSAWKVGTSFDIIKGLNLHLAYSYFNVGSKAQYYNRTHDASETNWDLTWKCRLIKNLELKARGIYTWNFVPGQNFTEYRLIANYNF

SEQ ID NO: 9938 - protein, 729 aa, Shigella boydii
MLSTQFNRDNQYQAITKPSLLAGCIALALLPSAAFAAPATEETVIVEGSATAPDDGENDYSVTSTSAGTKMQMTQLDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPSFDYVGGTGWNSGKRKVDALDLFADGSYELFGRQHNLVFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNMEGSIVYGAPRNFSITGTYQF

SEQ ID NO: 9939 - protein, 252 aa, Escherichia coli 53638
MNVIGRTDSRFGPRLTNDLYPEYTVAGRKDWFDFYGYVDLPKFFGVGSHYDVGIWDEGSPLFTEIEPRFSIDKLTGLNLAFGPFKEWFIANNYVYDMGDNQSSRQSTWYMGLGTDIDTGLPIKLSANIYAKYQWQNYGAANENEWDGYRFKIKYSIPLTNLFGGRLVYNSFTNFDFGSDLADKSHNNKRTSNAIASSHILSLLYEHWKFAFTLRYFHNGGQWNAGEKVNFGDGPFELKNTGWGTYTTIGYQF

SEQ ID NO: 9940 - protein, 386 aa, Escherichia coli 53638
MSHTIRHAARLALPLLLGLPAAAMARSGVTLYGVIDTALTYQTHSNPAGDAQIGLQQGGEGFLSGSRFGLKGTEDLGGGVKAGFVLENGFLADTGRLDQQGQLFGRQAYVKIGNQWGDLALGRQYTTANTMLYYVDPLGVGAAPSNSWMVYLTGQRYDNAVSYTGNFGPVSVIAEYALGETPGNSKATSSMSLGLKYAAGPITAIGDFQQTRDSQSRAARIYMAGLKAAVGRANLFANYIYSDRDAAFDSSKGGTDTATITSMSTAATATNRAAINSVFGSSRRDDFFTLGANYAVPGNVTLTASMMHNRTRADNFSGNRTTAYGVAGYAFSKRTDAYLAVAYDWVRGGWSGLFGNNTTNWTGGSGKPLDGRDNQTTVMAGLRHQF

SEQ ID NO: 9941 - protein, 727 aa, Ralstonia pickettii
MIPFQPRKLVMALAAVLPSVASVSALAQEATPPAAAPSTPATTAPATNVRDLSETRVTAKRLDAARNALSPDTGSSVYKFDTDDIDRLPLGDATPLNQVLLQAPGVVQDSYGQLHVRGDHSNLQYRINGVIVPEPISGFGQMLDTRFANQINVLTGALPAQYGYRTAGIVDITTKGASTDEDGEPKAFGGEIGTVLGSNATHEVNAQIQGTKDRFSYYLSGVFAENNMGIENPTGNRNATHDHTTQNKSFGMLSYLLDSDSRVSFMFGTSNGRFQIPTRPGLAPKFTLDGAVPPASEALNANQREKTDFQILTYQQKVSPKLDYQVSVFRRASRIDYMPDPIGDLVYNGVAADITRRNEAYGLQGDASYKLTDKHTLRAGVFVQRERYVADNTASVFAADSSGAQTSTTPFTIVDNHSGSGTTLGVYLQDEWKPTDKLTVNYGARYDRVNTIVSEQQLSPRLGLTYDLTPRTRVHAGYARYFTPPPTEKFDTTSVQAFAGTTNALPSDANTAVKSERSNYFDLGISHQLTPHLTLGLDAYYRDVRHLQDEGQFGNALLYSAFNYERGRIYGLEGSANYRNGNFGAYLNLAVSRAQGKGIETGQFNFGADELAYINNHWVNLDHDQRLTASAGVSYRYSGTTYTSDVLFGTGLRNGFANTEHLPAYWQMNLGAARDFTLPTLGKFKTRLTVLNIFDRSYQLRDGTGIGVGAPQFAPRRTFLLSVSKPF

SEQ ID NO: 9942 - protein, 714 aa, Ralstonia pickettii
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 9943 - protein, 527 aa, Ralstonia pickettii
MRVLSKVLSVRTSLIALAMAMAVVGRADLAHAETLAEAITAAYQSNPNIQAQRAAMRALDENYTQARSAYGLQASASVAEVYGWSKGVNAKNGVEAASQTSTLSLSQSLYTNGRFSARLAGVEAQIKAARENLRRIEMDLLVRVTNAYISVRRDREILRISQGGEAWLQKQLKDTEDKYSVRQVTLTDVQQAKARLASASTQVANAQAQLNVSVAFYASLVGRQPETLEPEPDIDGLPTTLDEAFNQAEQANPVLLAAGYTEKASRAGVAEARAQRLFSVGARADYRNGSSTPYYARGGLREDTVNASITLTQPLFTSGQLNASVRQSIEENNRDKLLMEDARRSMVLSVSQYWDSLVAARKSLVSLEEEMKANTIAFYGVREEERFALRSTIEVLNAQAELQNAQINFVRGRANEYVGRLHLLAQVGTLEVGNLAPGVQPYDPERNFRKVRYRGALPTELIIGTFDKIALPLEPKKPAPGDTSPIRPPSSELPARPVSADKVTPPASMNDLPALTDDTPVQTAPRN

SEQ ID NO: 9944 - protein, 702 aa, Ralstonia pickettii
MNRHLAARAFSCALAAIPLAVSTLAHAEAGQPAAGSATLHLNEATVTAGSQRGFAASTAQVGAFRGMALRDIPATVNVVTREALDAQQDTSLYDALRNTAGVTRQQLSGETFDNLAIRGVTLENRTNFRFNGSMPMAALTAIPLEDKERVEVLKGVSALYYGYTTPGGVVNLVTKRAGNTPVMTLGMQFDSNGSVVGTLDVGRRFGEDNQYGLRFNAAGGSLQSPTSGIDGTRQLAAVAFDWKVSSRLSLKADVEYSRKVITEQSVVTLPAAKNGVITLPAMPDPAKRIAPGWADFDGNNTNALLRADYTLADAWLLTVEGGVSETARTRAFSEFRLTNTLTGAGMLSGQRQSGRWNTSHVRVDVSGTEKTGWITHDLTFGVARSDMRQAAVYSDRFSGAQNLYNPVDLGWLPTTGTGFTAEQRAVDSGVYALDRMTLSEHWQVIAGLRYTRYTSEQAPNRYEASKTTPLGAVIYKFTPTLSAYASYAQGLEAGARAPNTAANANVAMPPALSEQKELGLRYETPAGTQLAAAVYDIDRAASYTNDANIFVQDGRERIRGIELTAQGRVTQDLSLLASAGWTDAKFRGVGNGLDAKTPENTPRSTASIFAEYTLPMLRAVSFNAGAYYLGPRPVNDANQAELGGTTLFSAGVHYVTRISGKRATLQFNVDNLTDKRYWAGAGNNRLSMGAPRLFKLGMKIDL

SEQ ID NO: 9945 - protein, 356 aa, Ralstonia pickettii
MQSKFKRGMAALAVASALGAASAGAQAQSSVTLYGQVDAWAGATKSLGASDRAWGVNSGGMSTSYWGMKGSEDLGNGLKAIFTLEAFFRPDTGKYGRFDGDTFFARNSFVGLQSSTWGSIKLGRLTPPYFVSTILFNPFIDSYTFSPMVFHTYLGNGLSGPGGISGLVGDSGWNNAIMYSTPDFNGLTANFIYGAGEQAGHNGQNKWGGNFLYFHGNFAATAAFQQVRFDSAPGDLNALVAGFSRQTAAQLGATYDFGVVKLYGQYQYIKNAINSGDAKSNGGQLGVSVPVGPGSILASYAYTKTSGAADVKRNTWAVGYDYSLSKRTDVYAAYMRDKVTNLSSADTFGVGIRAKF

SEQ ID NO: 9946 - protein, 457 aa, Ralstonia pickettii
MKQLTLTPLAITTSTPTLAQENPQSQDYLPLTLKSTSQQAQATGFIEGKSLDRNTRNYYANQHTQRDTHRKNNKNDGNHHTHSRENWVQTTILKYSSGYTQGTIGIAVDAARYNAINLQHSHEPIANPNNRTLTHSDGDPLPNWSKLGIGNINPRLSNTKLNPGRQTTDNPMIPYNDNRALPSSFQGAGLHSHETDNLTIHPGTFDRATPRTENSSKNLTTNYSNTADKTDRTSNPGTNEKPGKSLKTSLYATNVENIWNQYYLGPNHRPGDKTRLTLNTALNYYNTRDHGNQKMGNIDNDTYSLALTRTHQAHTLTPAWQQVNGNEYFDYIHETNGNYMANSLHSDYNGPNEKSRQLPYDLNMAPYGVPGLNANLYNANGWGIDGTHYHGNAYNVNGLDGENHNENGISTTYAVQTGPLKDTSIRTTDNNHRASNAQSDGSQDEFRLVTNIPFNML

SEQ ID NO: 9947 - protein, 998 aa, Ralstonia pickettii
MRGTVIDETGEPVPGATVMIKGTQVGTVTDIDGVFNIEASPGNVLVFSFIGYTPSEVTVEAGKTNYDVTIESSMSDLSEVVVVGYGSQIKKEVTGAIQTISEDELKDMPVTTTAQKLQGKLAGVQINQTTGKPGQGMNVRIRGQLSVSGGSDPLYVVDGFPITGDINTLNPDEIQDITILKDAASTSLYGSRAANGVVLITTKKGKVGQTNVNLNVYTGFQKVPENGRLEMLNAEEFAQFKKEYYEDAGQQVPAIFQNPSDFRDKNNDWYGAMLETAPITNYNLTITSNKEKVNTAIVAGVFDQKGVVRNTDYERYSIRMNTDYTVSDKVSIGLNVAPSYIVDNTPQTDGSRGTGILFNALHTWPVMDIYDENGDLTYFNRFPAETGNIFAYPNWLRSADEITNQTKRVNILANTYAEWRPIKGLSLKSTFNTEIRNSNYFFFNPSTATNRINVSIPTVAVSIRDNYRDLSWLNENIATYTNNIGDHNFEVLAGFSNQKFRRDRTRIQADTYADDRLPTIQGAININRGGTLSDVDEWSLTSIFSRLTYNYKGKYLFTAAVRGDGSSRFGEDNRWGIFPSTSVGWVLSDESFLNTSSTVSFLKLRASFGVTGNNNIGNYTQYALVNNTINAAFDNNVVPGAAVTSLSNTNLGWETTAQFDIGLDLGLWDDRVTFGYDYYTKNTTNLLYAVQVPQESGFTNFNDNIGEIKFWGHEFTINTVNTTGQFRWTTNANLSINRNEVLELADGIDRVYGYAHITQVGQPFGQFYGLQKLGNYANAEDLANSPVIPGRSTVGSIKLADINGDGVITYGGDNDDRTIIGNPFPDFVYGFTNNFKWKNWDASIVASGSHGNQLYMRHLYSTANLDGVFNMVAKVADRFRSPENPGEGIFGTTVGGGNVTGIERDWPNSNFVWDASYFTIRNITVGYNFTNLPKAIKSARLYASGQNMWVFTKYWGGSNPEVSMQNNGQGDGGNLSPGIDLAGYPVPRTITFGVNITF

SEQ ID NO: 9948 - protein, 873 aa, Ralstonia pickettii
MHSPISRSEKSTSRVRNAAPCLAGGVAALTAAGLYSPAFAEDQIVAVALPTAEVVGSTPIDSIGVPLSQFPANAQRVSAKDAREQRNSNLADLLNDNLGQVSISNGSGNPYQNDINYRGFQVSSLLGVPIGVSVYFDGVRMNEPFGSIVNWDLIPMNAMSSVNILPGSNPMFGLNTLGGALVVNTKNGKDNAGTSIEALGGSFGRRALSFETGIVDKAHSTDYFVAGNFDRQDGFRDHSGSNVKQLYGKARWHGNDGATQLELSAALADTSLSGTQSLPMDMMANRSAAYTWPDTISNRMALLNLKGSHWLNDTNQLAGSVYYRKASLHNVNSNAQLDDGCFNDDGSLATTAAGGTTTYKCANKAPNGTAVNAVTGANALALGYGRWTNAINTSVVDSATHEGTVGSSLQWSNFSQLAGHDNTFTFGGAFDHSRITYDQTTYLARLINYQTVVSPNQTYGFTANGSAPSTSNPALFTGSNVIGAVNLSSNVNNFSLYFTDTLSVTEKLSVTASGSFNYTTLNQGGANNKYLNEDGGYSWTDQVSGVSYHNPGYANAYRYSNAGSGAATAPNGVPPGAVAGPETNSLAGSHRYRRFNPALGFNYDLGAGQGIFGSYSESMRAPTSIELSCADPNSPCSLPTGFNGDPDLKAVVAKTIEFGGRGKLGKSTYWSAAVYDSRLSNDIQFIATSNTYGYFANVSKTERRGMELGASTKIDKWSLSANFGYVDAIYKSAFTTASGQHVVSGNKIPGIPAKTLKLGASYAFSPNLSMGGNVILVSKQIAHGNESNADPNGEVPGYGLVNLNLHYKPTKHLEISAYISNLFNKRYSTYGLSGMRSIYTLAKQQFMTPAPPRAIWIGLTYSFGGKAAGADAD

SEQ ID NO: 9949 - protein, 862 aa, Ralstonia pickettii
MPSLLCGARDSSVALCILLALCRVQVVKAADRVEFNTDVLDVKDRARIDLSQFSHAGYIMQGSYQMVLRLNKNELPEQTVQFIAPDHDPKGSEACLTPKMVDQLGLKADAIRQLTWWYNGQCLEIASLKGMEVRGDLGAGALYISMPQAYLEYTVENWDPPSRWDNGISGMLFDYSVNAQVTNQSGAGSQAQSLSGNGTAGANLGPWRLRADWQVQYSHTTGQVGSAQQSWEWSRYYAYRVIAALRAKLTLAEDYLNSGMFDSFRYIGASLISDDNMLPPNLRGYAPEVTGVAKTNAKVTISQQGRVIYETQVAAGPFSIQDLNTAVNGKLDVKVQEQDGSVQTFQVNTANVPYLTRPGMVRYKIAAGKPSDIKHRSKGPGFATGEFSWGVNNGWSLYGGALLARGYNALAIGIGRDLLAFGALSFDITQSRAQLLHDDTKHGGSYRVSYSKRFDEYDSQITFAGYRFSERNFMSMSQYLEARYYGVNNGRGKEFYTITFNKQFKELGLSVYLNYGHQTYWDRPNNDTYNLSLSRYFDIGRFKNISLSLTAYRTQYNGTNDDGLYLSMAVPWGENSTITYDGQLSRNSSNTVGYYDRIDDNNAYRINVGNGQGGRSIGSGYFTHEGDIAKLTANANFRGSEYSAMGLSLQGGMTATADGAALHRINMIGGTRMMIDADGIGGVPIRGYGSVTHTNIFGKAVVSDINSYYRSSVNVDVNQLADNVDATRSVVQGTLTEGAIGYRKFGMIAGEKAMAIIKLTDGTAPPFGAIVMNEREMQTGIVNDEGSVWLTGINPGENMSVHWDGRIQCLITLPQSLLANLMNNLLLPCRRVKGNDGSDAVETVVTPANTGNVARIGGENGR

SEQ ID NO: 9950 - protein, 471 aa, Ralstonia pickettii
MRALAGLLCGLLGLVPGAAAYEPDVFGTTGQVAGQAVYDLGGSGLPCRGGPPPTELSLEEAIERILCHDPQTRLAWANAKAQAAQVGIGKSAYLPRLDGRLDASRGYSDMDYRDAPYLSGDGHRHRRGASLQLSWVLFDFGRRSAALRNAQQLLLAANASQDATLQNTFALAAQAYYDALAAQRSLAASRQVAELAAQNLEAADAKYRAGAAALSDRLQAQTALSQASLAQVRDEGALSNALGVIALRMGLAPDTPLRLSGELEAQPDTGFVKAIDEMLAEARREHPALLAAQARLKAAAASVEESRAAGRPSLALSANLARSHSDQAMAFNGDTRERDRSIGLQLNIPLFEGFERTYQVRNALARREASEAELADTEQQVSLEVWNNYQSLSVETRSLARTRELVEQSRQSLEVVQGRYRSGVGSMIELLNALTAYASAEDQHIRALGNWQTSRLRLAASLGRLGFWSLR

SEQ ID NO: 9951 - protein, 498 aa, Ralstonia pickettii
MLFFPLIQHIWVAVRSLSVVRATVLSQVARRRSAQLSMAVLMSALACVAHAENTVLAETPPTSSAEDQNAVGSKSPASAEQAPAMPEAQWWNFHAQATHITQWHSKFRAPYAGANSLASDGESSETTDMTLFVGLRLWHGAELYANPEIDQGFGLSNTLGVAGFPSGGAYKVGNNTPYHKLPRLFLRQTINLGGESEPLESAANQLAGSRSADNITVTVGKFAVVDVFDTNSYAHDPRADFLNWSVIEAGAFDYAADAWGYTRGAAVEWTQSWWTVRGGFFALSTTPNSESIDVGFKQHEWVGEIEARHQLLGRPGKLKFLAFVNRGYMGRYDDAVSLAQQTGSTPDTSLVRQFASRRGVALNVEQELANDLGFFARASMNDGNKETFDFTDINQSVSAGLSMSGSCWGRSKDRLGVAFAVNGLSKAARQYFAAGGLGVLIGDGALNYGTERIAEIYYTWAVMPHVTAGLDYQYIVHPAYNRDRGPVSVVAARLHLDF

SEQ ID NO: 9952 - protein, 353 aa, Ralstonia pickettii
MNRTTAVRGMLACAAALAGWAAPAIAETNVTLYGRVATGVDYISNVAKSDGGTGALWRGAGNQWGTSMFGFKGSEDLGGGLQAIFRLESGFDAAKGRTNGDALFNRRAYAGLSSPAWGTLTMGKNLFISNDVWFLDPTGQQFIGSATLVRGRNWPGANNLIEYQSPTWGGFQVGLQTGLGEQPGSITASRRDGVSAVYSNALVELRAIYDVIRDGNGNYSDLYNFSKEWTLGGVLKLDAWKVYGAFQRLNAPDAAAGAPSAASHYWIGATYDITRALTLIGTVFRTDVNNGGGHATLFMAGANYNFSKRTLLYATYGRVQNSKNAAFSVEATDNRPLAGQGQNGAYAGIVHSF

SEQ ID NO: 9953 - protein, 693 aa, Ralstonia pickettii
MSAALMAFSALASSSVYAHDHHGEIEIISVMGTKQAQSTNSSAMKMDLSHLETPGSISVYNQDLIEAQGAVSLGEVLKNDASVSTGNVRRGRERFYMRGFVLEPDQSYLRDGQFHLSRYSQPIELYERIEVLKGPSALLYGKSTPGGMINLVTKRAQQEEFHFNFQQEFGSFGYNKSLLDLGGALNESGSVRARSILSRSSEDGWREYKDGSKATQERFVGALMLEADLSDDTVLSVNYDRTEDEGGIDMGPQHIKNEKSGKYELAGKRDYIWDMPWSLRDSSVENMGFTLNSYLNDDWTISAGFNRQRHQRQTTESLYGKVQGIDLGVGEYSLRGRDTYEQFDVVTGFFDFKGEFYTGDVHHRMLIGSSVVDYQKSGMQKKMKIADRVNINDAITIGKPEELDYRNGTALKQVQRKTYGVYIQDLIEFNDSWHLLAGVRLDREESKEATHNNILPKLAVMYHPTPNTTLYTTYSESFEPKDPVSNTEDTNYGKKLDAERGESFEVGAKGEFLDGSLYVSTAVFDIEKNNKAVTDKSGDNPITTQSGKVRHKGVEFSLEGQLSDNLSVLTSMMYLDGKIISDPIYAGKRSKDTPQFSACTWFNYRVGDKSQLSVGAIYVGERFGDTPNYFKKDAYVKVDMGFSHTIKFANEQQGIISINIDNLFDEDYLRGGCNNSAMFGSPRSVKVSFQYKF

SEQ ID NO: 9954 - protein, 116 aa, Ralstonia pickettii
MLFLPMLQDVRVAVRPRGRVRPQPCRRAAQLSLHARGARAMPEPDHLACRAAGGSGAFLGDGALNHAYARALEWFYSMQPEKGILLSPDVRLIQNPGDNRDRGPAKSVGLRVRAAF

SEQ ID NO: 9955 - protein, 817 aa, Ralstonia pickettii
MLFAPLVHSIRLLSGRVRYAVLSLLLLIVAATTFPAQAAENTLDTPDAAARKHYDIPAGPLGRTLSHFATIAGIALSFDPALTEGLTSPALTGNFSVSEGFNRLLANSDLELIRNADSSYTLRRAPIKAAQAGVTALPVVTVSTSTENADDTGYVAKRSSSGTKTDTPLIEVPQSISVVTRRELDMRSVQDMSEALRYTPGVVVDQWGFEGRGYEYLLLRGFQGLTTSLFRDGLSMAAQGLYFGSFITDTYGLERVDVLRGPTSVTFGRGDAGGIVNRITKRPSADPIREIELQYGNFDRKRIAADLGFANNDRSLMFRLVTLGLDSDTQVRYPNTGGDRAGLRRFYVAPSVTWHPTADTTVTLMGEVLNNRAEASPFFLTTPDGRHTDVVQTDSKFVKYATNQSSFSYQIEHNFNETFTARQNFRYMQQDGNFNDMFRAGFDADIPTLMQRSAMTTKERLTQTVLDTHLQAGLDTGPLNHTALLGVDWNRTNASLRFFSGEAPGIDVFNPIYGISVPVPDSLDIDAKQEIDQLGIYLQDQIRYGENWILTLSGRYDRVDTKDADFLSTTNTRNRDNAYTGRAGLTYLFSSGVAPYVSYSQSFLPLPGLDSSNRPFEPTRGTQYEVGVKYQPAGGRSLYTVAFFDLTKTNVPTPDPDDPFFRNRQTGEIGSRGVEVEARAELLRGLNFIGSFTYHDVTVTKSTDIDKDKMPIQVPHLMTSAWLDYSLGNLGVNWLRGFGIGGGVRYVGRIFNDLENTSTTPSYTLFDAMLRYDNGPWMFTINASNLFNNKYLSYNDPGWRAYPGLERTVLGTLKFRF

SEQ ID NO: 9956 - protein, 379 aa, Ralstonia pickettii
MKMKLFAAAVAALAAGGAYAQSSVTLYGVADVGVEWANKVPGADGQGHSRVAMQSGNLSGSRWGLRGVEDLGGGLKGIFNLESGFNLDTGTSAQSSRLFGRNAYVGLQGQWGQLTLGRQQNLLYDFALAYDPMAIAGRYSITAQDAFMAGRADNAIKYIGTFGGLSVSALYAFNRDGQEVAGVNKLGREWSLGANYAAGPFGLGVVYDQSNGTAASNASFAAQNAAADTKEQRATIAGSYAFGPAKLYAGYRWYHANFATVAGAGNLRSNLYWLGAGYQATPALTLTGTAYYQQFKNSGTGNPWLFVVGTDYALSKRTDAYFNVAYAKNSNGSTLGVAGINGASSGNATTLQSTDNQVLSNSTNTGNQFGAVVGIRHKF

SEQ ID NO: 9957 - protein, 1098 aa, Ralstonia pickettii
MKISRGVIVSAVWLAMLPVAAWAQFETATVLGTVKDGTGAVIVGSKVILENVKTGVISTGQSNDAGNFDFVAIQIGTYRLKAEMAGFKTGISSDFEVAVSARRRVDMTLEVGDVTQSVAVKDTVAMLETDSSDRGQVINNATVVNLPLNGRNYSDLALLAPGVRKSFLGMDPNNSNFREGSFNVNGQRSAFNNFQVDGVDNNAYNTSNQGYSNQAIQLSPDAVAEFKVQTDNFSAEYGRAGGAIINVSLKSGTNQFHGAAWEFLRNTDLNAVGYFKPANGKPVFQQNQFGGVFGGPVIKNKTFFFVDFEGLRRKTATLAYLTVPTADQRNGIFTTAIKNPYTGELYPDGVIPKSLITPFAAKVFSQLPAPTTGGTSNNYQALPNVPSVENKGDARVDQYFSSKLTAYFRYSRREFNQTDNPQIPLPLGSDSSNGFVNIINKQIAGGVTYTLSPTSLIEFRMGYTQSTGGKWPIQLGMPNMQDAYGIPGLPTDPSVSGGLNTQAIGGYLNLGRRSSTPQFQNPTVYNPKVNYTRMFAQHSLKLGYEYQHIDTAVLDFSPQYGQDSYSGQYSAPVGAASNNVYNVADFLLGARSAYSLTNVFTAQYRQRMNFFYVQDDWKVSKKLTVNLGVRYEYATPQWEDGNHLANFVPGQPAKMITASSGDIFNRALVHPDRNNWAPRLGLAYSLTPKTVIRSGYGISYIHFNRAGGENLLAYNPPSVITININNPDPSKSPICAQDVANSNCFRPTALGYTASILDPARIDYTNTSLRYTPPDTRTGYVQSWHFTVQQQMAKDLLLEVAYVGNHGVKLMTLGDVNQARPQAPNENSTLNSRRPYLGFGDVEISYGAGYDTYHALQAKVEKRFSGGFYFLNSFTFSKLIDNASGHLEANNGDNSRVNYLDPGYNKGVGSYNQPFSNTTTVVYSLPYGKGQKFGSHGNPVVTAILGGWQATFINTMSSGMPVNLNYGPASRYSVSGYPTYRPTLLGDPMAPEGQRNIDNYFNKANVIIPVDPLNPNPFGNAGRNTVRSYAIYQTDLGLHKDFFLKSEVRKLEFRSEFFNVLNKTNFQAPNSTSSSSAFGTIRSAFPARVIQMAMKLVF

SEQ ID NO: 9958 - protein, 224 aa, Ralstonia pickettii
MAFHRLAVVAVAAGMLAAGFSQAAFAQGTDLPPASGNWMVRLRAVNLTAANKSDPVPALAIPADAIQINNKVLPELDISYFFTPHLAAELILTYPQQQDVTVMRSALGGPTKIGSFRHLPPILTMQYHFTPESRFKPYVGAGINYTRISNVDLQVPGVGSLDLSKNSFGPALQVGFDYRLTERLYFNVDLKKTWISADVKMGGQTISKVKVDPWLLGVGLGYRF

SEQ ID NO: 9959 - protein, 1642 aa, Ralstonia pickettii
MNRVYRLVWSRSLRAPQVVSEHTKASHGGVDASHGATPARRCASIVSIGVSLGLAGAAVPAWAVTCAPSTIANCSAAGGSGTPDRSGNGGSGNGGGGGASTLSGPNTVQIPGGATSGGTGGTGAMNDSGQGGPGGAPAAALAGDVVINANVQGGAGQAFDGFNFAGGGGGGGAGVYSTGTSVTVNSGMTVQGGTGGNGGAGTSGPVSNGGGGGGGGAALVMVTPAADVSNQGTLIGGNGGNGGGGGFAGGGGGGGDGLLTLGSGSQVTNIGTIVGGVGGAGGGGASTAGASGAGVNLASGFTVLTNVGTITGGAGNGGAAGAGIIVNGTSVIVNGGTIAGGLYADGVTRAAAIQFNGTNNTLQLVTGSNIVGDIEVSAGAATKITAGSAGLTLSNQITLGDAASRVTFDSTTTNLVVSGVVSGAGGVAVSGSRTITLTGENTYTGGTTINAGTLQIGNGGTTGSVAGDIVNNGTLAFNRSDTVAYGGTISGTGSIVQAGSGTLAISGAAGYAGSTNINAGTLALIGAGSIAGSSGVVNNGTFDISATTAGAAINALTGSGTVALGGQTLTLANAAGTFGGTIGGTGGLTVAGGTQTLSGANGYAGATSINAGTLALSGAGSVAASSGIVNDGTFDISATTSGATINALTGSGTVALGGQTLTLANAAGTFGGTIGGSGGLTIAGGTQTLSGTNVYTGATSINAGTLALSGSGSVAVSGGVVNNGTFDISATTSGAAINALTGTGAVALGARTLTLTNAVGTFGGAINGSGGLTVAGGTQTLSGANGYTGATSINAGTLALTGSGSLAASSGIVNNGTFDISTTTSGAAINALTGTGTVALGGRTLTLANAAGTFGGAINGTGGLTVTGGTQTLSGANGYTGATSINAGTLALTGSGSLAASSGIVNDGTFDISGTTSGAAINALTGTGAVALGGRTLTLANAAGTFGGTINGSGGLTIAGGTQTLSGANGYTGATSINVGTLALTGSGSLVASSGVVNNGTFDISATTFGATINALTGTGTVSLGARTLTLANAAGTFGGTVNGTGGLTVAGGTQTLSGVNTYTGATMVDAGTLALSGAGQLASSTSVTLAGSTAALDLSAAGSQTVAHLSGVTGSRVVLGGSALTLSDDSSQTFGGSLVGTGGLVKQGAGTLTLNGVSTAFSGTTTVAGGTVAVGDAANAGAVLGGNVVVNALGTLRGHGTVAGDVSSSGVVAPGGSIGTLSVGGNYAQAASGTLSIEVSPTEASQLRVGGAATLGGSLAVLFDPGTYTARRYTVLSAANGVTGRFANIGATTAGANLGALQPSVDYGANAVDLLLAEPGGPGTPTGPTVIAPTKTSIYTALGTTALLQAQDASSTLLGRLAGPQDDPAGSRNVWAVASGSSTKVGGTGGAPGFLTHAYGFLAGAQGRLGGATVGGAGGYTHTTLGEDTTGASGTIDTLRVALYGAQPVGAVNLSATLGYGLDFLSQRRPFGSAGTAEGDHLGHEFTAATQASLPMEAGGFRFTPHVGLRYAYVRGSGFGESGANGQNLNVGPDNARSLQPYVGVSLDKAFGDAMRSLDVQLRVGYAHEVLRGSRVVQVQSQDGTVFAAPGTDLPRSFLTTGASVTLQAAKTTTVSLGFDATIDTSHVSAQSAYVRVNHRF

SEQ ID NO: 9960 - protein, 719 aa, Ralstonia pickettii
MTTSIKQHFLMLLAGNAAFAFLPVSTTYAQEANNTVRLDTVVVQTGNGRSDEGVAPVNGFVPTATTTGSKDSVAIEKIPQSVSVVGRKQMDAIGAQKLDEALRYTPGVLGQPFGVDNDTDWLYIRGFEATQYGTYLDGLQNFSYGFGGFLIDSFGIERIDVLRGASSALYGGSNPGGIVNYISKRPTDERLRYLETGINSYGNAYLGFDIGDKASDTVNYRVNGKIQGGDNYTDFAKEFRGVISPSIEYKPDEATKLIILGNYTHLDLTHDGGGFLPYYGTVVPTEFGKISRKRNFTEPDIDSYEREQASIGYEFEHQFDNDWTVRQNVRYGFSHVKEHTLYAYGYEGFLPQPAPGNPNIARINFRHDTTVNTFLADNQLEGTIETDALTHNLLFGVEYRYFRIEQMQQTGGATVIDGFNPIYGEPQGPMFDPYIDQDLRRHQIGIYAQDRVEFGDGWIATFNGRYDYVKTDAAGLPSYEYNKGKASGRAGLGYEFDNGITPYVSVATFFNPIIETLADGSYAQPETGTQYEVGVKYRPDLFDGLITASLFDLTKENALTGSSFAREQLGKVNSRGFELEVQANITDAWKVTASVTAYDLKIKENDSNPDIIGNRPYLLPEQQASVFVEYKVPDGAFQGVTLGGGVRYLGSSYADEENTLKVPAVALADLKLGYEKDNWGVDLNVTNLFDKSYVAGCQGIYVCGYGEGRKALLKVHTKW

SEQ ID NO: 9961 - protein, 376 aa, Ralstonia pickettii
MKKSAILVAVGALFAGSAYAQSSVTLYGIVDATIHYTTNANQAGNSLLRMDNGAVSNSRWGLKGSEDLGGGNKALFVLESGFDPDTGRVNSGGLFNRQSFVGLSNKDYGTLTMGRQYNFGFTMGGNFDPLGVGNYDENSWLYYGVTGLRVSNMLKYEGKWNGLYVGLGYGFGEQAGSTANNRYMGGAVSYEFGPALIGAFYQQQQDSTAAGNKQKVWGIGGNYTIGAAKLFAGYIDSSDNTGCVNSSTCAGDRSTFGLNLYNNASGPGLTPGATKRRDHIGLAGLTYQVTPALALTGAFYYDSISNAALDAGNDGKRYTGVLLAEYSLSKRTQVYGTVAYDKVKNAAIPEQPGGTGTGINAKTNQIGVGAGIRHIF

SEQ ID NO: 9962 - protein, 306 aa, Ralstonia pickettii
MNRTARRFAAAFACAAASTLAAPLAHAQSTAEANVAASASNGSGTSSGGGFSGFMDNYVWGRNVMALGWFYIRPMDSATPLTTTTSALGLGTYQSPGTDVKVSNANTLSLTFTHFFNDNIAGTFVGGVPPKFNLYGSGNVIAPVPVVGPLTLINLGLPQNNPVATVREWSPAIVAQYYFGTKESKLRPFVGAGVSYNFFTNLRLNSNFVNALQNLGQVLQLGMGQVPTGPAKVTAETSSSWTPVANVGVSYEFAKNWTAIGTVSYLPLKTTSTITIRSQQGQVLAVNKTDIKVDPIVFGLAVGYKF

SEQ ID NO: 9963 - protein, 386 aa, Ralstonia pickettii
MKIKLFAAAAAALVSAGAFAQSSVTMYGVVDAGVEWVNKAPNAARTEGNSRVGMQSGNMSGSRWGLRGVEDLGGGLKGVFNLESGFAIDDGRSAQGNRLFGRAAYVGLQGQWGQLTLGRQQNLLYDFALQYDPMAIASRYSIASQDAYLAGRADNAVKYVGTFGGLTASALYAFNRDGNEQAGMTKLGREWSAGLNYATGPFAVGAVYDQSNGASNAFFTNGFMADLKEQRATIGGTYAVGPAKFYAGYRWYKMSHDLGSTGVNGDLRSNLYWLGAGYQATPALTLTGTAYYQTFKNGELLGALASNDANTNVGNPWLFVVGADYALSKRTDAYMNVAYAKNSRSSILGVAGINGTSSNLSTLQSNQNQVFDGNQLGAVVGIRHKF

SEQ ID NO: 9964 - protein, 937 aa, Ralstonia pickettii
MHQAETISSQGFKELFEGYGNFNNTRNTAEIETLKQVTIRKGADSLKSGSGALGGSVSFDTKDARDYLLNKNYYASYKRGYNTADNQNLNTLTLAGRYKYFDAIAVLTSRKGHELENFGYKNYDERVQGKAREKADPYRRTLDSTLLKFAFQPTDNHRFSIIADLYKQTSKGHDFSYTLKPNTQYTRYGEKELRHTNDKVERKNIAFVYENFTETPFWDTLKITYSHQKITTTARTDDYCDGNEKCDLVNNELGLHYNNENKLVDKNNNPVVYNKKDIPKKNYYYVTAEKYNQYYNEGVPKEDADSMGIKPIFGDYVLDPSLNGPRCKNKFHKESGHEGLCEIGVNSSLSVETLKANGITYDLTDPKNSKLVNKWLDHERHIISCDGINCDKKMISGYKINGESIDIPFTIKKFKGKNVAYIDKQLDKQYENGCFKENGCQKNPKNADYLIMPGSIGYQTNLWSQRDLISQTKQLNIDLTKHKVLFNTEHDFSYGGLWSQMKKSMVNISGDQPLDQAWFVDLPETCDTYVNGKLNSDRTHTLCDNKNTFSFLIPVKTKTGALYFIDDFRINDYLAFNLGYRYDRVKYKPEYTPGKTPKIPDDIVTNLYITTPESNASQADSDLNESLKKQANAAANIKEIAQPKKFSASSYSFGTTLDPLNWLRLQAKYSKGFRAPTSDEIYFTFKHPDFSIRPNRDLQPETAKTKELSLTVHNDMGYITTSVFDTRYQNFIDLSYQGRRDVHGHSKLIPFHFYQNINRPNAKVTGWEIASQISLGKITQFLNGLNLSYKYTYQKGRIDGGIPMNAIQPKTSVYGVSYAHPADKFGLDLYFTHVSAKNAEDTYNMFYKEEGKTDSTIKWRSESYTTIDLLGYIKPIKNLTLRAGVYNLTNRKYITWDSARSIRPFGTSNLINQTTGAGINRFYAPGRNYRMSVQFEF

SEQ ID NO: 9965 - protein, 239 aa, Ralstonia pickettii
MAYKKALAAAAGMILATAAHAQAAGSNIVSLGWFRVMPNSSSDPLVVKSIGGIPVNQSQSGTGAKIQEADTVGLAFTHFFTDNIAVELVGGIPPRHKIEGTGALSGYGEIGSAKQWSPAVLAKWYFFNADTKFRPYVGLGLNYTWFSDEKITNSAFQTKLAGPGSKSNVSTDGSLNPVLNVGATYAITKDWFVGLSVSYLPLKTTATIDSTTATGVHVVSEAKIKINPVVTFLNVGYRF

SEQ ID NO: 9966 - protein, 144 aa, Ralstonia pickettii [sequence omitted]

SEQ ID NO: 9967 - protein, 1133 aa, Ralstonia pickettii
MKGNQLMRKPKLLRALLILLFVAAPMQWTRAQIVLSTPKTTLGAVIKNIKSQSNYQFFYDDKLAETPVNAIDVKNGSLQSVLDAALQGKGITYKIEDNIVYLSAPGEPQTPQQTGQEHTVTGTVVDATGEALIGVNVQVKGNPTAGTITDFEGNYSLSVPGNGEIVFSYIGYRSETLKPDGKNVLNVTMQEDTQQIGEVVVTALGIKREKKMLGYAVQELKSDELNKTGDPSVTSALQGKVAGLQMNTSATGLGGSTKITIRGNSSLTDNNQPLWIVDGVPFSDTSTSSASRYDGVDRGSASMDINPDDIESISVLKGPNAAALYGSRAGNGVILITTKKGSKKDGFGIRYSGNFTWTAIGETLDMQRRYGQGHIDTKDAKTAVYDKTDSGSWGPVLDGSMKEAWNGETYAYSNYGDKLKDYFDTGFSHTHNVSISNGTEKSHFRTSFGYSDNDGVFPTESLSRVNADLNAGTELNKWVSMDGKISLSRTKADNRPLYGDYGAISQLMRIPNNVRLDDLKQYSDETHAHVNWTGPTASIRNPYYVLHQRQNSDERWRAFGYYSMKINFTDWLHLSAKYAFDYYRTRVQSTNAGDGINGEANTSMITNDSMDRSEENFFESNAEVILMGDRQLTDNFRLGFNVGGNFMYQRSETLGVGVGNMVDKGNWMLNAANLLRTGSEDGYKRAMNSVFGSVQMAWKEYLSLDLTARNDWSSTLPSGNNSFFYPSANLSFVVSDFLRSIDKPLPSWVTFAKARLSAAQVGKDTSPYQLYNTYSFKFDNGVLTPTKDNVKMNDQLKPEIATSYEAGLDMKFLNNRLGFDFTYYYSKTKNQIMKVPAAAPWSGGQWVNAGMVTNQGVEFMLYSTLVETKDFAFDLNVNMAHNVSKVKELAPEENVNYMFFNGDGNFPVKVGTRAGHKLGEIYATSLYKRNENGDIIVNENGLPMTVTNESEYVNKPIGNIQPKLTMSVSPTFTYKGITLSALFDMKFGGDIFSYSEMLATGNGLAKRTLNRGEENNYMMVFPGVTESGEVNTKQVSASEYYGSLQAEDFIYDASFIKLKELSIGYSFPSSMLKKTPVNSLNVSFVARNLCYLMKHTPGTSPEGGYDTTMFSQAIDYASLPFTRTFGISINLGF

SEQ ID NO: 9968 - protein, 498 aa, Ralstonia pickettii
MLFFPLIQHIWVAVRSLSVVRATVLSQVARRRSAQLSMAVLMSALACVAHAENTVLAETPPTSSAEDQNAVGSKSPASAEQAPAMPEAQWWNFHAQATHITQWHSKFRAPYAGANSLASDGESSETTDMTLFVGLRLWHGAELYANAEIDQGFGLSNTLGVAGFPSGGAYKVGNNTPYHKLPRLFLRQTINLGGESEPLESAANQLAGSRSADNITVTVGKFAVVDVFDTNSYAHDPRADFLNWSVIEAGAFDYAADAWGYTRGAAVEWTQSWWTVRGGFFALSTTPNSESIDVGFKQHEWVGEIEARHQLLGRPGKLKFLAFVNRGYMGRYDDAVSLAQQTGSTPDTSLVRQFASRRGVALNVEQELANDLGFFARASMNDGNKETFDFTDINQSVSAGLSMSGSRWARSKDRLGAAFAVNGLSKAARQYFAAGGLGVLIGDGALNYGTERIAEIYYTWAAMPHVTAGLDYQYIVHPAYNRDRGPVSVVAARLHLDF

SEQ ID NO: 9969 - protein, 403 aa, Akkermansia muciniphila
MKLHHQLLTVAVAAALYVPAAHAEVAIDVIGGSEITFEGLVQADGNWFHNDVVDLNGGDAGNGKNSEFELRRAELVLKGKGPGNVEWVVGYDAKADKFLDTNVKYKLLGNANHFLQLGQFKQPNSLEELSSTKNNDFISKAAVTNTYAIARRLGGAYSYGQDNWSVTASAFGRELTRNLAHGSGYGVRGTWAPINEKGQVLHFGLSYVNYDTDADTLRVRARPNADLATARLVDSGNLTDTDRVSTIGAEAMYFQGPFKAQAEYYTSKAKRYDHDNYTSDGYYISGVWNVTGETWSYKGGTPGTGLPNNPAGGQWQLGVRYDHMDLNDGNLAANPVAGRPPIVDGVLGGKMDIWTVGANWYLRSNFKLMLNYVMVDSKKYSSTARGFVNDDPNILEARAQFFW

SEQ ID NO: 9970 - protein, 825 aa, Akkermansia muciniphila
MKLERQSVMTGLLTGVLVVCITPTVQAQVTITNVQINTTDQGLEIILETPEGQQPEVFSGSIGTTFFADIANAQLNLASGQDFRQDNPASGIASISVSQQPNNLVQITVIGIETTPIVQINRISGRLVLTVTPEQPSETEETPDSETSNQQEDEAIELVVTDDTQDNSYFVPNSSTATGTDTPLRDTPFSIQVVPNRVLRDQQVIRLDDALRNVSGVQQNSADPRGQRFQIRGFDSSSVLRDGFRQTFGRSGNSGFQELSNVQQVEVLKGPASILYGALEPGGVINIVTKQPLADPFQQIEFQAGNRGLLNPSIDFTGPVSRDKSLLYRLNFAYRNERSFRDFDTYIERKFIAPTFTWNIDEQTKLTFEVEYSDDDRPADFGVLALGDQVVDTPNARNFGEPGDYLRAETLRVGYRFQHDFNENWQFQNAFNYLRYDSTFSSAFTFSVDEETLTAFRSFIYLDQPSTNYELKSKVIGNFDTWSIKHKILFDVGLTRREQLGNIGRSDFSDIPLNIFAPVYGTVPRPDPNTQEIFTFSDYQVDQLRITFQDQITLFDNLKLVAAFNYDSVEQKFWDRLTDENTVQYDDSVVPRVGLVYQPIEEVSLYGSYSQSFYPGAGQTVSGQFLDPEESEQYEIGIRAEILDKKLSFNLAYFDITKNNVATSDPEFPIFSVAVGEQRSRGVELDIVGEIIPGLNIVFNYANITAEITEDNDIPVGNRLFNVPENSANLWLTYQIQDGFFEGLGFGGGFNYVDERFGDNANSFRLESYTLANAAVFYERDNWKFALNIRNIFDEDHIKGSENSRNNEIYPGEPFTLLGSISVKF

SEQ ID NO: 9971 - protein, 682 aa, Akkermansia muciniphila
MLYSPLRLSPLAVALWLAAPPSQAVELEPQVITANPLGNRQLAAPSTVLEGENLLQQQHGSLGETLNKQPGVASTWFGPGASRPVIRGLDGDRIRILRNGVGALDASSLSYDHAVPLDPVTVDRVEIVRGPAALLYGGNAIGGVVNTFDNRIPDSPIEGIHGAGELRYGGADTTRSSAGKLEAGNGAFALHLDANSRQFNDLRIPGYARSAKVRDADEPGSKHRLENSDGRQDGGAVGGAYHWDHGYAGLSYSRYDSNYGSVAEPGVRLDMQQDHYAFASELRDLDGPFSSVKVDAGYTDYEHSEIEEGEVHTTFKNKGYEARIEARHQPLGPVEGVVGAQVSRNEFSALGEEAFVPHTNTDSLALFMLEQWQATERLNLSLGARMEHTRIDPDAKGNENFVDADSASSFNAFSLSSGAVYQLDPIWSLAANLGYTERAPTFYELYANGAHVATGAFEVGDASLNKEKAISADLALRFDNGTHKGSVGVFYSHFRNYIGLIGTGNTREGGHDHDHDEDDHDHDHGHEGFPEYQYQGVRARFYGIEAQDRWQLVENRYGSFALELSGDYTRAKNLDSGEPLPRIAPLRLNSGLVWELDRWQARVDVQHAASQHRKPANETSTEGYTTLGASVGYRFEVGQSQWLAFVRGENLTDQTVRYASSILRDIAPAPGRSVEVGLRTTF

SEQ ID NO: 9972 - protein, 362 aa, Akkermansia muciniphila
MKLRLGVLAMLAVAQGAWAQSSVTMFGLIDSGITYVSNEGGGKNVKFDDGIFAPNLFGLRGTEDLGGGYRATFALVNQFSMANGSIVGTGIFGRNAYVGIESDRFGSITLGNQYDFMVDALFSRGNAISRDISGLYGFRNGPFQRLALPGNPTGAFDWDRTAGSKPIANSVKYSSPTVAGFSGGVMYAFGGVAGSVGADNAVSAGVNYELGAFGVGAAYTNEKYGPAPGVPSTSVRNWGVGMHYDFGVVTAKALMTTVRNSFNDAGVWMAEAGGLWRIRPDIVLGAKYMYMKGNEAVNDNHAHQISVALQYLLSKRTMVYVSADCQRANGGANAQVNGVLDPNGASSSATQAVARMGLHTVF

SEQ ID NO: 9973 - protein, 3152 aa, Akkermansia muciniphila
MKLHLPLNLLAALMTSFSGVTLGTATLAGVSGLLVTASQSYAADVAFDGTQVNVAAGGSASYDVGTVTASTTLNFAGAGTAAITNLNGTAPEAILTVNRVANGGASLSTLTLNGAGTFNGIISLYSNTTGGSQNNILNLNHAQAAQYATIKLGGYGYTTGASVLKAGVNTSISKLEHNNAAALITGEGTTLTITGDSSSYGGSFGGTVTVDYTGGGTFTLGNSDKNTALSPAASPNATLKISRGTLSLFSGNVTWSQKLVMGDGTTLNVQDGPSVTGYSSYNAASINNGGFNFSGAAVFGSGVNLTSSWGKNVKFSGVLTAASGFSISGGANEYTYYNLLNTANEIGGTIAITRNSASLGISASGSLGTAAVTTSVNSQYLTYYGTAGDAADVIDNSITGAGNFVAQSGWVHLSENVALTGTYTVNSGAVLSRAGSINAALAGGRLDAGAGTMTVTELSGNGTISASAGTMNFQNAFTVGETMGILANGSGTITGNVTVDGGRLYYTSMDNVGSVLQNVTLTSGLIDFSGFQEFQDLFGSEALVNTSYNLGVDLGNGFTLADVDESLYTISTVDGKTVITFTASGAHETVWDPAWGLEEAPSSATGTLVNQQSLSLYGIRASSMQEGFGSVNAVTGTGDLTGVTLAGGYYNTASNATATEITTGIWTDVLGGNYNLIIGGSYANNWSGSGKWNVTGDVHTQIQGDTAVNWVVGGNYKDGQAAGITGNVYVSVDGNAVIKGSLIGGGTGCHNSVNNLDGSTYVVVRSMQSVTDETISLNSVVRGFIIGGSTYEANSSSRAAITGSTNVTIDLGTASGSFVKSIVGGSYSGGSGAYTVGGDSSVSITAASDAVFTGAIYGGGFSSSGTSAVSGNSSLTLDGGAYTGALYAGGGGTGSSVNGDATLTVKKAVFRTGSSLNASGGTIGGTSSLLLGGYGNTADHAISFSNTAVAGFDIVTMFQDSFFTGNLNMTGSSVLALAGGAGTGINLDGSFSLSAEGELNLDLSEFGTLTDGMSVLSTTGLSNISSIRASFADGVAGSITISDNGKDLVYTAGTLLLWEGGENGVWSAEHVWTDGGAPATYADGMAVSFADQAGVANSVVQLDTEVSPSSMLVRNSTTRYELTGTGEITNTAVAKEGTGTLVLGTSSILGTGTTVAVSQGVLAFGYDTALPVTGVTWNTGSFLGAANGATVTVDLGTVTNPVFSLSPDASSFITLATPSDIVFGNAITGEGTVRKTGTGLLKLTGSNSGHIVVQEGNLQIGNGTSSIRWGSAGSSVTLENGTSLIIAGNSSGTSHHTINSDLILGTSASDAVSLKWVDASQASAADYQHSFTGTVTVNGAVSLVGRDNWAKEMGFTGTLTGAGSLTYSRGAGDGRYNSNGKLIISGDASGFTGMITMNASNGYSAGLDLRTSISQGGVTLTSGTDTTGFAFMRVLGDVEIASLDGTENSQVGAVGGARTLTVGAGTYNGTLTDRGVALGYGATSISYDESGVLSLTKVGEETLTLGGTVSYTGLTDIQGGTLALTASGATSLGNITMAANTRMTTAGALNLAANSTLTLDISSALEVGGAFGAGTFNLTLNGLEGITDAGEYTLISAASGLDAASAVFNWAGYTGDETLIYELEQTGTSLKLVVTSAGDVWIWQGAEGVTWSDTNTGAMWGIEGSTDTAAGKNLIFNSTGAGTVTLSGAVNPASITVNNAAGSDYVFVSDGTGKIAQGTLTKRGEGKLVLNLDNTGWNGDISVQQGELVAQVANSLGSGAITVTDGVLTLATADVQLGMGMINLQGGRLNLASGSFATAFTADNMTWTGGSMTLGEEVAATVAKALANGKAVELADGSVLTVSGANDNSALNLNASGSGTVSVGLGTSYGANVLNMSTEFQGSLSVTSGYFQLNNVTMGADGILKLADSNVRTEWNGTAGGTFANDVVFTGNQVFATKDFTFSGDLSGTAFSTQGAGNITLAGGVNLDGQLKVHRGTVTVNSADVAKLGDSIDIQNNSTLAFARDFSYGGVISGTAGSTVSVNAGTLELTGANTFLGALSIAGGATARLGDGSAWAGSLSGAGSLVIDTTGEITLAAGNTGFTGSTTLSGTGTVTLAGADSLGSGRVTVNNGVLNLSSLDAANVILITKGSLANAEAKTAGNVEVAASAGTQGALNTINLGGLSGSMVGSIVMEDYSRLTGVSGALDMTGKTVTLKLDSGSLTAGGTTGQGVIDADSLTLSAATTTINLSNQGVLDLLAANRDSTDGVGLVLTTGTLAVDNFKQIGFSPLLASLGYTVTEVLGADGTLMVSGNTDLVYLVDATPNSDNPNISDYAALDPYKAVGINGTTLHVSLNGAPEASRNGDGLKVSNLVGSDGALTVTNTADDAASNHAVVDLVQDVDAGGNSYGGTISGDHVDFVKKGAETLTVEGNFTGNDSSLSSSEGNIILNGAGNSLTTLELAGGDITLGGRNDGASRVTTVETLAAGAGGGTLNLGNGAQMVLTGQQAGSHVTEVTISGDGTLTLGGTGTDSSLTLGNGSSLNGVLLDIREGSALSAATGSVNTVSGLEGGGALKLSGAEMTISSSDSHTFTGTLDGASGTLNVKSGNGSVQTIKGAGNAGYHLNVSDGGVLTLAGAAGEGGNPAQASYQGITVNGGTLNIGSADDPKTQLTLGSDGLSVTGDSTVAITTSSTTVDGLGNPFVTSSGNITLGDGTGEVTLVMNNLDTLVSGSSETLNMELFKTTDGALVSLGDNVTLQDMILGSMYENLELTTNDSMTAIILTGTARTENIFRDSSLTRNAATGADILWNSRYHMEEGSALRDFYTSVLLSQNSGDYSGAARKLAAAAGSTVTSLGIAQRDSLRDQMGWIRNRVAQMGVNPAYVHEDMPYFHMWMQGTGSYAKLDTRGDESGYELTTWGGTVGMDVDINDRLTAGAAFTANYGSLTASAADTADGDLDSYYVNLFARYQYRKWSHLLILTGGWNDASLTRTVNYGTGSYQARGNTTGAGFGAMYELAYDIALNEDRSVILQPLFNASIVTTRMDGYRESGSAGNAGLKVEDQELTTAAVAVGARLSGLMGSNIFGREALGEVRVNVSQDMGDRRGQANVGFLADPSYTRPVYGAKVGSTAFQIGAGLSVPVGTQGVIFVDGNADIRSGSSSINGSIGYRYNF

SEQ ID NO: 9974 - protein, 776 aa, Akkermansia muciniphila
MRLSMTPSISPLASAVLLTLSAPAFAQPDDVSAPPGAVDLDAIRVQQERAQKPSSPKYTEALRDTPQTITVVTKQTMDQQNLLSLRDVLSTLPGITFGAGEGGGGYGDSINLRGFTASSDITTDGVRDSAQYSRSDTFNLESVELINGANSAMSGAGSVGGNINLVTKSAGQGNFTNVMIGGGSDRYGRLTADSNYDFENGTAVRLNAMGHTQDVPGRDEEFRHRWGVAPSVAFGLGSDTRFTLSYLHQHDNNLPQYGVPFALSPFNDGPLPGVDRETYYGYRNVSRQEIDVDMLTGVLEMDFDDNVKLRSLARLQRVDQSTTATAPEGTWCLPNNTNAYTGRACVGQPPSTWNPNSGPRGLVRDTENFIAHSQTDLTATLHTGAIEHRVVAGVAFSKEDFELDSGSLFRNADGSTTGITYPLQSFDNPYNIWTGPQHYFRTGRSKGSLTNQAVYLFDTLQFNEQWMLNLGGRYEHNEGDTTTYTVNATGGITGVAAGFPAGSKDDLFSYRAGLVFKPVDNASLYLSYANAKTPSKASVNGSCTPIATSTVGANCNVEPETAVNLELGGKWDVLDERLALTAAVFRNERENYKVNSGDPLVPEQVLDGKARVDGIALGAAGYLTERWSIFANYTFLDSEVLQSVSNRTASLTGDPIAGRELVQTPRNAGNLWTTYQLNQWTFGYGVNYQGSFYPNNTSTAVYRKTDAYWVHRAMVGLRVNAWLSLQLNVNNLFDKEYYTSIRNNLTVNAAGTVTAGSGWALPGDGRSAVLNATFSF

SEQ ID NO: 9975 - protein, 998 aa, Akkermansia muciniphila
MRPREGLRLKWPVEEDDMHMRGTRLAISASLLTVSFALAAPAFAQEAAQDKAAEAPVDAREIVVTGSLIQRPNNTAVSPIVSVGEAALKETGQVNLQDALNQFPSFTTAGNANTGGQGTGGRASINLHGLGTNRNLVLLDGKRLPLSDINGNVDINILPESIMGGVDVITGGASAIYGSDAISGVVNFKTLRAFDGVRLDAQNSISERGDGYKFNGSLAFGTGFAEDRGHVIAAFSYAQQDAVNGSSRDFFFDKTPSSFIGTGTFVPSATNAPTVDAVSGVFSGYGVGGLPNNVNLLNLGFNNDGTLFTQTGARNYKGANGTNGYLVVGNNVRMPVGQQIDFANALKRKTAFLKADYDLTPSLTAYGQFMYVDLSVHTASGGSLTQFGTLTTVPVTNPFIPDDLKTILASRPNPNAPFTWNGRYVGVPYKNWDENYVVEQYMAGLKGDIASGWSFDLFASYDQSVHDQQLNDAVIKGRVQTLLNAADGGASICAGGFNPFGDANARSLSDACVNYITKTAFSKEKLAQTQAQLQVNGKLFDLGAGPAQIALVAGYRKNTYSYVPDSDLAAQNIEAVIASQPASGRISVKEFAAQVDIPLLADKPFVRELGIGGAIRHSDYSVTGGVTSYEVDARWRPVDALLFRGSYQRAVRAPNIGELFSPQTGTQLVIGTPPGALGDPCDVRSNARTGADGAKVAELCVAQGIPQAAISSYTFPTTATGQLVSGNTNLTPERADTFNVGFVLNSPFESGPLADFTLSVDYYNIAVKNVISTVPGLTVLSKCFNLDGSNPTYDKNNLYCGLLVRDNSGQLTTVATPYLNLGAVKTDGVEAQVNWTVPARFLGDESGRFFVNSAVGWLHKYKLQLLPGAAYLDYTGISNGAAGVSSLPPRATPKWKAVTSFGYRSDAATLGLRWRYQSKMEDTTSVLTPATAQVGVPAYALWDMFGSVRIAKTFEIRAGVNNLFDKGLPFVASSQNGTDVALYDPIGRSFYLGAKVSF

SEQ ID NO: 9976 - protein, 686 aa, Akkermansia muciniphila
MRHAGVTEDSGSYNTSSMSTATGLNISARETPQSVSVLTKQRMRDQNLNSVESAVNNITGISVRQFDSDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLGLGWNRQRQNIDNDYYLATCNATRTCPDLGDFTQPGWQYPKPVWSDKRAYGSKGRSDQSSQYVVTQLSLIDPLTLILGGRLTTWETRGDNFGTPQNARYKNEFVPYSGLTYDINRDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLSDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 9977 - protein, 675 aa, Akkermansia muciniphila
MLLAAVAQAQTDTPSAAGTASAERLSPIFVTANPLGDTQLIAPTVQLSGDALTRRQADSLGETLDGLPGVSTTTYGPMVGRPIIRGMDGDRIRLLQNGVAAYDASSLSYDHAVPQDPLSIERVEIVRGPAALLYGGNAVGGVVNTIDNRIPREAIEGVTGALDARYGGANSVRAGAAQVEGGNGRFAFHVDAFDRETSKLRIPGYARSSAQRAIDGPDTPQPIGSVPNSDGRVHGGAVGASYTWTDGFAGLSYSGYESNYGSVAEDDVRLRMRQERLAFASEVRNLSGPFTKLKFDFAYTDYRHKEVDNGETATLFRNRGYEARIEARHRKIGPFEGAIGVQFGRNTFSALGDETLVPSTRTNSVALFGLEEWQVDPRLKLSVGARVEHVTVDPDPAGVDKFAGAQPRDFNAGSISTGALFSLTPVWSIAANVAYTERAPTFYELYSNGPHDATGQFLIGNPNASKEKAVSTDLSLRYASGANRGSVGVFYNRFSNYLTEYNTGRIVDDEGEPVAPGTDDALAEAVYRGVRAEFYGIELDGKWRAYARKGHTVDVELTADYTHARNVDTGQPLPRIAPLRATLAADYGYGPLGVRAQLTHAWSQHRVPDNDFPTDGYTTLGVMLTYKFRVGATHWLAYLRGDNLTNQDIRYSTSVVRGFAPEGGRSVMAGLRTTF

SEQ ID NO: 9978 - protein, 682 aa, Akkermansia muciniphila
MVIGCAAFPDREAALGGRVMGYGSPDRAWRAGMGVFGVAVAAVMAGVVGASGAAAWADEPETTEGLIVSASRTPVAAKDLGRSVSVLTGEDLRERGVRYVSDALRQLPGVAVSRAGGPGGVTQVRLRGAEANHVLVLIDGVAVSSPASGEYDFAGLVASDIERIEVLRGPQSALWGSNATAGVISIVTRRGTRNQSGGEVSLDGGSDGTFGGSVAMGAGTEDLDAALSLAGLRAGGLDVSADPGGDIDRDRNITLNGKINYDASDWLRFGATARMADRRSDYDGFAFGAPKRSDLVYDGDYATDQRDVAVSGHVDVDSLGGRLSHQARFDYTRVDIQTLLDGLSTAKSLGQRFKGTYQTTLALDAPTLTSANHRLTAAVDWQRETFRNTDADLVSDPSQVEGQQRDLYGLVAEYRGTLFQDLDLQAALRHDINDSFADSTTFSTSASYEVRPTQSRLHASVGTGVTNPTFYEQFGFIPSQFIGNANLDPEKNFGWDAGIEQRILGDQLTLDATYFHETLTDEIVTVYKAPSYLGTAVNENGDSRRQGIELTLTARPTEALTLTGNYTWTDAYDPDDKIEVRRPRHRATLAADYRFLDNRAGVNAEVVYAAGNYDFDYRAASMGSARLRLDDYALLNLGGRYKVTEAVEVYGRIENALDTQYADLDGYATQGVTGYFGLRARF

SEQ ID NO: 9979 - protein, 421 aa, Akkermansia muciniphila
MRLHHSSLCQLLCGGAVLIAASPASAAFVDDSKAVLDARNFYFNRDFRQSGAAQSKAEEWAQGFMLRFESGYTEGPIGFGIDAIGLLGLKLDSSPDRIGTGLLKSDREAPRRAQDEYGEAGFTAKLRASNSTLKLGTLQPLLPALMRNDSRLLPQTFRGAWLSSNEIEGLSLDLGRLDRVNQRDSSDNEEMAVFNGGRRNIVLGSTRTSDEFIFAGGRYQWTPELATSYYYGGLDGIYKQHLVNLVHQLPLGEGQSFKSDIRYARSTDDGGSNVDNDAFGALFTYRLGSHGFTAGYQHLSGDTGFAYIAGADNALINLVQINDFGNQDERSWQLRYDFDFAALGVPGLSLMTRYLSGDNVDRGAGQSEGKTWERNTDLAYVVQSGPLKNLGLRLRNATTRSNFGPDLDENRFIVSYSLPLW

SEQ ID NO: 9980 - protein, 254 aa, Akkermansia muciniphila
MKKHLLTLTLSSILAIPVVSHAEFKGGFADIGVHYLDWTSRTTEKSSTKSHKDDFGYLEFEGGANFSWGEMYGFFDWENFYNGRHNKPGSEQRYTFKNTNRIYLGDTGFNLYLHAYGTYGSANRVNFHDDMFLYGIGYNFTGSGWWFKPFFAKRYTDQTYYTGDNGYVAGWVAGYNFMLGSEKFTLTNWNEYEFDRDATYAAGNGGKEGLNGAVALWWNATSHITTGIQYRYADDKLGEDFYQDAIIYSIKFNF

SEQ ID NO: 9981 - protein, 1017 aa, Akkermansia muciniphila
MNLRLISLCILLSINWISLSQNGRDISGIVYNAKDSIPLPGVNIIIKGTNAGAVTNLGGRFFYTVKKKPISGQKLVFNYLGFKTITIALESQNYFTIYLQPETDHLDEVIITTSYGTTKLKEEAVASISQINERDLNVNQSFETIDKMIDGLAPGVQIEGNSQLGTSTRINIRGQGTFTPLNGNLLNASAQPLIIVDGVILSEENGFDDNLFDGGGRFSEQFLNPLAKIPPEDIKSISILKDASAVSIYGADGANGVILITTKKAGKTDFSINFSQQAGFSTPINPIIYLNGPQYHSILTDYYINSGESPSNASALAGSNSVNTNWFDLTNETGTFTRSQLNFEGSTGQLGYRANVSYLNNDEVQINNQYENIRGSVSFSYSNEKLEANLRFIPSYVIKNNPNTLFSFPLRPNISPRDENGEFNIIGEGSIGNPLAVLNQNKATSKTIGLLTTLNLKYDVDENWSISTIVGADLTDKEQDNFFSGNNSSGRFSGTFEVDEVTFPNWGRKLIQNRSVESYQFNAVLSYNKQFGDHSIDGILGTEVREESIKAERFFGRGYILQNRDNSLEEANEVVFNSFTSENARTSLFTQLNYDFLKKYFITTSFREDKSSAFGGDINAAYNGAVGLSWILSKEDFFKIDAVYFLKYRISYGSSGNSRIGSFSARGLYNTNVQSIAGGYNFGSATFPSTAPNPDLGWERNIKFNMGIDFNLLSRFKFSVDFYRDKITNIISSTNAVPESGFINVQANTGSMENKGIEFSLSSEIIDKDQFKFNLNFNLSRNRNTVLNIENLSSEFSASQRASALRVGESTSAIWGYQWIGVDPANGQDLYRVDGQIFSGNYVSQNFDSSHWEVIGDRLPEVYGGLQANFQFFNQWSLTARFVYNIGGDILVNRNFESTDQLLPNRNMIVNLLNYWQEPGDIARNSKPSPGQPIVSNSTKYVYDNTHIKFQNFSLNYKIGPKFLEILNISNANIFINADNIGYWYKNGSSEGHNGIAELRFVYPEMRTITAGINLGI

SEQ ID NO: 9982 - protein, 1865 aa, Akkermansia muciniphila
MRLHLPITLLAAVLACYTSVSLAVPTSESPAWGADSTFNNNEPANEYSVTGSQSVNLDVNSGNNNYSTGLYIGAGSSFTINQNANGGCTINLNGAFAGEGNLTLVAANGNAGYASKFVLGSQESSFSGNIILSQKGTQPGGAILQITGTALANATVDLSGSINQSSSALTLQISNAASLAGLNDADGFSGTHKGRVQSANSSRANLTLTGNGNYTYGGSIGATTQHSGVNGNTTPTGGINLIMAGTGTQNLTGTVINANITAQGGILKINNSSLAYSGIITMAGGTLDFTSATLGANAVLNMNGTGVLKNAAIDGAKLTYTESGSSFTKENVTFTSGTIDIGGALDSLVEGEQGYTFDLGSNLGANFTVTGLDTGQYRIEGSVLTIEDGAISSVTWVSAGEGGELEETVKNAFTLALGEGSAANVSLGYLNGTLTTSGDKVYQITNTGGTKINLSGVYNSGATLPSGNLNYQGDIWMDINGGAFGIIAGGVTNEWGTNLQTSTLTGDTHVQLSGNATAEHVIGGNNKGASTTLTGNTNVTVKDNAIVAGAIIGGSTSSHNAVTTITGNTSVLVTNIQHSNSATVNLGDFGNVTAQNFITGGSAWTANQTSGTTIQGNTSVTINVGDAELSGTEGHNNFVKNIYGGSYANTKSEGNGAVQKVEGNSSVSISGKEGITFTGDIMGGSFWNWGNGTTLTTNGNTSVSIDGGSTFTGKIVGGSWRGSTWTAEDPTALPVSIGGNITVTLGQGTYLGDIYGAGNCGTVGGEVHVSLTGGSIFGEEGEESGITIGGSAGAAVEGNRTLELKGTFGTGDFQNVTFTRFDEINIAQEETSATIYALTDSPALTKTGAGTLTLGADAAGAETILDGTTEGITISEGSLNLSGAGGSHMKGTWNIASGSRLTGVSGTVTVGEGGLDGLTIALGTENIGQDTQASGAVIINGSGTGSDPNLSIEGEGLTLDLSNDAVVNLLLDHKTDDSSSYLTLTSGTLTVGDLGDIAFTTDLLSNYGIRVTGTDGGSLVLSGAATGLYRVQEEGGNAHEVNSYQTLSGYAGVVIGGGQTLTVNLAGAPGESDGQGAKINNLMGATGSSLVVNNTGDGTAVVILNNKQMTTGEDDIDPAGQDTVMGGSITGGNNVAFIKEGTGTLTVGGTMDVETLALREGNIVLNGASNTLDTLTLEGGGLTINGNAEVGTITGTEAGGSLTIQGTLNLTGTGEINDGSITGTGTLRIQEGAELALGGEARLDGTSVTADGTLALSGTESGAIISLSGSGTLSMNGGSLSISSATTSSGTFSGTLAGSGTLDISGQATQYLQTGNKDYDLAVRDGGVLVLKGTADAPTLNYNSITAGNNGTLRIEATGDAQGSANTTLNVESITFQNGSTTELIYNFNQDAPFGAPMLTADTITVQDGAGFLLSNMEGNAAMNAGSDLHDVILMSATGSISGLEDGQSLAARISGLFAVYYQDATLNRDGNDILLNATLRQENLFASAADTWNSAAGASLLWEARKNLDPDSQLAQFMNGVSTMINDGNLSGATRAMAAAAGSTVNALGTAQRDALRDQMGWIRNRTTLMGVNPAYVNDDLPRFHMWMEGTGSYAKLDTRGDESGYQLTTWGGTVGVDADLSDRLTVGAAFTASYGDLTAGAADSADGHLDSYYASLFGRYQDRRWAHTLILTGGWNDAKLNRTVNYGEGSYGTQGSTSGWGFGAMYELTYDVYLNENRSSVLQPLFNASVVTTRMDGYEETGAGNAGLNVGRQDWTTGTLALGGRWMGLVGSNIFGREALAEIRVNAAQDLGDRRGETNVSLLGNPGFAQSVRGAKVGTTALQLGAGLSVPVGTKGTIYVNGNADIRDGSSALNGSIGYRHDF

SEQ ID NO: 9983 - protein, 467 aa, Helicobacter pylori
MNATADSSLLRSMAAIALACTLASTSARAGAKDESAAEWLAPKWFNEWHDGLANKGLNFGATYIADNIGNVSGGVARGAIHFGRLDLSVDADLDKLVGWSGGRFYANAFVIYGRGLSRNYVQNLATISEIEALPDQRLYNAYFEQSFFGDRLNIRAGQQAADVEFFDSQTDDLFINGTFGWPAIKASNLPAGGPAPPIAVPGIRVKAALTDQITAYAAVFNGDPSGPGDADPQIRDHHGLAFRVNDPPWVIGQVRFNYDIDIGGRPLAGNFTPGAWKHYGSFDSQRFTAEGLSIADPSGSGVPAKLRGNYGIFAVIEQVLYRPPEVKDNTTSASIPGVTAFGRIAYSPPDRNLIDLYLDGGIGFVGFTPGRPLDRFGVAMAYMRISNTARILDLDTQAFTGVQSPVRSNETLIEMIYEAHIKPGWLVAPYFQYVFRPSGGVPNPNDPSGTSRIGDAAVFGVTTTIRY

SEQ ID NO: 9984 - protein, 253 aa, Helicobacter pylori
MKTLFSVYLFLSLNPLFLEAKEITWSQFLENFKNKNEDDKPKPLTIDKNNEKQQILDKNQQILKRALEKSLKFFFIFGYNYSQAAYSTTNQNLTLTANSIGFNTATGLEHFLRNHPKVGFRIFSVYNYFHSVSLSQPQILMVQNYGGALDFSWIFVDKKTYRFRSYLGIALEQGVLLVDTIKTGSFTTIIPRTKKTFFQAPLRFGFIVDFIGYLSLQLGIEMPLVRNVFYTYNNHQERFKPRFNANLSLIVSF

SEQ ID NO: 9985 - protein, 286 aa, Helicobacter pylori
MKKSVIVGAISLAMTSLLSAETPKQEKAIKTSPTKKGERNAAFIGIDYQLGMLSTTAQNCSHGNCNGNQSGAYGSNTPNMPTASNPTGGLTHGALGTRGYKGLSNQQYAINGFGFVVGYKHFFKKSPQFGMRYYGFFDFASSYYKYYTYDDYGMRDARKGSQSFMFGYGAGTDVLFNPAIFNRENLHFGFFLGVAIGGTSWGPTNYYFKDLADEYRGSFHPSNFQVLVNGGIRLGTKHQGFEIGLKIQTIRNNYYTASADNVPEGTTYRFTFHRPYAFYWRYIVSF

SEQ ID NO: 9986 - protein, 696 aa, Helicobacter pylori
MKIKKSLFALSFSLMASLSRAEDDGFYMSVGYQIGEAVQKVKNTGALQNLADRYDNLSNLLNQYNYLNSLVNLASTPSAITGAIDNLSSSAINLTSATTTSPAYQAVALALNAAVGMWQVIAFGISCGPGPNLGPEHLENGGVRSFDNTPNYSYNTGSGTTTTTCNGASNVGPNGILSSSEYQVLNTAYQTIQTALNQNQGGGMPALNSSKNMVVNINQTFTKNPTTEYTYPDGNGNYYSGGSSIPIQLKISSVNDAENLLQQAATIINVLTTQNPHVNGGGGAWGFGGKTGNVMDIFGDSFNAINEMIKNAQAVLEKTQQLNANENTQITQPDNFNPYTSKDTQFAQEMLNRANAQAEILSLAQQVADNFHSIQGPIQQDLEECTAGSAGVINDNTYGSGCAFVKETLNSLEQHTAYYGNQVNQDRALSQTILNFKEALSTLGNDSKAINSGISNLPNAKSLQNMTHATQNPNSPEGLLTYSLDTSKYNQLQTVAQELGKNPFRRIGVINYQNNNGAMNGIGVQAGYKQFFGKKRNWGLRYYGFFDYNHAYIKSNFFNSASDVWTYGVGMDALYNFINDKNTNFLGKNNKLSVGLFGGFALAGTSWLNSQQVNLTMMNGIYNANVSASNFQFLFDLGLRMNLARPKKKDSDHAAQHGMELGVKIPTINTDYYSFMGAELKYRRLYSVYLNYVFAY

SEQ ID NO: 9987 - protein, 349 aa, Helicobacter pylori
MASSKVKMLTLSAFIAAVVSTGVSAQDHTGEITVQGGRIFFDDPLEDADTWGVSFGFPVNENWTLEAVWSRYDTETQNGGFDLDGTQYRLDGIYNIITESQWKPYLALGVGDLKRELNVAGGGSARETLVNLGAGVKRSLGGNWQFRTDVRAFNSLDNEYTDLAVNLGLTYLFGKKSAPVVAAAPAPAPVVEDKDSDGDGVLDSKDKCPNTVSGLKVDADGCPVVLEKTLVINLEILFDTAKSEVKPQYLPQVKKLADALTQYENTVVTVEGHTDSQGSAAFNKRLSQQRADAVKAALVEKFGIAADRVTAVGYGLERPIANNATAEGRAQNRRVVGEVSVKYSETLKN

SEQ ID NO: 9988 - protein, 1010 aa, Helicobacter pylori
MKNHRTVSTLPPRSLLYCTLAASLLAANPAMAQSSNATLRGQVASAQSGSEVVVTNIATGSVRRAPVNANGNYTIVGLQPGTYKVESNGISRTVTLSVASSATVDLGNETAAAPAGDATTLDTVTVNAPMMREVKTSEVGNTVSLRQIQQLPQATRNFLEFADTVPGMVFTIDQDGNTKLRAGASNASSSNLYIDGVSQKSYVSGGGIAGQNETQGNPFPQLAIGEYKVITSNYKAEYGQISGAAITAATKSGTNQFHGEAFYRFTNQDLRKERPDEENGKVDSQTKEYGLAIGGPLIQDRMHFFFAYEGKDNVAPKSVQPSAEASPFVGLLPSNLRDQFGASNMPFTEDLYFGKIDVEPTDNDRIELATQYRDETQVSNVGGQNAPDRAVDKINKDKRTSLRWQHSADSWFNEAIITTEDSSNVPTPRGTGNGSIYTYVDRTEADPRQWVFLNTGAASGEDFKLRSQKGWSFQNDLTFNALEWHGEHTIKTGVTYRDIKLTSRESSSLNPQLSYEVSQNGIAPVPFQVRYIRAFDNPGQVPVVESPSKQYGIYLQDDWAVNDKLMLNIGMRYDYEDTQAYTDFVTSQPFINALYSDDPDNPGQPWANRLVPSGINVADYISTGNNRKNFKDAWAPRFGFSYDFFGDESAVLHGGAGRSYDRNLFEQLALESVKAALSPVVVYFSDAASRQPCFRDDRVCTAWNPGYLNGIDQLNTIPGTNDSSELFMFNNKLKTPYSDQYSIGISNQVGDWLTDVTFQRVLAYDGLVMSLVNRYPNGAYFDSTGSVPWGEPVPGYRNTILGYNGLEQRSSQFLLSAEKPYTKESGWGLNLSYTHTSARQNRTIDEPFAFDKATIRDYPFVKSDAVAAHRFVASGSIDGPWGVTFGAKLILATPEPINTIACYGFTDPDGGTCQAVGVTPPGNGKFLVGGKIWGYRTVDLQANKEFTVVGDFKLNARINVLNAFNFKNYTQYQYNSFGSDGRLQPDITVVDNGEISYVPRSVVLEIGAKF

SEQ ID NO: 9989 - protein, 1003 aa, Helicobacter pylori
MKKGNFMFKVLLMLIAGIFLSIDAFAQQITVKGIVKDTTGEPVIGANVVVKGTTTGTITDFDGNFQLSAKQGDIIVVSFIGYQPQELPVAAQMNVILKDDTEILDEVVVIGYGQVKKNDMTGSVMAIKPDELSKGITTNAQDMLSGKIAGVSVISNDGTPGGGAQIRIRGGSSLNASNDPLIVIDGLAIDNEGIKGMANGLSMVNPADIETLTVLKDASATAIYGSRASNGVIIITTKKGKNGQAPSVSYNGSVSFSKTQKRYDVLSGDEYRAYANQLWGDKLPADLGTANTDWQDQIFRTAVSTDHHVSINGGFKNLPYRVSLGYTDDNGIVKTSNFRRFTASVNLAPSFFEDHLKFNINAKFMNGKNRYADTGAAIGGALAIDPTRPVYSNEDPYQFTGGYWQNINSTTGFSNPDWKYTSNPNSPQNPLAALELKNDKANSNDFVGNVDVDYKFHFLPDLRLHASIGGEYAEGTQTTIVSPYSFGNNYYGWNGDVTQYKYNLSYNIYVQYIKSLGANDFDIMVGGEEQHFHRNGFEEGQGWDSYTQEPHDAKLREQTAYATRNTLVSYFGRLNYSLLNRYLFTFTMRWDGSSRFSKDNRWGTFPSLALGWKIKEENFLKDVNVLSDLKLRLGWGITGQQNIGDDFAYLPLYVVNNEYAQYPFGDTYYSTSRPKAFNENLKWEKTTTWNAGLDFGFLNGRITGGIDGYFRKTDDLLNSVKIPVGTNFNAQMTQNIGSLENYGMEFSINAKPIVTKDFTWDLSYNITWNHNEITKLTGGDDSDYYVEAGDKISRGNNTKVQAHKVGYAANSFYVYQQVYDENGKPIENMFVDRNGNGTIDSGDKYIYKKPAGDVLMGLTSKMQYKNFDFSFSLRASLNNYVYYDFLSNKANVSTSGLFSNNAYSNTSAEAVALGLSGQGDYMSDYFIHNASFLRCDNITLGYSFQNLWKTQTYKGVGGRVYATVQNPFIISKYKGLDPEVKSGIDANPYPRAMTFLLGLSLQF

SEQ ID NO: 9990 - protein, 2905 aa, Helicobacter pylori
MKKFKKKPKKITRKQKTILKRPLWLAPLLISGFASGVYANGTDILGLSWGEKSQRVCVQRPWYALWSCDKWEEKTQQYTGNQLITRTWAGGNAANYYHTQNNQNITANLKNDNGTYFLSGLYNYTGGEYNGGNLDIELGSNATFNLGASSGNSFTSWYPNGHTNVTFSAGTINVNNSVEVGNRVGSGAGMHTGIATLNLNANKVNINSNISTYKTSQVNIGNSNSVITINSVSLNGDTCSSLASVGIGANCSTSGPSYSFKGTTNATNTTFSNANGSFTFEENATFSGAKWNGGSYTFNKEFKATNNTTFNSGSFTFKGVSSFNGASFSNASYTFDNQATFQNSSFNGGTFTFNNQTNQTNSAQHPQIQNSSFNGNAITLKGSVIFQQAFNNSNHQLTIQNASFNNATFNNTGKITINDGASFNSMTFNTSINTSNMSVTGGVTLSGKNDLNNGSTLDFGSSKITLTQGTTFNLTSLGDKKSVTILNSSGGITYNNLLNHAINSLTNALKTNESSSRPQSFAQGLWEMITYNGVTGQLLNENAATSKPTDSSPPKSSSNPTQVYQVGYKIGDTIYKLQETFSPNSIIIQALESGTYTPPPTISGSQFDLSASNYINADMPWYNHKYYIPKSQNFTESGTYYLPSVQIWGSYTNSFKQTFSASNSNLVIGYNSTWTGNSVSSSDTVSFGDTSGSALNGHCGPWPYYQCTGTTNGTYSAYHVYITANLRSGNRIGTGGAANLIFNGVDSINIANATITQHNAGIYSSSMTFSTQNMDNSQNLNGLNSNGKLSVYGTTFTNQAKDGKFIFNAGQAVFENTNFNGGSYQFSGDSLNFSNNNQFNSGSFEISAKNASFNNANFNNSASFNFNNSNATTSFVGDFTNANSNLQIAGNAVFGNSTNGSQNTANFNNTGSVNISGNATFDNVAFNSPTNTSVKGKVTLNNITLKNLNAPLSFGDGTISFGTHSVINIGEAITNGNPITLVSSSKEIEYNNAFSKNLWQLINYQGHGASSEKLVSSVGNGVYDVVYSFNNQTYNFQEVFSQNSISIRRLGVSMVFDYMDMEKSDHLYYKDVVGFMTYMPNSYNNNLGNANNTIYYYDNSIDFYASGKTLFTKAEFSQTFTGQNSAIVFGAKSIWTSLSDAPQSNTIIRFGDNKGAGSNDASGHCWNLQCIGFITGHYEAQKIYITGSIESGNRISSGGGASLNFNGLQGILLTNATLYNRAAGTQSSSMNFVSNSANIQAQNSYFIDNTAQNGGNPNFSFNALNLDFSNSSFRGYVGKTQSVFKFNAKNAISFTNSTNLSSGLYQMQAKSVSFDNSNLSVSVGTSSIKANAINLSQNASINASNHSTLEFQGDLNLNDTSSLNLNQSTINVSNNATINDYASLIASNGSHLNFNGAANFNSANITTSLSNSFIVFKGASSLGGQFNLSNNSSLDFQGSSAITSNTAFNFYDNAFSQSPITFHQALDIKAPLSLGGNLLNPNNSSVLNLKNSQLVFGDQGSLNIANIDLLSDLNDNKNRVYNIIQAGMNSNWYECINFFGMRISDGIYDATNQTYSFTNPLNNALKIIESFKNNQLSVTLSQIPGIKNTLYNIGSEIFNYQKVYNNANGVYSYSDDAQGVFYLTSNVKGYYNPNQSYQASGSNNTTKNNNLTSESSVISQTYNAQGNPISALHIYNKGYNFSNIKALGQMALKLYPEIKKILGDDFSLSSLNDLNSNALNQLTKLITPNDWKNINELIDNANNSVVQNFNNGTLIIGATKIGQTDTNSAVVFGGLGYQTPCDYTDIVCQKFRGTYLGQLLESSSADLGYIDTTFNAKEIYLTGTLGSGNAWGTGGSASVTFNSQTSLILNQANIVSSQTDGIFSMLGQEGINKVFNQAGLANILGEVAVQSINKAGGLGNLIVNTLGSGSVIGGYLTPEQKNQTLSQLLGQNNFDNLMNDSGLNAAIKDLIRQKLGFWTGLVGGLAGLGGIDLQNPEKLIGSMSINDLLSKKGLFNQITGFISANDIGQVISVMLQDIVKPSDALKNDVVALGKQMIGEFLGQDTLNSLESLLQNQQIKSVLDKVLAAKGLGPIYEQGLGDLIPNLGNKGLFAPYGLSQAWQKGDFSFNAQGNVFVQNSTFSNANGGTLSFNAGNSLIFAGNNHIAFTNHAGTLQLLSNQVSNINITTLDANNGLKINAGSNNVSVSQGDLFINASCAQQSDPTAANATNPCALSAQSANGTSSSNASNNAPIALNNNDESLVVTANDFNFSGNIYANGVVDFSKVKGSANVKNLYLYNNAQFQANNLTISNQAVLEKNASFVTNNLNIQGAFNNNATQKIEVLQNLVIASNASLSTGIYGLEVGGALNHFGTINFNLENSQTPVNPLIQAEGIINLNTTQTPFINVNNSMANNTTYTLLKSSRYIDYNINPNSLQSYLKLYTLININGNHIEEKNGALTYLGQRVLLQDKGLLLSVALPSSNNAHQNNILSLSVLYDQIKMSYGDKAMDFTPPTLQDYIVGIQGQSALNQIEAVGGNAIKWLSTLMMDTKENPLFAPIYLKNHSLNEILGVTKDLQNTASLISNPNFRDNATSLLELASYTQQTSRLTKLSDFRAREGESAFSERLLELKNKRFSDPNPGEVFVKHSQPSKHQNNLWVQGIGGASFIAGGNGTLYGLNVGYDRLVKNVILGGYVAYGYSDFNGNIMHSLGNNVDVGMYARAFLKRNEFTLSANETYGGNASNINSSNPLLSVLNQRYNYNTWTTSVNGNYGYDFMFKQKSVVLKPQVGLSYHFIGLSGMKGKMNDAVYKQFLMHSNPSNESVLTLNMGLESRKYFGKNSYYFVTARLGRDLLIKSKGGNMVRFVGENTLLYRKGEVFNTFASVITGGEMHLWRLMYVNAGVGLKMGLQYQDINITGNVGMRVAF

SEQ ID NO: 9991 - protein, 884 aa, Helicobacter pylori
MRTLLITITIMGVLYASNGKIAGRVVEKETGSPAVGVNVILIDTYLGSATDENGRFTILNIPPGTYSIRVDAIGFATITMKDVRVTTSQTTELSFTLEEAVIEGQEVTVIAERPLVQKDLTASQRVTTAKEIEDMPVESFLGVLTTHAGVNQSAGGALHVRGGRSNEVGYYIDGVSVSNPFYTNSLAVSVSNKALEEMKLVSGAFNAEYGNAMSGVVNVTIKEGGKNYDGSLSYYTGDYSSSAHDIFPNIDDQDFTANSTLDGFISGPVLPFLGDRLTFNVSLRRSESEGYLYGIREHNTSDYAYFPPSGDWYIQNTGDSSYVPMNPSQSTNALSKITWRVSPTMKISTQSILSKAQSKSYSHAYKYNPDGVGTGYSANNNHSIKINHSLSPKSFYEANLFISDTDYKNYLYEDTTDSRYVSTDYINTEPTSATFLFGGTQMGHTYRVSNSVGGKFDFTIQMNNRHELKTGFSFRRDNLEERNFSILYNYNYRQPTVLPENESPYHVYYKKEALQYSAYIQDKMEYSSMIMNLGVRYDVFVPNDSSITDLVYPQAGKNDAGEKTMISPRVGVSLPITDKGIFHFSYGHFYQMPTLRNLYRESYFGAGLAPTVGYPDLKPEKTVLYEFGFQQQFGNLIGMDINLFYKDIRELLALQSIRYDSPQYGPSNYAIYLNKDYGSSKGLTLSVTKRYDPVSKTRIWLDYTYQKSEGNSVKSAAFYFSTLSGIEEEKLIVPLSWDQSHLLNATVIIGNPGGTTLGLIGKISTGWPYTPSIPTANYVPEPNSGRKPIQRNMDLKIERRVSIGSRKVSLFARVYNLFDIRNARYVFDDTGSPKYTYEYRSLQETEQFKAHYGEPGIHTWEEYITRPQYYSSPRSFKIGFSLDF

SEQ ID NO: 9992 - protein, 160 aa, Helicobacter pylori
MYYLRILILSISFLNILNAENLSYMSSSYQIGTVFMRPLNTNKLLQGASILQGYEVNPKNDWAYSRYYFFIDYGNVLFNNDSTLQANMFTYGVGGDFMVAYAKNPINRWAFFFGLQLAANTWILNNKVKDLVVNTWDSLKDFNFHNTYFRAIGKFGVQGR

SEQ ID NO: 9993 - protein, 240 aa, Helicobacter pylori
MGLKKYAILWSLMGFYAGLNALDYDTIDPKYYKYIKYYKAYEDKEVEELIRDLKRANAKSGLILGINTGFFYNHEIMVRTNSSSITGNILNYLFAYGLRFGYQTFRPSFFARLVKPNIIGRRIYIQYYGGAPKKAGFGDVGFQSVMLNGDFLLDFPLPFVGKYLYMGGYMGLGLGVVAHGVNYTAEWGMSFNAGLALTVLEKNRIEFGFKILNNFPFLQSNSSKETWWGAMANIGYQYVF

SEQ ID NO: 9994 - protein, 1022 aa, Helicobacter pylori
MCSIVRTVCPRAKALEGVAIGNVAQHLARWHVEKRERSNGKQWAVAILTLTGMASAATAMAGTVEGDLKEASSGKPAANAKVRIAGTAYSAVADARGHFVIRDVPAGQYALNLEYPGFSAAETSIQVGETGTASVAIALEEVKQMKAISVVSNRYDASDLKINAANTVDVLSANDLQRTAVHNVAEALGLIAGINITSTGSGYFGGIDGAARGEGMFASVRGLPSEYNVNMIDGVTVAQGMPYSRSVQLSLLPPTGLQTIVANKTSTADMDGDAIGGTLDFRTPTAYDFKDTTSGSVTGSGRVESRARDYGGDGLGGGFGGEFQHKFGDAQQFGVYASAYYDYRTTTNSEVAAATSALNDGSWEYLNTDANGGNAAGFDPQHNLTSTGMNVGIAAGWERRYGGNASFDRHVDDTLSLYARMTYAYAKTDQGTTFVQLLPQDVRYVPTGTPGVYTPNIGRIASRFWYETNPEIADLATFQIGAKKTVGGWTFMPNVFYSFGDNDRPDHVEIDGREDKFTQDNYAYSSNTLVAYGGGAFPYPQLTPALQAQVNNIPSLYAGSYGELTKIYSGQKKGGARVDTRYDFEEDGALRSVQFGVKYSKSRRRYTNRDWYTGGVDGTTTLGELGIFTGTYASIFPGKYDWNTPRVSEAAVAGVIAQHLTDDDLDTCGNAFYVNNFNCNTMRGTEAVGAAYASATFIMGNLDIVPGVRLEHTAINNTFWVSPTDADGNDIAGYFDHNHASYNEPLPSVFLTWRPDLRTAYRASLWTSYTRPAFVQLGGGSQIDISNGVTTITQGNPDLKPIESTNLDLSGEWSTQHGGFFSLAGFYKQLRNYIYDAGSAQANGSTTGSGTVLYHMPTNGGDGKIYGVEISARQKFQDLPAPFDGLGVSANATRQHARADLGLDGFENEHMQSAPAAMANLEVFYEHNGFSLNLSYHFSSSYLLGYDFLHEGAPWNDLWARPTRRVDLHTGYRFDNGVSMDLSISNLTKEYSYWAHIGRRNLAISDIVDAGSTALFTVKYAF

SEQ ID NO: 9995 - protein, 246 aa, Helicobacter pylori
MKFKVIALAALMGISGMAAQANELPDGPHIVTSGTASVDAVPDIATLAIEVNVAAKDAATAKKQADERVAQYISFLELNQIAKKDISSANLRTQPDYDYQDGKSILKGYRAVRTVEVTLRQLDKLNSLLDGALKAGLNEIRSVSLGVAQPDAYKDKARKAAIDNAIHQAQELANGFHRKLGPVYSVRYHVSNYQPSPMVRMMKADAAPVSAQETYEQAAIQFDDQVDVVFQLEPVDQQPAKTPAAQ

SEQ ID NO: 9996 - protein, 186 aa, Helicobacter pylori
MIKRIACILSLSTSLALAGEVNGFFMGAGYQQGRYGPYNSNYSDWRHGNDLYGLNFKLGFVGFANKWFGARVYGFLDWFNTSGTEHTKTNLLTYGGGGDLIVNLIPLDKFALGLIGGIQLAGNTWMFPYDVNQTRFQFLWNLGGRMRVGDRSAFEAGVKFPMVNQGSKDVGLIRYYSWYVDYVFTF

SEQ ID NO: 9997 - protein, 843 aa, Helicobacter pylori
MQKTKLALLFAGIFAMPATAHAEETEISTSEDLGIETLETIVVQDTSFSQQIGTQKITEAQIKRRPSTNGNITELLKSNPTVAFSNQAETSIGAGEIKPEEISFHGEKFYNNNFTVDGITNNDNMNPASGNATLNAQNGMEVYELPSEGSQSMWIDSSLLKSVEAFDSNVSAKYGNFTGGVVNAEIKDPEFDKQHGRISYRTTRGSWAKFHVQDKNVDDFYKANRYDFQPEFTKNIYSVSVSQPLSENTSLLFSYNRTESDIKYLHPYLYYTDNPLGYVTETQKRVNETYLLKGVHIAENGDIWKATFMYSPHKSKSFKPNVVGGGYSNNGGGYNFNLTWDKEYDNLKMNTVFSYKRVGNEIEHDVDTYRRYVSTGASGGTIDWRSNSSGYALYGGYGSYKTQKDTYTIKQNYSLKEFDLGDTSHKLIFGWSAELAQAKYKRDHEAWQYYYESANISCNGMNECIEGEQYATSAQAYAAKNVKVNDSSYAAYIEDRIKWKNVDLNLGARVDYNQYLKNVNVAPRISINYDVFSDGNTNIFGGYNRYYANSMLAYKLREGIGNRDRWYRNASTNYVWTLRASGTSYPYATSDLETPYSDEFVLGVGQKMWGIDTVLKWVHRNGRDQFTRKTINGYYTLTNDGWSKNDNITLSFDKIGEYKFKYANMDWGLSFRYNKNETSGSNYDANATYFDNEYAVYNGRLIQADDLPSNDYNSKWAATLNVNTEFPSIRLTWDQRLSWVGAYDYIKATSTSINCQYSNYQSICGSLYGQDIDATVYEDASIGSQLLLDWRFAYKQPITKDQYIEITLDVNNVLDSKAKASSSGSTIYYKMGRNFWLGASYNW

SEQ ID NO: 9998 - protein, 791 aa, Helicobacter pylori
MFLRLYPKLRYALCLPLLAETCYSEERTLNKVTTQAKRIFTYNNEFKVTSKELDQRQSNEVKDLFRTNPDVNVGGGSVMGQKIYVRGVEDRLLRVTVDGAAQNGNIYHHQGNTVIDPGMLKSVEVTKGAANASAGPGAIAGVIKMETKGAADFIPRGKNYAASGAVSFYTNFGDRETFRSAYKSAHFDIIAYYTHQNIFYYRSGATAMKNLFNPTQADKEPGTPSEQNNALIKMNGYLSDRDTLTFSWNMTRDNATRPLRSNAIGLAYPCEAPFSPDGAQGCPNVLDSFTRYMYHSINSANNLSLQYKREAGNSFGDPRLDFTLYTSIRNAQFDPLFDPNGVYAKFPTSLASAWEKENYPCVEGGYCTPSFSDVDKPSSQPRNLFLNNTGLNLKVAHVIDEATDSLFEYGFNYQNLSVFDARIPKSELYRPNQVYTDDKGQKQIACTLVDNNPNDPTLCQRGKANGNIYGGYVQANYAPHKIITFGAGVRWDAYTLYDKDWNHRYTQGFSPSAALVLSPIEPLSLKITYSQVTRGVMPGDGVYMRQNDLRYAKNIKPEVGSNAEFNIDYSSQYFSGRAAAFYQALDNFISQYAQSLIVTNLSQAIRIYGYEVGGTFKYKGVSLNVGISRTWPTTRGYLMADSYELAASTGNVFIIKLDYTIPKTGINLAWLSRFVTGLDYCGFDIYLPDYGTAEKPKTPTDLAKCGSKLGLVHMHKPGYGVSNFYINWSPKTKSHWKGLLLSAVFNNVFNKFYVDQTSPYIMSPDMPGTDAIKRAIAEPGFNARFEVAYKW

SEQ ID NO: 9999 - protein, 587 aa, Helicobacter pylori
MKNFSPLCCFKKLKKRHLIALSLPLLSYANGFKIQEQSLNGTALGSAYVAGARGADASFYNPANMGFTNDWGENRSEFEMTTTVINIPAFSFKVPTTNQGLYSVTSLQIDKSQQNILGIINTIGLGNILKALGNTAATNGLSQAINRVQGLMNLTNQKVVTLASNPDTQIVNGWTGTTNFVLPKFFYKTRTHNGFTFGGSFTAPSGLGMKWNGKGGEFLHDVFIMMVELAPSMSYTVNNRFSVGVGLRGLYATGSFNNTVYVPLEGASVLSAEQILNLPNNVFADQVPSNMMTLLGNIGYQPALNCQKSGGDMSDQSCQEFYNGLKKIMGYSGLIKASANLYGTTQVVQKSNGQGVSGGYRVGSSLRVFDHGMFSLVYNSSVTFNMKGDLVAITELGPSLGSVLTKGSLNINVSLPQTLSLAYAHQFFKDHLRIEGVFERTFWSQGNKFLVTPDFANATYKGLSGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPTIGQLRIFSASLGYRW

SEQ ID NO: 10000 - protein, 278 aa, Helicobacter pylori
MNKLLKKGFLAFFLSVYLRADDLVTYTIIKKEDLGFQRFLAKKCLRGKAHPPCFAEPKKPKKKLFNTDKSSHYYGTSVVQMSWLQSREKFENHSKYRDIPFAEVSLIYGYKQFFPKKERYGLRFYISLDYAYGFFLKNKGTLGDSLRESSQIPKSYREKLQRKETFINAIFYGVGADFLYKRAFGTLILGMNFVGETWFYETKIFKKWAKDPLSVYHPYMFQVMLNVGYRYRFSRYKNWAIEFGARIPFLTNDYFKTPLYTLHFKRNISVYLTSTYDF

SEQ ID NO: 10001 - protein, 305 aa, Helicobacter pylori
MGRIESKKRLKALIFLASLGVLWGNTAEKTPFFKTKNHIYLGFRLGTGANARTSMWQQAYKDNPTCPSSVCYGEKLEAHYKGGKNLSYTGQIGDEIAIDKYHILGLRVWGDIEYAKAQLGQKVGGNTLLSQANYNPSAIKTYDPISNAQGSLVLQKTPSPQNFLFDNGHFMAFGLNVNVFVNLPIDTLLKLALKTEKMLFFKIGVFGGGGVEYAILWSPQYKNQNTNQDDKFFAAGGGFFVNFGGSLYIGKHNRFNVGLKIPYYSLSAQSWKNFGSSNVWQQQTIRQNFSVFRNKEVFVSYAFLF

SEQ ID NO: 10002 - protein, 307 aa, Helicobacter pylori
MKKALLLSLFLSFWLHAERNGFYLGLNFAEGSYIQGQGSIGEKASAENALNQAINNAKNSLFPEQNTKAIRNAQNALNEVKDSTKIANRFAGNGGSGGLFNELSFGYKYFLGKKRIIGFRHSLFFGYQLGGVGSVPGSGLIVFLPYGFNTDLLINWTNDKRASQKYVERRVKGLSIFYKDMTGRTLDANTLKKASRHVFRKSSGLVIGMELGGSTWFASNNLTPFNQVKSRTIFQLQGKFGVRWNNDEYDIDRYGDENYLGGSSVELGVKVPAFKVNYYSDNYGDKLDYKRVVSVYLNYTYNFKNKH

SEQ ID NO: 10003 - protein, 212 aa, Helicobacter pylori
MKKFTVVALALTTLLSSSVYAHEAGEFFMRAGPATVRPTEGAGGTLGHLNGFDVSNNTQLGLTFTYMATDNLGVELLAATPFRHKVGTGATGDIATVHLLPPTLMAQWYFGDSSSKVRPYVGIGVNYTTFFDNDFNDNGKKTGLSDLSFKDSWGAAGQVGVDYLINRDWLIGASVWYMDIDTTANYKMGGVQQHDSVRLDPWVFMFSAGYRF

SEQ ID NO: 10004 - protein, 767 aa, Helicobacter pylori
MKRILVSLAVLSHSVHAVKTHNLERVEASGVANDKEAPLSWRSKEVRNYMGSRTVISNKQLTKSANQSIEEALQNVPGVHIRNSTGIGAVPSISIRGFGAGGPGHSNTGMILVNGIPIYVAPYVEIGTVIFPVTFQSVDRISVTKGGESVRYGPNAFGGVINIITKGIPTKWESQVSERTTFWGKSENGGFFNQNSKNIDKSLVNNMLFNTYLRTGGMMNKHFGIQAQVNWLKGQGFRYNSPTNIQNYLLDSLYQINDSNKITAFFQYYSYFLTDPGSLGIAAYNENRFQNNRPNNDKSGRAKRWGAVYQNFFGDTDKIGGDFTFSYYGHDMSRDFKFDSNYLNVNTNPKLGPVYTNQNYPGFFIFDHLRRYVMNAFEPNLNLVVNTNKVKQTFNVGMRFMTMDMFIRSDQSTCEKSDIIDGVCHMPPYVLSKKPSNNQEMFNNYTAVWLSDKIELFDSKLVITPGLRYTFLNYDNKEPEKNDFSVWTSKKQRQNEWSPALNIGYKPMENWIWYANYRRSFIPPQHTMVGITRTNYNQIFNEIEVGQRYSYKNLLSFNTNYFVIFANRYYAGGYSPQPVDARSQGVELELYYAPIRGLQFHVAYTYIDARITSNADDIAYYFTGIVNKPFDIKGKRLPYVSPNQFIFDMMYTYKHTTFGISSYFYSRAYSSMLNQAKSQTVCLPLNPEYTGGLEYGCNSVGLLPLYFVLNVQVSSVLWQSGRHKITGSLQINNLFNMKYYFRGIGTSPTGREPAPGRSITAYLNYEF

SEQ ID NO: 10005 - protein, 270 aa, Helicobacter pylori
MKKFVVFKTLCLSAVLGNSLLATEGNVDVQKQLEKPKEYKAVKGEKNAWYLGISYQVGQASQTVKNPPKSSEFNYPKFPVGKTDYLAVMQGLGITVGYKQFFGEKRWFGTRYYGFMDYGHAVFGANALTSDNGGVCELHEPCATKVGTMGNLSDMFTYGVGIDTLYNVINKEDATFGFFFGAQIAGNSWGNTTGAFLETKSPYKHTSYSLDPAIFQFLFNLGIRTHIGRHQEFDFGVKIPTINVYYFNHGNLSFTYRRQYSLYVGYRYNF

SEQ ID NO: 10006 - protein, 490 aa, Helicobacter pylori
MDIDTKDKSYTFDYEYRPTQNITLSTSLYKQEQDRNINTESIDDIKIIASNRRFSHITQEKIFYDVKSEMQAKFEEDKKGLKVKAKFDYNLVGDNASETILGYDYQTSTNKRKSLVQSETLKNYYDSSIGGFRNLDSTDRSPIINKVDMKMTKKSEGMYIFNKWGLSNWLDVTLGGRIERTKYNGYRENGPNVMPYVTPEKKRIDTDEKLTNYAGELGFLFKYNDTGRIYTRYERGFVTPFGNQLTDKVHDTELKNKQAGIIVPPSVNVASKYVANNLKSEKTDTFEIGFRDYILGSSISTSFFLTDTADEITLISSGVTNPAVNRWKYRNIGKTRRLGIEFEAEQNIGKFRFNQSLTLVRTKVLIANDEARIAKGDQVPMVPRLKATLGVKYNFTDRLSGYLNYVYLAKQESRELRENPDISKDDVVVKHTIGGHGTLEAGLSYKPDNYSDIKIGAKNILSNKYNLRETSLEALPAPKRNYYLQLNVRF

SEQ ID NO: 10007 - protein, 2910 aa, Helicobacter pylori
MKRFKKKPKNTKRSHQKIILKRSLWLAPLLISGFASGVYANGTDILGLSWGEKSQRVCVHHPWYAMWECNKWEEKTQQYTGNQLITQTWSWGNAAHYYHTQNNQNITANLKNDNGTYFLSGLDNYTGGEDNGGNLDIELGSNATFNLGANSGNSFTSWYSNGHTDVTFSAGTINVDNTVEVGNRVGSGAGTHTGTATLNLNANKVNINSSISAYKTSQVNVGNTNSAITIGSVSLSGNVCSSLATWGSGSNCSTSGPGYSFEGNVNATNTTFSNSKGSFTFGENATFSGAKLDGGTFTFNKEVSATNNTAFNSGNFTFEGASSFNGASFNNASYDFDNQATFQNSSFNGGTFTFNNQNNQTNSTQPPQIAFENSSFSGNATTLKGSVDFQQAFNNSNHQLTIQNASFNNATFNNTGKITINENASFNGTTFNTSIDTNNMTITGGVTLSGNNDLKNGATLDFGSSKVTLTQGTIFNLTGLGSKNSVTILNSSGGITYNELLNHALNSLTNALKTSKSSSLPQSFAQGLWDMITYDGVIGQLLSENTTTSKSTDTPPNSTQIYQVGYKIGDKIYKLQETFSHNSITIQALASGTYTPPPIISGSQFNLSTSNYMDSDIHWYNHEHYIPKSQNFTESGTYYLPSIQIWGSSNNSFKQTFSANNSNLVIGYNSTWTGNSVSSSDTVSFGDTSGILLSGHCGPWPYYQCTGTTDGTYSAYHLYITANLRSGNRIGTGGAANLVFNGINSVNIANANIEQHNAGIYSSSMTFSTQNMDSQQGLNGLNSNGKLSVYGTTFTDQAKDGKFTFNAGQATFENTNFNGGTYQFSGDSLNFLNNDQFNSGSFEISTKNASFNNANFNNNASFNFNNSSATTSFIGNFTNANSNLQIAGNAVFGNSTNSNGSQNNANFNNTGSMTISGNATFNNVTFNSPTNTSVKGQVTLNNITLKNLNTPLSFGDGTISFGTHSVINVDQAITNGNPITLLNSSKEIDYNNAFAKNLWQLINYQGHGASSEKLVSSVGDGVYDVMYSFNNQTYNFQETFSPNSISIRRLGVGMVFDYMDMEESDHLYFKNAVGFMTYMPNSYNNNLGNANNTIYYYDNSIDFYASGKTSFTKADFSQIFTGQNSAIVFGAKNIWTSASDVPQSNTIIRFGDNKGAGSNGASGHCWNLQCIGFIIGNYEAQKIYITGSIESGNRISSGGGASLNFNGLQGILLTNATLYNRAAGTQSSSMNFISNGANIQAQNSYFIDDTAQNGGKPNFSFNALNLDFSNSSFRGYVGKTQSVFKFNATNAINFTNSTNLSSGLYQISANSVSFDNSNLSVSVGTSSIKANAINLSQNASINTSNHSTLELQGDLNLNDTSSLNLNQSTINVSNNATISDFASLIVNNGSHLNFNGAVNFNSSNITTSLNDSSIVFKGAVSLGGQFNFSNNSSLDFQNSSAIISNTAFNFYDNAFSQSPITFHKSLDLKASLSLGGNLLSPNNSSVLNLENSQLVFSDQGSLNIANIDLLSGVSGNKSRVYNIIQADMSNNWYQYINFFGMHINNGVYDAANQTYSFTDPLNNALKITESFKDNQLSVTLSQILGVTNTLYNISSEIFNYQKVYNNANGVYSYSDDAQGVFYLTSNVKGYYNPNKSYQASGTNNTTLNNNISSDSSVISQTYNAQGNPIQALHIYNKGYNFNNIKALGQMVLKLYPEIKKILGNDFSLSNVSALNSSALSQLAKLITPSDWENINEFIDNADNSVVQNFNNGTLIVGATQIGQTNTNSTIVFGGLGYQKPCDQTDIVCQEFRGTYLGQLLESSSADLGYIDTTFNAKEIYLTGTLGSGNAWGTGGSASVTFNSKTSLILNQANIVSSQTDGIFSMLGQEGINKVFNQAGLANILGEVAVQSIDKAGGLGNLIAGMLGSDGVIGGHLTPEQKNQTLSQLLGANNFDNLMNDSGLNTAIEGLIRQKLGFWTGLVGGLAGLGGIDLQDPEKLIGSMSINDLLSKKGLFNEITGFISASDIGQVISVMLQDIVKPSDALENDVAALGKQMIGEFLGQNTLNSLESLLQNQQIKSILDKVLAAKGLGPIYEQGLGDLIPGLGKNGLFAPYGLSQLWQKGDFNFNAQGNVFVQNSNFSNANGGTLSFNAGDTLIFAGNNDISFTNHTGTLNLLSNQVSNIDITELNASNGLKMNAVNNNVSVSQGDLFINASCVKQSDPTTQNGINPCALNATQNTNNTSNNASNNTQIALNNNDESLSVTANNFNFLGNIYANGVVDFSKIKGSANIKNLYLYNNAQFQANNLTVFNQALLEKNASFVTNNLNIQGAFNNNATRKIEALQNLTIASNASLSTGVYGIEVGGAFNNFGAINFNLENPQTPATPLIQAGGVIDLNATQTPFMNVNNGMANNTAYTLLESSRYINYNINPNSLQSYLKLYTLININGNHIEENNGVLTYLGQRVLLQDKGLLLSVVLPNSSQNNASENNILSLSVLYNQIKMSYGNKIMGFIPPTLQDYIVGIQGQSALNQIEATGGNNAVKWLSALMMETKENPLFAPIYLENHSLNEILGVTKDLQNTASLISSPNFRDNATSLLEMASYTQQTSRLTKLSDFRSKEGEFSFSDRLLELKNKRFSDSNPSALEVFVKYSQISKHPNNLWVQGVGGASFIAGGNGTLYGLNVGYDRLVKNVILGGYVAYDYSNFNGYIIHSLANNVDMGMYARAFLKRNEFTLSANETYGGNVTNINSSNPLLSVLNQRYNYNTWTTSVNENYGYDFMFKNKSVVLKPQVSVSYYFIGLSAMKGKMNDAAYQQFVMHSNPSNESVLTLNMGLEGRKYFGKNSYYFVTARLGRDLLIKSKGDNIVRFVGENTLLYRKGEVFNTFASVITGGEMHLWRLMYVNAGVGLNIGLQYQDINITGNVGMRVVF

SEQ ID NO: 10008 - protein, 943 aa, Helicobacter pylori
MKKIVLFIILAFASNQIVNAQKNGIISGKITEAETNFSLPGATIKLEGINKYTYSNQNGEFEFLNIPEGNYQVEITYIGYEKQTQEVKVEAGKNTNIKFVLITASNELENVVVIGDRLRGQAKALNKQKSNQNITNVISSDQTGRFPDANIGDALKRVQAITMQNDQGEARNIIIRGLAPNLNSVTLNGDRIPSAEGDNRNVQMDLIPADMISTIEVNKTLTSDMDADAIGGSVNLITRATPNGERISATLAGGYGPIREKGNYTAGFVYGNRYLENKLGVVFSASYFNNIFGSDNVEAVWVKDDFDNVYIEEYDVRKYDVQRIRNSFAFATDYKFNNNNSIYFNAMYNIRDDRENRYRARYRGIDPIYDVNANIIGFEGDVRRQTKGGIDNKKNKNARLERQKVQNYSIGGEHLLSPKLDMDWSVNYAEASEDRPNERYIEFQNKGLDFDMNLNNARFPLITGIGDNLAEDFEFRTLSENKNYTEESELGAKINFRVPFSIIENQKGRIRFGARLRIKDKFRNNNFFEYEPIVDFGNLNTLQTTSYGGENWQAGSQYIPGTFVSNSFLGNLDLNNSAIFNKQDIPSEYLGLNYKAKENIYAGYIRYDQDFNDKLSMIAGLRLENTFIDYTANYIENEEDLVGEINNTNSYTNVLPSLAFKYNNEKDWVYRAAFTTSIARPNYYALSPFLSVIPDDDSAIDAGNPNLKATYAYNFDLMLEKYYKSVGLLSGGVFYKKLNDFIYTYRDNQYTNAKFSQDFPDLVNPIPTVNPGNWSLTQQRNGEKVSVYGFEVAVQRQLDFIPGKFFKGLGIYLNYTYTDSKAEGITNADGDERKDVTLPGTATHMFNSSLSWENKKFSARISLNYTADYLDELGGDSFDDRFYDKQTFVDANASYKFTKQLRIFAEANNLTNQPLRYYQGVSARTMQMEYYQARFNLGLKFDF

SEQ ID NO: 10009 - protein, 1288 aa, Helicobacter pylori
MEIQQTHRKINRPLVSLVLAGALISAIPQESHAAFFTTVIIPAIVGGIATGTAVGTVSGLLSWGLKQAEEANKTPDKPDKVWRIQAGKGFNEFPNKEYDLYKSLLSSKIDGGWDWGNAARHYWVKGGQWNKLEVDMKDAVGTYKLSGLRNFTGGDLDVNMQKATLRLGQFNGNSFTSYKDSADRTTRVNFNAKNISIDNFVEINNRVGSGAGRKASSTVLTLQASEGITSSKNAEISLYDGATLNLASNSVKLNGNVWMGRLQYVGAYLAPSYSTINTSKVQGEVDFNHLTVGDQNAAQAGIIASNKTHIGTLDLWQSAGLNIIAPPEGGYKDKPNSTTSQSGTKNDKKEISQNNNSNTEVINPPNNTQKTETEPTQVIDGPFAGGKDTVVNIFHLNTKADGTIKVGGFKASLTTNAAHLNIGKGGVNLSNQASGRTLLVENLTGNITVDGPLRVNNQVGGYALAGSSANFEFKAGVDTKNGTATFNNDISLGRFVNLKVDAHTANFKGIDTGNGGFNTLDFSGVTDKVNINKLITASTNVAVKNFNINELIVKTNGISVGEYTHFSEDIGSQSRINTVRLETGTRSIFSGGVKFKSGEKLVINDFYYSPWNYFDARNVKNVEITRKFASSTPENPWGTSKLMFNNLTLGQNAVMDYSQFSNLTIQGDFINNQGTINYLVRGGKVATLNVGNAAAMMFNNDIDSATGFYKPLIKINSAQDLIKNTEHVLLKAKIIGYGNVSTGTNGISNVNLEEQFKERLALYNNNNRMDTCVVRNTDDIKACGMAIGNQSMVNNPDNYKYLIGKAWRNIGISKTANGSKISVYYLGNSTPTENGGNTTNLPTNTTNNAHSANYALVKNAPFAHSATPNLVAINQHDFGTIESVFELANRSKDIDTLYTHSGAQGRDLLQTLLIDSHDAGYARQMIDNTSTGEITKQLNAATDALNNVASLEHKQSGLQTLSLSNAMILNSRLVNLSRKHTNHINSFAQRLQALKGQEFASLESAAEVLYQFAPKYEKPTNVWANAIGGASLNSGSNASLYGTSAGVDAFLNGNVEAIVGGFGSYGYSSFSNQANSLNSGANNANFGVYSRFFANQHEFDFEAQGALGSDQSSLNFKSTLLQDLNQSYNYLAYSATARASYGYDFAFFRNALVLKPSVGVSYNHLGSTNFKSNSQSQVALKNGASSQHLFNANANVEARYYYGDTSYFYLHAGVLQEFAHFGSNDVASLNTFKINAARSPLSTYARAMMGGELQLAKEVFLNLGVVYLHNLISNASHFASNLGMRYSF

SEQ ID NO: 10010 - protein, 737 aa, Helicobacter pylori
MKKHILLLTLGSLLVSTLSAEDDGFYMSAGYQIGEAAQMVKNTKGIQDLSDRYESLNNLLTRYSTLNTLIKLSADPSAINGVRNDLGASAKNLIGNKANSPAYQAVLLAINAAVGFWNVVGYVTQCGGNANGTKSISSTTIFNNEPGYRSTSITCSLNGHTPGYYGPMSIENFKKLNEAYQILQTALKKGLPALKENNGTVNVTYTYTCSGEGNNNCDALKDNGNGGSKTKTQTIDGKTVNTTISSKVVQPSHGAAYTEITNQLSGVPDSAQALLAQASTLINTINTACPYFHANNSSEANAPKFSTTTGKICGAFSQEISAIQKMITDAQELVNQTSVINSNEQSAQVGANNNGKPFNPFTDASFAQGMLANAQAQAKMLNLAEQVGQAINPERLTGTFKNFVTGFLATCNNKSTAGTGGTQGSAPGTVTTQTFASGCAYVEQTLTNLNNDIAHFGTRAQQIQQAENIADTLVNFKSRYSELGNTYNSITTALSKVPNAQSLQNVVSKKNNPYSPQGIETNYYLNQNTYNQIQTINQELGRNPFRKIGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKLNVANFQFLFNMGVRMNLARSKKKGSDHVAQHGIELGLKIPTINTNYYSFMGAELKYRRLYSVYLNYVFAY

SEQ ID NO: 10011 - protein, 912 aa, Helicobacter pylori
MIRKIAYTFFSFLICCNVSLAWGQTFAFRGTVLDEQTHKALDYATIQLFVEKQFAYGGITDANGHFELLHIHPGTYRIIISYLGYDSTEKEIKVVGNTSDIFYLKPSNMALNEVVVTASESKRATSASIVDRTAMKHLQPSSFSDLMELVPGGKSADPQMGQANLIRIRETGKTEDISSLGVGFYIDGIFQNTDANLQYMPSSTSAVNATSTMSKGVDMRTIPTDNIEKVEIIRGIPSVAYGNVANGAVIIQRKTSESPLSARFKADKTSKLFSVGKGFRLDGNGRYVLNTDLSYLDSKIDPRNSVKNYTRLTASARLDGKWLWNERNIHWNLSTDYTGSFDDAKRDKDATVKEDSYKSDFSSFKMAGKWNLKFSNHSWIREIHAATSVSWQWEKMRETKSVSLNRPAAIATQTETGESDGIYLPYNYVAQMEIDGKPLYVTVSARTHLAFPLGGLQNRMNLGVEWNYQKNLGKGQVFDVTRPISEGLSTRPRRFKDIPGLQPFAFYAEEVLNLPVNKHKLAFTAGIRLQSLLGLDRKYEMQGKIYPDLRLDMQWSLPTSNGWNIAFSGGLGWISRMPTTAQLYPDFKYVDLIQLNYYHNHPDYRRINMMTYKWDNTNYQLEPARNMKWEVRADIGYKGNRLSATYFRERMNNAFDDLTYYKSLAYKLYDPASIDGSALTAPPELSQLTYANEYNLDVYSTQGNGMKVHKEGVEFQFASRRIESLKTRVTVYGAWIKTVYSSDSPKYKASSILLDNKQLKYVGLYQGENGTESQAFNTNFMFDTYIQRLGLTFSTSAQCTWYTNRRNLWNNGVPVSYIDQSGETHLFREEDKNNIQLQHLVEKYSATYFERTTVPFYMDINLKASKRIGKYLNLAFYVNRLLGIYPDYTLRGVLQRRTSESPYFGMEMNLTF

SEQ ID NO: 10012 - protein, 527 aa, Helicobacter pylori
MKQNLKPFKMIKENLMTQSQKVRFLAPLSLALSLSFNPVGAEEDGGFMTFGYELGQVVQQVKNPGKIKAEELAGLLNSTTTNNTNINIAGTGGNVAGTLGNLFMNQLGNLIDLYPTLKTNNLHQCGSTNSGNGATAAAATNNSPCFQGNLALYNEMVDSIKTLSQNISKNIFQGDNNTTSANLSNQLSELNTASVYLTYMNSFLNANNQAGGIFQNNTNQAYENGVTAQQIAYVLKQASITMGPSGDSGAAGAFLDAALAQHVFNSANAGNDLSAKEFTSLVQNIVNNSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 10013 - protein, 813 aa, Helicobacter pylori
MNDKRFRKYCSFSLFLSLLGMFELEAKEEEKEERKTERKKDKKKNAQHTLGKVTTQAAKIFNYNNQTTISSKELERRQANQISDMFRRNPNINVGGGAVIAQKIYVRGIEDRLARVTVDGAAQMGASYGHQGNTIIDPGMLKSVVVTKGAAQASAGPMALIGAIKMETKSASDFIPKGKDYAISGAATFLTNFGDRETIMGAYRNHHFDALLYYTHQNIFYYRDGDNAMKNLFDPKANNKVTGSPSEQNNVMAKINGYLSERDILTLSYNMTRDNANRPLRANFTGTFLPYSCGDFNAFPNEKNPSDCLFENDASLFKTYSVNLVHNVSLNYEREGGSRFGDPKLKINGYTSIRNVQIDPLFKPNDIAAIIPFTPNPKLSEENECVAQGGIYDALKQTCSITFKSLGGGSVVANKNLFIINSGFNANVIHTIDHKNDNLLEYGLNYQNLTTFDKAIPNSELVKPGDAPDACLRVTSPNDPNMNGRCQRNGATANVVGVYAQANYTLHPMVTLGAGTRYDVYTLVDKDWQLHITQGFSPSAALNVSPLENLNFRLSYAYVTRGPMPGGLVWMRQDNLRYNRNLKPEIGQNVEFNTEYSSQYFDFRAAGFVQLISNYINQFSSTLFVTNLPAQDIIYVPGYEVSGTAKYKGFSLGLSVARSWPSLKGRLIADVYELAATTGNVFILTASYKIPRTGLSITWLSRFVTDLSYCSYSPYRNGPTDIDRRPSNCPKTPGIFHVHKPGYGVSSFFITYKPTYKKLKGLSLNAVFNNVFNQQYIDQASPVMSPDEPNQDKYARGMAEPGFNARFEISYKF

SEQ ID NO: 10014 - protein, 656 aa, Helicobacter pylori
MRKLFTSFLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKIDPYTLFLPKIEATSTSVSDANTQRVFETLNKIKTNLIMKYSNENPNNFNTCPYNNNGNTKNDCWQPFTPQTAEEFTNLMLNMIAVLDSQSWGDAILNAPFDFTNSSTDCDNNSSKCVNPGINGRVDSKVDQQYVLNKQGIVNNFRKKIEIDAVVLKNSGVVGLANGYGNDGEYGTLGVEAYALEPTKLFGNNLKTINLQDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQSFRSPILGVNAKIGYQNYFNDFIGLAYYGIIKYNYAKASSEKVQQLSYGGGIDLLVDFITTYSNKNSPIDIQTRRNFSSSFGIFGGLRGLYNSYYALNKVKGSGNLDVATGLNYRYKHSKYSVGISIPLIQRKASIVSSNGDYTNSLVFNEGASHFKVFFNYGWVF

SEQ ID NO: 10015 - protein, 624 aa, Helicobacter pylori
MLRFSLGIAALASIHSFPLIASADGMRLEDTIVTASRSEQKSSEVLGDVSVISQEQIQRAGQSSVLELLGREPGIEIMHNGGLGKSTDIFIRGANSTHTLVLIDGIRVSSATSGTTAIQNISLNQIDHIEILRGPASSMYGADAIGGVIQIFTKSGKGQPRLQASAGLGTYGTAIGDIGVSGRISDTSFSLQAGATHTHGVSAYNRHHRNYNPDHDGYRNQNLNARITQHLSEHHELGFNAFISDNKNFHDGAVRANEYYGEQTLSSYTVHSKNRFTDNWTSTLSIARSMDDLASYSKSATATSRDTIKTTQDQYLWQNTVTTDLGVFNAGLEYRKQKVESNADLAEDRRNIRSWMAGWQKQFDRHGLQMNLRNDDSTQFGDKTTGSINYGYHITPQLRAGAAFGTAFAIPTFNQLYSPLNPAFNYIGNAELRPEESRNKEISLQYDNGTHQIGAIYYHNEVDNLIANSRSLVNGVNRLMPTNINEAVLRGLTLSYKGNFTDWRLYGSADLQRPEDRGDTTSGNLLPRRAKAHANFGVSRTWQSFELGSELEASSYRYDNINNTPSSRMSGYTLVNVYANYRINPDWTLNARVNNLFDRHYELAQGFSTLGANLFVSLRYAPAF

SEQ ID NO: 10016 - protein, 234 aa, Helicobacter pylori
MNETASRGIWLFGLYIATCCVTAIAQSDDTKNTVKIGYAALNFNASSGELTGPPGTTPAGATTGINNAQTAGLIYERKVSGPWSFVGQIGYPLTIQFKGAGTAAALGQVGSAKAWFPSALVTYSFAGPQTLRPYVGAGANYAFFTQPQAGPAYNGAFGGTSSTVGLKSSLGAVAKLGMEIPLSNTWVVDIAYSRYWIKTTATIVTATPNVGNIERKVDIKTTPEVFGVFLGYRF

SEQ ID NO: 10017 - protein, 801 aa, Helicobacter pylori
MKRALALASISLLVVAAPAGAAERAALDLPAGRLSDAVAALAAQTGASISVTDGSIWAMRVAPLRGRMSAEDALRRLLRGSRARLVVLGDRSFRIVAARDAAAPPRSARPAPPAAIVEGEEPPIIVTASKRDTRLRDFPGSVSILDGADLTFGGEQGMESVLARVASLSSTHLGAGRNKLFIRGIADSSFTGPTQATVGQYLGDMRLTYNAPDPDLRLYDIRSVEILEGPQGTLYGAGSLGGIIRIVRNPPRLGQFGGALSAGASVTAHGDPSGDLGGMLNLPVIGDRVALRAVAYGLREGGYIDDVWRQKKDINRTRIAGGRATLRIDAGDGWTVDLGGVYQDNEGRDSQYADRSLGGLKRSSRTPGGFDGNYALGELVVAKSWDGLSFLSSTGLVRQKLDERYDASMNGAERLFTQRNHTRMFATENRLWRPTRDGFGWVIGASYTHNRTDLDRSLGPVGVPVAVTGVSNRIRETTVYGEASVEPVRGLTVTGGARYTWSKLGGGADDPLPVFLPSLEAARAAIVASRKENRLLPSASVSAALLPRLIVYARYQQGFRPGGLAIEGGFVRRFRNDHVATMETGLRYGVRGDDPFDLSLSLSYTDWQDIQADFIDSGGLPTTDNIGDGRIYSLSAALGWAPLPGLIFDAAATYNDSRVTDPSPSLLFALASAAVSDKTGAFTGGQSRIPNVARFTTRIGFDYRTPVSDALELRLNGWVRYIGKSRLGIGPILGDLQGDYLDTALTARIGRPDFGVSLGVTNLTDAIGNRFALGTPFQASGGRQITPLRPRTIRIGLDKSF

SEQ ID NO: 10018 - protein, 376 aa, Helicobacter pylori
MQDCKMVGKNFNRKESVLIAQSLDISKKGSVILGALLSSLWLTNPLNAHEKNGAFVGISLEVGRADQKTNAYKNGELFQVPFGDVSANDDGKVPDGQTGGCQPASGTPGTPGYTKANCVVNWTSRTMLSTNKNIPGRNQPMYGLGVITGYKHFIGKKRWFGLRYYGFFDYGHTNFSNSRAANAISPFYLSDQKADMYTYGFGTDMLFNIIDKPKATAGFFLGVNFAGNTWTNNRVGYFKDGYVYGVNTDADAYMTNADGTITCGDTTPASCDVGINPNSVYTTGKLNAKVNHTIFQFLVNVGVRTNIFEHHGIEFGIKIPTLPNYFFKGSTTIRAKKQGPLENGQPTTITGAETNFSLTQTLRRQYSMYLRYVYTF

SEQ ID NO: 10019 - protein, 211 aa, Helicobacter pylori
MIKKAISLAAVGMLMLSHAYAEDSRWSYRIGATNVAFDASAEVSMNGGRVPGGSADASDNNALTFDFGYVINDSWNARLIVGIPPTTKVTGAGTLPPILLGRIQYAPAVLSVTYNLPQMGGIRPYVGAGINYTRILKSEDANLTSFDADHAWAPVLHIGAEADINRDWFVSFDLRKLYLKTDASGFLGPQVATARVTLNPLLTSIAIGRRF

SEQ ID NO: 10020 - protein, 639 aa, Helicobacter pylori
MKKMKKTILLSLTLAASLLHAEDNGAFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYIKSPGENNQKNFHYTDENGNGTTINCGGSTNSDGTHSSIGTNALKADKNVSLSIEQYEAIHEAYQILSKALKQAGLAPLNSKGEKLEAHVTTSKYQQGNQTKTTTSVIDTTNDAQNLLTQAQTIVNTLKDYCPMLIAKSSNGGTNGTNTPSWQTAGGGKNSCATFGAEFSAASDMINNAQKIVQETQQLSANQPKNITQPHNLNLNSPSSLTALAQKMLKNAQSQAEILKLANQVESDFNKLSSGRLKGYIEKCDASAISSANMTMQNQKSNWGNGCAGVKETLSSLKTSAADFNSQTPQINQAQNLANTLIQELGNNPFRNMGMIASSTTNNGAMNGLGVQVGYKQFFGKKKRWGLRYYGFFDYNHAYIKSNFFNSASDVWTYGVGSDLLFNFINDKKTNFLGKNNKISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 10021 - protein, 668 aa, Helicobacter pylori
MKKTLLLSLSASSLLNAEDNGFFISAGYQIGEAAQMVKNTGELKKLSDTYENLSNLLTNFNNLNQAVTNASSPSEINAAIDNLKANTQGLIGEKTNSPAYQAVYLALNAAVGLWNVIAYNVQCGPGNSGQQSVTFEGQPGHNSSSINCNLTGYNNGVSGPLSIENFKKLNQAYQTIQQALKQDSGFPVLDSAGKQVTITITTQTNGANKSETTTTTTTTNDAQTLLQEASKMISVLTTNCPWVNHNQGQNGGAPWGLDTAGNVCQVFATEFSAVTSMIKNAQEIVTQAQSLNQQNNQNAPQDFNPYTSADRAFAQNMLNHAQAQAKILELADQMKKDLNTIPSQFITNYLAACHNGGGTLPDAGVTNNTWGAGCAYVEETITALNNSLAHFGTQAEQIKQSELLARTILDFRGSLSNLNNTYNSITTTASNTPNSPFLKNLISQSTNPNNPGGLQAVYQVNQSAYSQLLSATQELGHNPFRRVGLISSQTNNGAMNGIGVQVGYKQFFGEKRRWGLRYYGFFDYNHAYIKSSFFNSASDVFTYGVGTDVLYNFINDKTTKNSKISFGVFGGIALAGTSWLNSQYVNLATFNNFYSAKMNVANFQFLFNLGLRMNLAKNKKKASDHAAQHGVELGVKIPTINTNYYSLLGTQLQYRRLYSVYLNYVFAY

SEQ ID NO: 10022 - protein, 204 aa, Helicobacter pylori
MLKKTWLTAALLATCSMANAAPYIGASIGKATFDDISGSIKSNTYNASEKLEVKDNESLSGKVFGGYTFNEYISLEGAIGGYDALDGSVVTVGDMKFLAIQPKLTLPIGDRFNLFAKAGLSYFNAEFKVSNSVLTGDEGHTTFSETTVTGLYGLGAEFAITKNLALQVEWEYMKPELDVAKLGSEKVTVEAEISAFSVGMSYRF

SEQ ID NO: 10023 - protein, 231 aa, Helicobacter pylori
MFKKIIFFCVFLMGGFVIPPLEAMPILHNKTPKKNYQEAHEKLYRSIINRQKLTRKKSGWYFLGGFGAVEAIKDYQGQEMKDWIATLNLKTGVQSFFKKYIGIRGVFAWDLGSGKVNYQSHKDPTNSFFTMLAVGLDVIMEFPLGSYKHYLGAFGGARGALVVYTDKQNFKFFKHSVVSGGLAINGGVMLTLFLRHRIELGFKILPTARLLSSSKRFETSPLFYAAYSYKF

SEQ ID NO: 10024 - protein, 825 aa, Helicobacter pylori
MLKRHWYVGSACAALAAALTAVPALAQSAPAETAETASDGGLQEIVVTATRRDSNLQSTAIAISAVDENLIRQASPRNVGDLAAFVPNFSAATITNFNAASFSIRGVGQNSIIVYFEPPVAVLVDDFVMPSVQTQLLDTFDVSQVEVLRGPQGTLFGKNTTGGAVVVKTKRPQLEKIEVEGRLQVGDFGTVIPQASFNLPIGQTLAFRGVIGHTQSDGYYKNGGCFGPVTPFAATAFAAKFAGQSGCGDGRSLGGQDVWNARAKLLWEPSDAFSALLQYEYLRDRSDSVPSVNLTPASNGFLFHSLGLGSVPNRNSDPLKNAALTDRQAALIKEKSGQIVNVDGVYLNMDYKTDWGTFTSVSGYRNQRSRLPNTYMGTAPVASDGTVLSLFDAQRDDNRKTYQQELRFASSFDGPFNFVAGGFYQKDKTSFCVAQLLGFLDLASGGPGFGNWNDNPYLLCNAQRSRSKATFVEGTFKFTPTLTLTGGFRYTWENKSWYGRQQVFAQQLEGGFDPSIVLENALDANVFDYTAGVIKVKDSAREPTWRVSLGWQATPTVFAYATYSRGFKAGGFNDQIGSFHPFVNADGSDNPAAFAAAASATKPERADSYEAGVKTELFDRHLRFNLTGFYVDYNDLQKQIVVPLVVGGQQFQVTRFFNAAKATVKGIELESTLIPVHGLTLRGLVGYQDGKYKSYVTPIPAGYDLSTAPLDRLPKWQWTADATYELPIGDFKLQFNGNINYVARNLFTQSITSPAENTFLNARTLYNASITLMQADDKYYVRLIGRNLSDKRYLTGAQVVGGLWANGQYGPPRYFGAELGFKLGN

SEQ ID NO: 10025 - protein, 211 aa, Helicobacter pylori
MKFFSKDLFKKVTPLFLSVCFLNPTIMQAKSRFYVASQYQVGKMIMKKYNDLKRTIEGASFSLGWEINPTNYWFYSRYYFFMDYGNVILNKRTGAQANMFTYGFGGDLIVEYNKNPLYVFSLFYGMQVAENTWTLSKHSANFIIDDWRSIQGFSLKTSNFRMLGLVGFKFQTVLFHHDASIEVGIKWPFAFEYDSAFVRLFSVFISHTFYL

SEQ ID NO: 10026 - protein, 718 aa, Helicobacter pylori
MHKKVKPFMQSTLALCVSLSLVPHAYAQVTDTRASIQAQTNDLEIISISARGRTESIQSVPDSVTAFSSDMIQSARIANFRDVANLTPNLTQLDNFRPGLSRITIRGLITPQVGDPPLAFVVDGVTASDIEFINQDLVDVERIEVMRGAQGALYGRGAVGGAVLITTKQPIEDLEGSVKGSYSNGNAYHLSGVLSGSLNEEDSAYFRVGGYTKSSDGLIDNAFLDEEADALDEDSVFGQLQFDIFDDTRLNIKSRYTTSTAGFAYYQGVTADTIEDFSIDTSQNIANRDERDVFEISAKLSQDYALGTFDFITAYSQSKNDHFYDGDYSADATFIDEADLFRAPFGTAGESDVESFTVESRFTSQNQQHLRWAVSLFYQDRQRDTVVSFFDDFAGDAPRNRSDFTDEEKYLVIADNNSSKAWAISGQVNYDITDKLELTTALRFDQDKRESFAPNFADDTFAQKTFSQSQPKVTLAYQAMPNFLVYSSYSKGFRSGGFNEPAEGISRTFNKEVSDSVEGGFKATLFENSVTLNGAAFAIDQDDAQVTQFNVRTFTLENLAIDRVETRGVELELGVAATQNLDIRFSAGLIDSEIKAFSRQPSLEGETMVWVPDYNLALSANYLTELNDTWSLTSSASLQVEGPKSFDITQPQIRSSQYRFINANLGLRSEQWTIQLFVNNLTDERAIEDIFILDDGVTEFARQPNKPRTYGIEAAYRF

SEQ ID NO: 10027 - protein, 348 aa, Helicobacter pylori
MKKFFLPLCLASGFAGPALAQSGVSLYGLIDTTIRYTTHENPSGDGKFQMGDGVLTGTRFGMQGTETLGNGYRAFFVLENGFLPDTGMASQGGRLFGRKAFVGLGGDFGSLKLGRDFTVIHEVIASYDTMALPNLGLIAFQSGNYTGGVRQDNMLKYSGVFGPVTVAAQHAFGEVAGSFPASSSTGASLTYSSGPVKLAGGYQIMRDTATYFGTAVPTSDQQVWSVGGTYRWGNTLFNAGFTRSTYDQAGYRDNAYYAGLKHAFSDAWTFYLTGTYDRMKINGDGGNRYTAAMMVDYNLSKRTDVYVEADYTALTGTWRTLASRPNFVTPFFGHGNRIGVTTGLRHKF

SEQ ID NO: 10028 - protein, 710 aa, Helicobacter pylori
MKKKFLSLTLGSLLVSALSAEDNGFFVSAGYQIGESSQMVKNTKGIQELSDSYERLNNLLTNYSVLNTLIRQSADPNAINNARGNLNASAKNLINDKKNSPAYQAVLLALNAAAGLWQVMSYAISVCGPGSDKSKNGGVQTFENVPSNGGTTITCDSFYEPGKWSAISTENYAKINKAYQIIQKAFGSSGQDIPALSDTKELNFEIKGKKNDSVQPGERWKFPWTNGFVSIKWVNGTYTETKEDIKVSNNAQELLKQASTILTTLNEACPWLSNGGAGGAGGGNSLWAGIDKGDGSACGIFKNEISAIQDMIKNAEIAVEQSKIVAANAQNQHNLDTGKTFNPYKDANFAQSMFANARAQAEILNRAQAVVKDFERIPAAFVKDSLGVCHEKGSDGNLRGTPSGTVTSNTWGAGCTYVGETVTNLKNSIAHFGDQAEQIHNARNLAYTLANFSGQYKKLGEHYDSITAALSSLPDAQSLQNVVSKKTNPNSPQGIQDNYYIDSNIHSQVQSRTQELGSNPFRRAGLIAASTTNNGAMNGIGFQVGYKQFFGEKKWWGLRYYGFVDYNHTYNKSQFFNASSDVWTYGVGSDLLVNFINDKATKHNKISFGAFGGIQLAGTSWLNSQFVNLANVNNYYKAKINTSNFQFLFNLGLRTNLARNKRRGAEHSAQHGMELGVKIPTINTNYYSLLGTTLQYRRLYSVYLNYVFAY

SEQ ID NO: 10029 - protein, 223 aa, Sulfurihydrogenibium sp.
MRKSLFLLLPLVVTNAHAVYVDVRHEYLDDSKANYDRAYISHRFANGVGFAIEAISKSGGEDTNKAFNDLETQGNEYTISYQFKTGDVAWQPGFVLETGNGYSTYKPYFRATWTLNESWWVGARYRFEYVRRSSDIRDDDTINRMDVWAGYKWNNFDWTIEGIYKKADKYDLYDGGKDNYEYNFRTAYIIDQWSPFVEVGNVSVNSNSDERQTRFRVGIGYTF

SEQ ID NO: 10030 - protein, 387 aa, Sulfurihydrogenibium sp.
MKKTLLAAALLAGFAGVAQAETSVTLYGIIDTGIGYNKVKGTGYDASRVGMINGVQNGSRWGLRGTEDLGDGLQAVFQLESGFDSSNGNSAQGGRLFGRQATVGLQSASWGRLDFGRQTNIASKYFGSIDPFGAGFGQANIGVGLSAANTVRYDNMVMYQTPSFSGFQFGIGYSFSADDTKSDKDGFVNGVYTKNGVPGQTGFATADNTRAITTGLRYTNGPLNVALSYDQLNASNKLSNAQTNATPRAYAIGGSYDFEVVKLALAYGRTTDGWFAGQSLPSGTSLSGFGTNVFADGFKANSYMVGLSAPIGGASNVFGSWQMVDPSNNKLTNVKGADETMNVFSLGYTYDLSKRTNLYTYASYAKNYAFQDDVKSTAVGVGVRHRF

SEQ ID NO: 10031 - protein, 414 aa, Sulfurihydrogenibium sp.
MKKLASLVAALLLALTAIPSAEAAFVIGGENGWQLSTDGIVDVFSVYQSTSPKPSGDRFTTFLSGSPDQFQNFGVKVGLLPSLIAFNIKAPTVNGVDSNVRVGIYPSIQNKNQDTRFEVNPNIDFREFYYTAKGTYGELLAGRALNLYQAKNILTDMTLLTAGVVPAPGTSTTLGHIGYGYLYTNFGPQIRYTTPDLNGVKVAFSVNEPYKISSDTAKTNTPRLETEISYATVLNGGTTLQAWASGLFETATRSKAAGVARPGEQNQSIGGAAGIEAGFGGVDLMASGYAGEGLGMISAQDGDAFGSSSTDAAGKERTHFGFLVQATYKLTPDIKIGANYGQNRQVESDDDKTKRGVGGSFSPMKKQEAAVGMVTYNFNKFTQFIVEYAYAQNTWHDRATQHSNSVAIGTMFYW

SEQ ID NO: 10032 - protein, 338 aa, Sulfurihydrogenibium sp.
MKKVLLSTIACASLALAANSDYKYEITPLIGGVLTEGNTGLEKNYANAGLSFGFNQFDSFIDQVELGFLRTLEDVDGKGNFSNRDTGVTRVFANLVKDYDLTSDLSLYTLVGAGVEFFDNEFEDNKNGLFGNYGVGVKYNLAERLALKFDVRHLIEVDHGDNTLLYTVGLSVPFGEVSKPAPVAEKPAPVATPVAAPKDSDGDGVIDNLDECPNTMKGAKVDNIGCMTLVNLNINFDTDKSVIKDSYNSRINEFAKVMKADPKLKANIEAHTDSVGTDAYNQKLSERRATSAVNALVAAGVEKDRIKAVGYGESRPIASNDTVEGRAENRRVEAVMVK

SEQ ID NO: 10033 - protein, 483 aa, Sulfurihydrogenibium sp.
MKRKITFQNSKSEKSLPMQKEKLPSLFGFKVSFLIGIVFVSPLLGVGIFQPSHNTRYAGMAGVNLAIGGSPMDVATNPANLTRSQKGGLEFGIGLPYIRSKYTDRLTDASPETAYSNSQNYNILAPLPYFGLNLPITDRLNYGAGIYVPGGGSGHVNGILRVTPDGRSLRDWSGLDIPGPIGDSRKIKEDLSTTFYVVKMTNALAYRLGNFSVGLGIETIYSKQIAYQKLYDITHTLEIPGQGFDYKSRNAYSMGAIFGLSYTFTERFRIAYSYQARNILPLDGGMQIGINNANHYRRTGVSATFNLPEKHGLGFSFGGESLRVGLDFLYYNYNSYNQTFKQTLEDSWFSTPFGKTNTISQNIAYHDSWAAAIGLEYKTDFFMYRGGYRYNTGVVRSEGISALQAGIMVQQLSTLGISFLLGKWSIDLAVNYLFSKKIIANQGNDWAVLHSVFGPNDIRVLNYSQSLQSDVPAILLGASYRFD

SEQ ID NO: 10034 - protein, 1031 aa, Sulfurihydrogenibium sp.
MRKVLALSFCALAFVASAYAQATAGLGSVSGTVRDASGASVPGATVVVSNESKGIKRTMTTTDAGVFAVPALVPASGYAITVTKEGFTSYEIKSFEILVGQNVDFKVGLTVGAATTKVDVTAEAPLIENTKSGVTATVDESQIRELPINGRRVDSFVLLTPAVTNDGEFGLISFRGIAMGNSFLTDGNDTTESFYNENAGRTRIGAGLSQDAVQEFQVLSNGFSAEFGRAMGGVINTVTKSGQNSTHGTGYWFFRNRTLEATDRYANGYNLPEWRHTAGGSLGGALKKDKLFYFINFDFTDRSFPALNRIVNNSLTDPTGNFIPASNCVPNATTGPTQAQCTAAINFIQKQMNVLVPRTYKQDLGFAKLDWHVNDRNTVSVDMNLMHWRSPHGIQTQAVLTGGAALGNNGNSTVEDRYGKASWTAVVTPNAVNELRFGWFKDRLSDPGASDLFPAETGATYITVAGSTVGAAQAYPRTYPSENRYQIVENYSLTKGAHSIKFGVDFQTTQDWMNQLFNQNGGYSYTNLLAFAKDFTGNTTGAKNYSTFTQQFGNPIQNIRTTDINFYAQDTWKLSKRLTFNYGLRYEKTWIPQPTIVNPDYPATGVINSPNKNFAPRASLSYSISDRTVLRVGYGIFYARFHGNALDTLYLGNGKYQTALSMNNTQVGAPVFNGVLASANGFPAGSISLNVADKNFHTPYTQQGTLALDHQLSRDLAISASYIWTRGIGLFVQRDLNLGAPTSQAYTYIIQDASGNNVGTYSTPLFVLNGGLRPDPRYGKILQVENGGQSWYNALALQLTKRFSHGFQAQVNYTWSHAIDDGNEQGASWNVASNFNNATFNGNYPLDKGSSTLDQRHRVSINWVWSPTIVSNGSSTAKFLLNGWELSAITTLASAHPFSATVNAPSTSLGAEFPGIQLAYGSLTGTGGSSRVPFLPYDSFDVDQIYNVDARITRKFAIGERAKLSLGFEAFNAFNTIHNTSIQTAAYSVSGNILKPILTNGVSHVGDGSASQGFPDGTNARRMQVIARFTF

SEQ ID NO: 10035 - protein, 864 aa, Erwinia tasmaniensis
MPDISPGRTSFAASDRALRRLSILNAHVLPGAPSASSDRIRCEFNKLLLGSVASIALFCSLDSEARAACVETSPGAYDCSGTGPGPTFTGQSVTINADPTASFTSDVSITGPGTSTLNNNGTLTNSLRATDNDRFTLNNRGLIDGTIFLGGSGANVIINYAGGDVQNGVTSTGDSHDTVINRGFFAGSIVLGDGYDVLGLIEGTVQTSVDMGAGDDQFTWLVGNIAATVQMGEGDDRAVFGSLTQQNLSAGKRVDGGLGIDTLVWENTTNDDGGGSGDHPENIVNWEEIELRNGSEMTFIYSTGNLTLGDSASGTGTLSIDETSAVRAGNSFGYGVRAFDPSQLVTVYNAGIIDMTNDTVNVGDLLHDTFTVYGNYVGQQGGLQLHTVLESDDAPSDKLVISGTGASASGGTSILITNVGGQGALTLADGIRVVDATAGATTEGTAFTLGAPVAAGIFEYKLYRGGLTEDPDNDDDWFLRSGGVSPPPPPPPPPPPPPPPPPPSPPPPPPPSPPPPPPPPPPPPPPPPPPPPPPGPSPITPSVRPEIPGYIVKPALMQKMGVAAIGTFHERQGDQFLLNSNGYLPGAWGRLFGESFDQSWSSKISRFEFEVSPSSSGELWGLQAGQDLIGALHDDGSQDRVGVFFAYTGTSGSNGGNTLGRLQVESGSIDLHANSIGAYWTHIGADGWYVDSIGMYSWLDGGSNSDRGIGVDTSGNSTALSIEAGYPFRFDNGWVLEPQGQLIWQHVDLDDANDRFTGIDYESFGTWTGRLGVRLEANTTMNDVPVQPFASVNLWHDFDQDYKVSFNRVPVVTELEQTLLELNVGFSAQMSETVSVYGGLQFATGLDDDDNRGYGGNIGLRIKW

SEQ ID NO: 10036 - protein, 724 aa, Erwinia tasmaniensis
MPHVFLNVSKNLPKIYRDSLAATTAILLIGISASPASAQSATDGDTATTLEPIVIQGASSDSKTDRTSVTAKNSAGATKISTPLVETPRSISVTTEKEIEQRGAQSIIEAVRYTSGVTTGPNGFDPRFDQIYIRGFNITTVGDFRDSLRQPYMNYGMFRTDPYQLQRVEVIKGPVSVLYGAGSPGGLVNKISKLPTEEPIREVGITYGTKDRLQGMFDFGGPISEGNDDFLYRIVGLARRGDTNFDIADDRYFLAPSFTWKPDEGTTFTVYGLAQSDETDSNVGAITTLDGKIHELRESDPDYDYQKVKQQQVGYQFEHEFDNGLTFRQNLRYSHLDLQARYLGVTGWTGTVAHRGTNAIRDEMNVFQVDNQLEAKFDTGPLAHTMLFGLDYTNLQSSFGYGAGASDPAFDFDIANPTYGVSGATPDYSILASDADMRQVGIYAMDQIEVGNWRFNLGGRQTWVNQTRDATLPAVSSEEVDKNAFSWQAGALYLFDNGIAPFVSYATSFDPVTNRSTSGKILAPTEGEQYEVGVKYQPPGSDILLSAVAYHIVEKNKPVLVDPLLFAYGSIGEVTGKGIELEARAAVADGWDLIAAYTYNQSEVTGGGENEGNTPALTPSHVASLWANYTFQETNPFHGLSVGTGVRYVSENWTDTANTSKNPSSFYIDASAAYDFGAVDKKYEGLTAAFNIRNIADERDTVCNEGFCYLGQGRNMTATLKYRW

SEQ ID NO: 10037 - protein, 171 aa, Erwinia tasmaniensis
MKKIACLSALACVLAVGAGSAFAGQSTVTAGYAQGDAQGVQNKVKGFNLKYRYEQDNNPLGVISSFTYLEKNGSDDGFYSKGQYMGFTAGPAYRLNDWASLYGVVGFSHGKVTSNNTNGQDNASNDDYGFTYGAGVQFNPIQDVALDVGYEQSRIRSVDVGAWAVGVGYRF

SEQ ID NO: 10038 - protein, 362 aa, Erwinia tasmaniensis
MMKRNILAVIVPALLVAGTANAAEIYNKDGNKVDLYGKTVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 10039 - protein, 809 aa, Erwinia tasmaniensis
MRMNGRWWRVVSLGLSLGVGWGSLSQAQPNARIPDSTTPPLLAQATPAPTTLPEQIRELKAQIEAARQRGDQAEVERLQAELRALQQEGTPIFNLQQVTVTGTRTERTLADSPASITVIDRERLRRELVQNIQDLVRYEPGVSVRRSVRYGLQDFNIRGLDANRVLIQVDGIRQPERFSFGPFTIGRDTFELEALKTVEIIRGPASTLYGSDALGGVVTYTTLDPADLLGERDSHVGLSSQYDSKNQGYVNTLSLAGRQDNLEALLIYTRRDAREPDIQADPSFKDRQTVEGDNVLAKLVYRFSPFDSLTLTAEYFHNRTTTTFSPRNLDPGIRFFRETIETERSRLSLEYRYANPDTPAFELATVQIYYQPARTQEPSVEERTLTVQGRPVPVRRDTFNELVSNILGASVQAQSRFQTGDLSHRLVYGMEISTTRNERPRNRFQTNLLTGAVTQNIPPDTFPTKDFPDSDTVRFGLYLQDEIDFGGGNFTLIPGIRYDTYRLTPSPDEAFLKSGAEAASLFADAISPKVGLVWRINPNLTFTAQYNTGFRAPQYNEINSGFTNLVSPFFRYRTLSNPNLRPETSQGFEVGLRGIYPQASFSLAAYYNTYNDFIEAFREVGSEPSPPGPPGSPPPPPVTLFQSQNVSRARIYGVEATGQYFFSPDLTGWSLNGSFAWAVGDNLTENKPLLSIEPLTAVLGLHYDDPSQIWGARLVATLVADPRDPQREVVQPNPNAPPQIPFVPKGYTVVDLLGYYNLDDNWQLNFGVFNLFDEKYFLYSETRSLFVGPEVERRAQPGRHAALSFSTRF

SEQ ID NO: 10040 - protein, 379 aa, Erwinia tasmaniensis
MEISRRTQMKNALSGALALCALTTAAQAGGLDRSGQGINILFEEGDAIQFRLGWTDPRVSGSLGGMPSGNVANSFVLPHFAYKKALSDRLDFALIYDQPFGADITYDAAYPLSQNPVPGGRRDVLRAKADTDALTAVFRYRFDRGLSVIGGLRAQRAEATVTVPAAAGYSVTTDSPVDFGYVVGVAWERPDIAARVALTYNSAIDHTLQQSESLNPPPPAPPGFVATLPSTSTISTPQSVNLDFQTGIAADTLLFGSVRWVDWTALVYNPPNYPPLTNLVDYDSDTVTYSLGIGRKFSEAFSGAVTLGYERRTGDSLSDLGPTDGFWSIGLGGTYSLDKAKISGGVRYTDLGDATTNNGARFTGNSAWSVGLQITYALN

SEQ ID NO: 10041 - protein, 757 aa, Erwinia tasmaniensis
MKKTACIFLVSNLTLPLSPNALYAAHEAGISKKKDEPVVFNPMVISATLSDKSIEEIPGTLHLFDKEKIRLRNVRRAGDILQETPGVYIWGASQGSQAPSANRGNRISIRGVSGVSRTLVLLDNQKMNDPAFGTFNWATLFPEDIERIEVIPGAASALYGGNAFAGVIRVVSKKPTEKEISLTGGYQFNSPESGYGSAVYRDVFDNGLAISIGYRYETSSGYRDSWSFSDPATNQAGPQGTRVTGAIPTHTTNGTPTFQIGDRGNVPWNYHVGQIKAYYDFSPTTRISGGLRYLFSDVRSENPTSYLRDPGGNTVISGTVNVGGTILGRITPSLFLNAETHEDDLRSFLDFEHEFANHSKFSLSFNHLSRGYWSTLVGQNSTFDGGPGTSAHRPQQLINGQGMYSFHLGDRHFLTTGFQVEHGTLKRREYTLSNWQDIDSRTALNLTGDSESLTTSFFVQDEIFLTDRLTAYFGTRLDWWTAEGKSRNLQTGVVKPTEKQSVVEISPKLALVYQAPWQGGVLRASAGRAFRPPTLQDMFADSRRGVVINYANASLKPETALSWEAGIEQHLAATGTRLKATFFENRLFDLITSKNLTFTTTLREATDVNAGTGITRGIELSVDQVLTGWLKLHANYTWTPTARTLKNSASPDSEGKRMPNSPKHILTAGLETNWHDWSGSLTGRHVSKSFNTAENIDVFHNVYGGNQAFWLLDTKLIYTWNKMAELSFAANNLLNERYFQSLISTGRNYVAQVNLRF

SEQ ID NO: 10042 - protein, 993 aa, Erwinia tasmaniensis
MKHKILLVLLLGFMTCLTVSAQKVTLQFRQVKLTKVFDAITQQTGLTVAYSRPTVDPDRMVTIEAKDEDLSNVLSKLFTGTNVAFEIGEKKIYLKEKKTSDSLQQTRKTKKISGTVLDEKGEPVIGASILVDETSNGTITNIDGEYSLTGVPENSTLTISYVGYKTIKLKASDKNLSNIILQEDSELIDEVVVVGYGVQRKRDVTGAMTSVDATKIASVPVTSASEALQGRASGVLVSQDNWAPGTSPSVLIRGKRSINASNEPLYVVDGVPITGGLREISPSDIASMEVLKDASATAIYGSRGANGVVLITTKQGKDGKTQVDYSGYFGVQTMQNKLDLMNGAQYAEYVREAYRNTNSSNKYPMDHPDKAADMANPMFKQDAYVLESLMMAYDENGNYDPSRIRSDNWFDHVTRDGIITDHQISVNGGNAKTNFLASATYNKNEGIMKDQSYERYSIRLNLNHEINKWFKFGLQTQYSHSVKERGSGMESDAYMYRISPLGALRNEDGTPTQLVASDAQMWNPLMNLEKGAVSAPEKVSRYLGSYYIEVTFPVEGLKFKSNLGLDARTKQDYQFYSSNTSTRQLGTSYAYNGMSKYTMMTLENMLFYNRDFGKDHTVGVTLLQSIQEDKTESNKIGVQDITSDKLLYNDLASSSIIDNIGSNLTKWTMASFMGRLNYSYKERYLFTGSVRYDGSSRLAEGHKWVAFPSVALAWRVSEEAFMKRQNVMSNLKLRAGWGKTGNSAIDPYMTRGGLSLSKYVWDNGASEVLGYAPSIMANSELTWETTKQWNVGIDFGFLNNRLSGTVDLYLQHTSDLLLERQIPVVSGFGSVLSNVGETKNKGIEISLSTLNVNTRAFQWTTDVMFYANKESIESLYNGKVDDVGNKWFIGHPINVHYDYEKIGIWQNTSEDLAEMSEFNKNGASFKPGDIKIWDNGDKKITEADRKILGSTSPKFIASMVNNITYKGFDFSIFLYASAGAMLNNNIEYLNKPN

SEQ ID NO: 10043 - protein, 644 aa, Erwinia tasmaniensis
MSILSPRTIRLLAGSAALSGSCVTAHAQDLAFSLDPIVVQARDDFAEAADRATSMYVADAELERARTGDLKDVFAGIASVSVGGALPLTQKIFVNGVDMLNLGVSIDGAAQNNRAFHHVSANAIDPGLLKQVRVDATISPADAGPHALAGSVVFETVDAADVLSEGQRFGGTLRLSYGDNGKTAQGALTLAGREGGFEWLAYAKRATGDDYEDGDGATRLGTAANLKSAAGKLAYESEGGHRFELSALRLRDDELRQFRANFGGLGGVVDQLRLYDTTRESWSFSYENTQGEGMWDPSLRLGYSESDVVIPLPYDSNGLSGTWSATLQNDFHLNATDRISAGLDWQRRFGEYSSPTFGEFLEETSHNLGLFVQARLEPTDRWRLSFGGRLDRQKFEGVDGSDLGHSGPSGNLSASYALTESLTLRGGLSSIFGGIDIEDNYIFRPSWSYDSLRPSRARNASLGFDWDAGALKVGGELFLTEINRARSATEMFDFESRGFNLGATYGWDGGFARVTLSHSEVKVDGAKAAGYEALDFGAPLGTVAAVELQQDTSVAGLRLGGGLDLALDHDMPATAERDLAGYSVVNLFAEYVPPEAQNLTLRLQVDNLFDKTYADRATYGAEYSDVTSLKEPGRTITLSAVTRF

SEQ ID NO: 10044 - protein, 1100 aa, Erwinia tasmaniensis
MFNLKVYTMKRQRFFEGLGLKVYVTLAICMALLLNVQFLNAQSSTINVKGVVNDAMGPVIGASVVEKGNATNGTITDIDGNFSLKVPSDATLTISFIGYKTVELPVAGKTSFTVTLKEDSEILDEVVVVGFGTQKKVNLTGSVGLATAKEIEARPVANATQALQGLVPGLQITTNTGELDKNMSINIRGNGTIGDGSSGSPLILIDGMEGDINTVNPQDIENISVLKDAAASSIYGSRAPFGVILVITKKGKSGKPTINYNNSFRFNSPVNLPEMMDSYTFANYFNEAARNGQDNAQFSDTVMQQMLDFQAAGGTNRGGLPTDGNVWGKPAGDPFTTAYANTDWFSEIYKGSSFSQEHNFSVSGGGDKFNYYASLGYLDQNGLLRHGSDDLKRYNATAKFGAELTKWLKFNYSLRYVRQDLGRPTNFGGGLYERIGRQTWPNLPVYDENGYYFNGNADTPAMSLALGGERDVQTDKVYHQASLVFEPVKNWITNVEFNYSTNSIDTRETGLPYYNHDVSGNIVDTQGTSSLYQDYKKESYMNWNIYSTYSLAINDDHNFKVMGGFQSEEMRQKFFSAKGYGLQVEDLPELDLISNIDGAGKDKVPEVGGYRNEWATAGFFGRLNYDYKGRYLAEANLRYDGTSRFRRGNRWQLSPSFSLGWNIAQENFWEDFADVCNQLKFRFSYGELGNMNTNGWYPTYRAMTLKQANGSWLQNGLKPNTAYVGDLISTALTWEKVRTWNIGLDWGLFNNRLTGSFDAYIRYTDNMVGPSVELPATLGIATPKTNNCDLKTKGWELTIGWQDRTNFGMGYGIKFNVSDARTYIDRYPGNPTNSINTYIAGREIGEIWGFETVGIAKTDDEMQAHLNKVGGQSAIGSGVWTAGDIMYADQDGKPGITKGAQTLEDHGDLKVIGNNTPRYHFGLDLNANYKGFDVRLFFQGVMKRDYWQGSNIFWGVGQWGMWWSTGLKEHEDYFRDEPVGLAGHEIAANVNSYYARPRFDSTQNQETQTRYLQDASYIRLKNFQLGYTLPASMIRKIGITNCRIFVSGENLWTGTKLSKLFDPETISGGNTDSNASAPIKSAGNAYPLSRTWSFGLSVSL

SEQ ID NO: 10045 - protein, 1092 aa, Erwinia tasmaniensis
MTEKTNLFPSLIRFRETNRLKMAIAASIMLWCATPQQAAADTYEKHEIASVQQQKVKTTGTVVDQNGEAMIGVSVKVKDNATMGAITDLEGKFSIDTPKGATLEISYIGYKTVTVKAEGTALNITMQEDAEVLDEVVIVGYGSQKKVNVTGAVSMVDSKVIESRPVSNVSQALQGVVPGLNLTVPTAGGALDAGMNISIRGAGTIGDGSSSSPLILIDGMEGDMNSINPNDIENISVLKDAAASSIYGSRAPFGVILITTKSGKAGRTSVNYSTNVRFKSPMSMPEMMDSWSFANYWNEAGINQNGNIKFTQDVMDKILAFQQGTLTGPDAAGISWQDGEWKKYAGAWANTDWFKEQYHSIVSNEHNISVNGGTDKVTYMVSAGYMGDKGLTRHGDDRLTRYNLSGKINATLSKYVKLMYNTKFIREDYDRPSYLTSNFYHNIARRWPTNPVKDANGYYLDHSEIIQMEEGGRDVTQKDQFYQQIQLVVEPLKDWLIHAEGNMKIVNNQNQWEVLPVYYHDGEGSPVAMAWFDGYTPGMSRVNQSYWKDNNYSLNLYTDYFKQIGDHYFKVMGGFNAELYKRTNLSGQRDELITPDVPTLNTGTTEQKANGGYSHWANAGFFGRINYNYKERYLLEINGRYDGSSRFIGDKRWGFFPSFSAGWNVSREPFWRDLEHIVNNFKIRGSWGELGNCNTTAFYPFYQTMPTGVENSGWLINGKKPNTASAPGIVSAEMTWETVRSWNIGFDFGLLNNRLTGSFDYFVRNTLDMIGPAPQLPATLGATVPKVNNADMKAWGFEVEVSWRDRIKDFNYGVKFVLSDDQRKVTRYPNEELNRNQWYAGRMDGLVWGYETVGIAKTDAEMEAHLASLPNGGQSQLGSKWAAGDIMYKDLNGDGKISSGDGTLNDLGDLKVVANTQLRFKYGLTLDASWKGFDFSAFFQGVGKRDVVVGGPYFWGANGQGMWQAAAFKDHMDYFRPEDTESVFGPNVDAYYPRVIFGGGSSEGGKNTLTQSRYVQNGAYIRLKNLQLGYTLPSTITKKFAVNSLRVYVSGDNLWTGTKMRVFDPEVLGSTGDAGKAYPLARVWSVGLNVNF

SEQ ID NO: 10046 - protein, 781 aa, Erwinia tasmaniensis
MKKRTLAAQAAIVFCAAVSSAWGAPGNAVLTGTVSDPAGQPVAHAKVQVQDASGASISTSSTDTSGHFSIDGVAPGTYAVVVTAAGFASGSSIATAQSGAPASVSVQLQKSDTLDVQVNAQRLNAARNGLLPETGSSVYRFTQADIDTMPAGANTPLNQVLLQAPGVANDSFGQLHVRGEHANLQYRINGIIIPEPISGFGQSLDTRIIDQMNLLTGALPAQYGYRTAGIVDIRTKSGDTGNGGSIDVFGGSHQTVKTSADVFGSQGPFSYYLSGSLGMNNLGIENPTASANAIHDHTRQGNAFGYLSYLINPLTRVSLLFGATSNQFEIPNTPGLTPNFALDGHSTFDSSQLNETQSELNNFAALALQGTNGGALDYQVAFFTRYTRTKFNPDPIGDLMFNGVASEDFHSNTANGVQVDTTWRVNDSHTVRAGIFFQQEHAVFDNSVTVFPADADGNQLSNVPFNIQDSSSKTGYLYSLYAQDEWKLTDRLTLNYGLRYDRMDEYTSASQLSPRVGLVYTLTPSTTLHAGYARYFTPPPFELVSGSTISKFDGTTNQSSSTQNDPVQPERSHYFDLGITQKLGSAVTLGLDAYYKKSTDLLDEGQFGSALIFTPFNYQYGRTYGVEFTANYRQDNLSAYLNLAYSRAQGKNINSAQFNFSADELAFVSNHWVFLDHDQRVTASFGATYDFHQTTFTFDGIVGSGLRRGFANTDRLPVYAQFNLGAIQHFNEPMIGKFDARLVVINAFNRVYQLRDGSGIGVGAPQYGPHFAVYAGVTKYF

SEQ ID NO: 10047 - protein, 210 aa, Erwinia tasmaniensis
MKLRALALAVIAVLPVVASAHQAGDFFMRAGSATVRPTSGSDDVLGLGEFSVDNNTQLGLTLTWMATDHIGIELLGATPFRHKVGLGPTGTLATVRQLPPTLMAQWYFMDDASKWQPYAGIGVNYTMFYHTDFNQTGRDAGLSDLSVKNSWGVAGQVGMDYQLTPEWMLNASLWYMNIDTKVSFNAGDSRQSIDTRINPWVFFIGAGYRF

SEQ ID NO: 10048 - protein, 665 aa, Erwinia tasmaniensis
MVMLLRRKKILAQVVSAALLLPATYAFAEAAPDKDKIMERIVVTASGFEQQVRDAPASISVITREDLDTRFYRDLTDAMLAVPGVVVTGGADRRDISLRGMGSQYTLILVDGKRQSSRETRTNSDGPGVEGAWTPPLAAIDRIEIVRGPMSSLYGSDAIGGVINIITRKVPNEWQGELRLDTTLQEKSVSGNVYQGNFFVNGGLIKDLLGVQLYGQYTQREEDNIYGGYRGRDADNLTARFALTPNQDHDIMLEVGTANQELDSTLGKTVAPLAPGASCGRGGCPASSTTEYENSTISLSHTGRWDFGTSDTYIKHEVYDNKSRKMKIKNTDAQTSVIATLGESHTATFGAAFNYQDLTDETGNQVSDLQDISRRQWSVFSEDEWRIVDDFALTLGLRLDDDENFGEHLSPRIYGVWGLTGSTTLKGGISTGFRAPSLRQTVPDWGQVSRGGNMYGNPDLQPETSVNYELGIYTDLTDSITTSAGVFYNEFKDKITRVACPATQCTDGPNQFGSDPTTYVNIDEAVTQGVELSIDYKILSNLALTGNYTYTDSEQKTGAYKGSPLNQLPKHLIQLSVNYEPIDNLNTWLRVNYRGEESQPTTGPSSRSLIAPSYTLLDLGANYRVNDSIKFSAGIYNAFDKEITQEEYGYIEDGRRYWLGMTYSF

SEQ ID NO: 10049 - protein, 405 aa, Erwinia tasmaniensis
MKRSSEFKQLALGAAMFTAMPAFAQSSVTLYGVVDTGIAYQNSQTTLGSTANGHSAIKMVTGVWAGSRFGLKGAEDLGSGTKAIFTLESGINSTTGAQQYTNAMFGRQSWVGFTNPAYGSLTFGRQYASYYQLLSPYSPTNWLTGFFGAHPGDIDGLDTIYRANNTIEYTSPKLYGFTFSGSYSLGGVAGSLNSGSTWAGAIQYANGPIGLAVGFSRINNSTTGGGAFGADSTTSNNGAQAGVSALTNGYQTAQAQQRFAVGGSYTFSSAWDVSATYSNVQYIPGIGSKFTDTAIFNTGGIVLHWKPAVAWDFGAGYSFTRATKANGITSAAQYQQFNLSQYYALSKRTGFYALEAYQRANGKTLGTAGASQIIDATATLGDGFNSAPSSTRNQFAAGVGVVHRF

SEQ ID NO: 10050 - protein, 356 aa, Erwinia tasmaniensis
MTDKTYNYGYFQPYYMPSGRQYTQAFYLQDQIKWKNIIFSTGVRYDHINNIGQKNLAPQYNDISVGHNYSQKNYNGWSYYLGLNYDINHYLSLFTNFSRTWRAPVIDEQYETQYKQASGPVKATSLNLEKEMINQTRVGGIITLNHLFQENDAFQFRTTYFYNRGKNEIFKTRGVNCVGNAANTNKNNVCPKIIGNYRNLPGYVIQGAELEAYYQSTYLFGELTYSYVKGKRDTSPRNPWGKTSTWIAEIPPRKATATLGFNIPKYNFTAGWRAEFVRRQDRSPLSGDPEAGYWSLPASRGYSLHNLFLSWSPAKIKGMNVKITVDNLFNRAYNPYLGELASGTGRNIKFSLSQKF

SEQ ID NO: 10051 - protein, 377 aa, Erwinia tasmaniensis
MKLQYLSVLASAMVMAGSAGAAEVYNKDGNKLDLFGKLNGMRYMSSDDAKNGDRSFIHYGFNGEAQLSEGITGFGTWEQEVGLSHAESGGAKSNFTRLGFAGIKFADAGSIDYGRNYGVLYDVGAWTDMMPEFGADTTVTDNFMTGRANGVFTYRNTNFFGMVDGLNFALQYQGKNDTKEDEKGRRGLKGGRGLNEANGDGYGLSVTYDLGNGVSAGAAYTSSNRTLGQRMLNSARNNKDKRAEAYSLGLKYDANNLYLAALYSETRNMTPYGDFSGNKAKHGFADKAHNLELVAQYALDFGLRPSVGYLQSRIDGDYQGKSQTIKKYIEVGASYNFNKNMLAFIDYRINLLSKNDFTRDTQISTDNILAMGMTYMF

SEQ ID NO: 10052 - protein, 1058 aa, Erwinia tasmaniensis
MLTKKFTSMKNNFQPVQITRFVLSLCCLLCFSVHLFAQQITVSGNVKDSSGEPVIGASVLVKGTTNGVITDFDGNFSIANVEDGSQIEVSYIGYVTQMKKATGTQPLNFILKEDTETLDEVIVVGYGIQKKSVVTASISRVSSDDLKNVTPTRVDNMLKGQTSGVTVTSASGQPGDAAKVRIRGIGTINNSDPLYIVDGMPVDGGIDYLNPSDIESIEVLKDAASAAVYGARAANGVVLVTTKGGSKGKAVISYDFSYGWQNPWRKRDVLNAVEYETLMNEMAVNSGKDAPYANPEAAGEGTDWQDALFNSNAPIMNHQISVSGGSDKGSYFLSTGYFKQDGIVGGNFDRSNYERFTLRMNSNYTLFDQTKNRNWLSSFKIGTNIGYTRIKSVGVDTNNEKGGPLGSALMIAPTLPVYAEDPEAVLKEYPTAIKDKNGNVYTIVGDAYNEITNPLAQLELPGDVNNSDKFVASFWGELQLWDSLKFKTTYGADLAFWGNDGWIYPYYLGKSNSQTQSSAWSGMNRGYTWQLENVLSYDKTFGQHSVSVILGQSAKKYQGRTLWGKNYNLQSLDPDKANINFGQGTKADQEATGQAQPFSTLASMFARVSYNYAERYMFQATIRRDGSSNFGPNNKYAVFPSLSLGWNITNEKFMEKRPEWLTSMKLRASWGKNGNERIDAFRYTAIMNSGNNYIFGANGNEAIVVGAKPNGLPNPDLKWEETSQTDLGLDFGFLGNALTFTVDWYKKKTDGMLMQMPLPAYVGDTPPMGNVGKMENSGIEMDLSYRFQVSDLNVKFGANASYLKNKLIELGNAEGWANYDAIQNIGTITRAENGEPFPFFYGKKTAGIFQNWDEVNSYVNSKGEKIQPNAQPGDVRFVDANGDGKIDDADRVKIGKGMPDWTVGFSIALDWRGFDLNAFFQGTIGNDVFDGSRRIDLKSINLPSYMLDRWHGEGTSNKYPRLSENDENGNWLSSDLYIKDGSYLRLKNIQLGYTLPKAVTTKFFVQNLRVYVGAENLFTITGYDGFDPEISSGGTSLGVDKGVYPQAKTFTVGANITF

SEQ ID NO: 10053 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDPSYRTAKASGNDVDSKGASSARFKNHADII

SEQ ID NO: 10054 - protein, 420 aa, Neisseria meningitidis serogroup B
AQSTANAAAAEAADASTIFYNPAGLTKLDSSQISVNANIVFPSIRYEADSATDFTGIPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIPKKAQMLQATPSNPTAAAQIKADGHADVKGSDWGFGYQLAWMWDINDRARVGVNYRSKVSHTLKGDAEWAADDAMAKQLWNSNMLAPLGYTANEKARVKIVTPESLSVHGMYKVSDKADLFGDVTWTRHSRFDKAEMVFEKEKTIVNGKSDRTTITPNWRNTYKVGFGGSYQISEPLQLRAGIAFDKSPVRNADYRMNSLPDGNRIWFSAGMKFHIGKNHVVDAAYTHIHINDTSYRTAKASGNDVDSKGASSARFKNHADII

SEQ ID NO: 10055 - protein, 423 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKNIVNGKKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADII

SEQ ID NO: 10056 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRKADYRMNSLPDGNRIWFSAGMKYHIGKNHVVDAAYTHIHINDPSYRTAKASGNDVDSKGASSARFKNHADII

SEQ ID NO: 10057 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDHARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYPIGKNHVVDAAYTHIHINDTSYRTAKASGNDVDSKGASSARFKNHADII

SEQ ID NO: 10058 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPGGNRIWFSAGMKYHIGKNHVVDAAYTHIHINDTSYRTAKASGNDVDSKGASSARFKNHADII

SEQ ID NO: 10059 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADII

SEQ ID NO: 10060 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAEMVFEKEKTVVKGKSGRTTITPNWRNTYKVGFGGSYQISEPLQLRAGIAFDKSPVRNADYRMNSLPDGNRIWFSAGMKFHIGKNHVVDAAYTHIHINDTSYRTAKASGNDVDSKGASSARFKNHADII

SEQ ID NO: 10061 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWARHSRFDKAEMVFEKEKTIVNGKSGRTTITPNWRNTYKVGFGGSYQISEPVQLRAGIAFDKSPVRNADYRMNSLPGGNRIWFSAGLKFHIGKNHVVDAAYTHIHINDTSYRTAKASGNDVDSKGASSARFKNHADII

SEQ ID NO: 10062 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSGRTTITPNWRNTYKVGFGGSYQISEPLQLGAGIAFDKSPVRNADYRMNSLPGGNRIWFSAGMKYHIGKNHVVDAAYTHIHINDTSYRTAKASGNDVDSKGASSARFKNHADII

SEQ ID NO: 10063 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAEMVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADII

SEQ ID NO: 10064 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAEMVFEKEKTVVKGKSDRTTITPNWRNTYKVGFGGSYQISEPLQLRAGIAFDKSPVRNADYRMNSLPDGNRIWFFAGMKYHIGKNHVVDAAYTHIHINDTSYRTAKASGNDVDSKGASSARFKNHADII

SEQ ID NO: 10065 - protein, 422 aa, Neisseria meningitidis
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAEMVFEKEKTVVKGKSDRTTITPNWRNTYKVGFGGSYQISEPLQLRAGIAFDKSPVRKADYRMNSLPDGNRIWFSAGMKYHIGKNHVVDAAYTHIHINDTSYRTAKASGNDVDSKGASSARFKNHADII

SEQ ID NO: 10066 - protein, 422 aa, Neisseria meningitidis serogroup C
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVNWTRHSRFDKAELVFEKEKTVVKGKSDRTTITPNWRNTYKVGFGGSYQISEPLQLRAGIAFDKSPVRNADYRMNSLPDGNRIWFFAGMKYHIGKNHVVDAAYTHIHINDTSYRTAKASGNDVDSKGASSARFKNHADII

SEQ ID NO: 10067 - protein, 422 aa, Neisseria meningitidis
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSGRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADII

SEQ ID NO: 10068 - protein, 422 aa, Neisseria meningitidis
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAEMVFEKEKTVVKGKSGRTTITPNWRNTYKVGFGGSYQISEPLQLRAGIAFDKSPVRNADYRMNSLPDGNRIWFSAGMKYHIGKNHVVDAAYTHIHINDPSYRTAKASGNDVDSKGASSARFKNHADII

SEQ ID NO: 10069 - protein, 419 aa, Neisseria meningitidis serogroup Z
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIMEKAKALKETPPNPTKAAQIKADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRKADYRMNSLPDGNRIWFSAGMKYHIGKNHVVDAAYTHIHINDTPYRTAKASGNDVDSKGASSARFKNHADII

SEQ ID NO: 10070 - protein, 422 aa, Neisseria meningitidis
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKGEMVFEKEKTVVKGKSDRTTITPNWRNTYKVGFGGSYQISEPLQLRAGIAFDKSPVRNADYRMNSLPDGNRIWFFAGMKYHIGKNHVVDAAYTHIHINDTSYRTAKASGNDVDSKGASSARFKNHADII

SEQ ID NO: 10071 - protein, 419 aa, Neisseria meningitidis
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTIVNGKSGHTTITPNWRNTYKVGFGGSYQISEPLQLRAGIAFDKSPVRKADYRMNSLPDGNRIWFSAGMKYHIGKNHVVDAAYTHIHINDTPYRTAKASGNDVDSKGASSARFKNHADII

SEQ ID NO: 10072 - protein, 420 aa, Neisseria meningitidis
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADDAMAKQLWDANKLALLGYTPSEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKFHIGKNPVVDAAYTHIHINDTSYRTAKASGNDVDSKGASSARFKNHADII

SEQ ID NO: 10073 - protein, 419 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIMEKAKALKETPPNPTKAAQIKADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTTYRTAKASGNDVDSKGASSARFKNHADII

SEQ ID NO: 10074 - protein, 419 aa, Neisseria meningitidis serogroup C
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTIVNGKSGRTTITPNWRNTYKVGFGGSYQISEPLQLRAGIAFDKSPVRNADYRMNSLPDGNRIWFSAGMKYHIGKNHVVDAAYTHIHINDTPYRTAKASGNDVDSKGASSARFKNHADII

SEQ ID NO: 10075 - protein, 419 aa, Neisseria meningitidis serogroup A
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIIEKAKALKETPPNSTKAAQIKADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKGELVFEKEKTIVNGKSGRTPITPNWRNTYKVGFGGSYQIREPLQLRAGIAFDKSAVRNADYRMNSLPGGNRIWFSAGMKFHIGKNHVVDAAYTHIHINDPPYRTAKASGNDVDSKGASSARFKNHADII

SEQ ID NO: 10076 - protein, 420 aa, Neisseria meningitidis serogroup B
AQSTANAAAAEAADASTIFYNPAGLTKLDSSQISVNANIVFPSIRYEADSATDFTGIPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIPKKAQMLQATPSNPTAAAQIKADGHADVKGSDWGFGYQLAWMWDINDRARVGVNYRSKVSHTLKGDAEWAADDAMAKQLWNSNMLAPLGYTANEKARVKIVTPESLSVHGMYKVSDKADLFGDVTWTRHSRFDKAELVFEKEKTIVNGKSGRTTITPNWRNTYKVGFGGSYQIREPLQLRAGIAFDKSPVRNADYRMNSLPDGNRIWFSAGMKFHIGKNHVVDAAYTHIHINDTSYRTAKASGNDVDSKGASSARFKNHADII

SEQ ID NO: 10077 - protein, 420 aa, Neisseria meningitidis serogroup B
AQSTANAAAAEAADASTIFYNPAGLTKLDSSQISVNANIVFPSIRYEADSATDFTGIPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIPKKAQMLQATPSNPTAAAQIKADGHADVKGSDWGFGYQLAWMWDINDRARVGVNYRSKVSHTLKGDAEWAADDAMAKQLWNSNMLAPLGYTANEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRKADYRMNSLPDGNRIWFSAGMKFHIGKNHVVDAAYTHIHINDTSYRTAKASGNDVDSKGASSARFKNHADII

SEQ ID NO: 10078 - protein, 420 aa, Neisseria meningitidis serogroup C
AQSTANAAAAEAADASTIFYNPAGLTKLDSSQISVNANIVFPSIRYEADSATDFTGIPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIPKKAQMLQATPSNPTAAAQIKADGHADVKGSDWGFGYQLAWMWDINDRARVGVNYRSKVSHTLKGDAEWAADDAMAKQLWNSNMLAPLGYTANEKARVKIVTPESLSVHGMYKVSDKADLFGDVTWTRHSRFDKAEMVFEKEKTIVNGKSDRTTITPNWRNTYKVGFGGSYQISEPLQLRAGIAFDKSPVRNADYRMNSLPDGNRIWFFAGMKYHIGKNHVVDAAYTHIHINDTSYRTAKASGNDVDSKGASSARFKNHADII

SEQ ID NO: 10079 - protein, 379 aa, Neisseria meningitidis serogroup C
  misc_feature (262)..(262): Xaa can be any naturally occurring amino acid
AQMATAAPFVSDQSEAKGFVDGSTLDLKLRNYYYDRDKKNTTGPNRRDDKDWTQGLWVNYSSGYTQGTVGVGVKAFGYFGLKLDGQRKYSGSGNLVTSSDGTNEDSFGKGGGAVKFRVSKTELKVGDMQPANPVFGVGGSRLLPQTASGISLQSSELKGLDVEAGHFYSGTSQDDTSHSGGIFSAYSGVEAKSADYVGGKYALTDSLGVAFYAAKLEDIWNQYYGNVNYALPLSGDQSLAFDANIYRTVDEGSANAGSISNXTYSASAAYSFLAAHTVTIAFQKVNGDTPFDYIGIGDNNRPGDSIFLNNSVQYSDFNGPGERSWQVRYDLNMAPYGVPGLSFMTRYLNGDNIDGTGLAANSRYRNNDGTPIYGDNGKH

SEQ ID NO: 10080 - protein, 420 aa, Neisseria meningitidis alpha275
AQSTANAAAAEAADASTIFYNPAGLTKLDSSQISVNANIVFPSIRYEADSATDFTGIPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIPKKAQMLQATPSNPTAAAQIKADGHADVKGSDWGFGYQLAWMWDINDRARVGVNYRSKVSHTLKGDAEWAADDAMAKQLWNSNMLAPLGYTANEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADII

SEQ ID NO: 10081 - protein, 422 aa, Neisseria meningitidis serogroup B
AQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTGHSRFDKGEMVFEKEKTVVKGKSGRTTITPNWRNTYKVGFGGSYQIREPLQLRAGIAFDKSPVRNADYRMNSLPDGNRIWFSAGMKYHIGKNHVVDAAYTHIHINDTSYRTAKASGNDVDSKGASSARFKNHADII

SEQ ID NO: 10082 - protein, 245 aa, Escherichia coli
LMTTSVIALISASAAQAADVIVPHEVAPTVISAPAFSWTGFYIGGQVGNFSSKVEITDPNKKDKLFSKDDTPKPSGFMGGIYAGSNMDLGNNMILGVETDAVWADREDAKTSSAEAIGQDELETFRDSLKKANAAFAQGKTSDNVAAVDKHTDSLALKEKWSGATRVRIGFTAADRIMPYVAGGVSYAQVQAVSSTKVTQAADDAEIATAQLFDKTKTLVGFTLGGGVDFAMTDNVLLRAEYRYS

SEQ ID NO: 10083 - protein, 1058 aa, Aeromonas hydrophila
MKKILNRYTWLCILLISIGINAQETKPLIQSKLVGTVVDAVTKDPVIGASVVIKGTTHGVQTDFDGKFFFQTGQKFPYTVIVSYLGYKKAEVVVNDNPVVIELTEEQNQLSEVVVTALGISKEKKSLGYTTQALKNKDIADTKETNFLNSLSGKLAGVRITNSQGDMGSSRIIIRGETSIAGNNQPLFVVDGVPVDNSQLGSVGGATRDFKNAIADLNPNDIETLTVLKGPNAAALYGSRAAHGVVLITTKSGKSQKGLGITFSSGITISQVATLPSFQNSYGQGSNGRFSFVDGKGGGVNDGVDESWGPRLDGRLIPQFYSNGEAVPFVAHPNNVKDFFNTGVTYDNSISVARSDEKSDFRLGVNNQKQLGTVPNSEVNKTNFTINTNYQISKGIRVGATANYITTNAPALPGGPSGNRAAGVMLQFLWFGRQVDINQLRNNRDVNWNNSYYSNPYWNAYYNTTSQQRNRIIGDVHLDAKLAEGLNFKFRTGVDYYNDRRKYTIKYGTNGTPFGSYAEDAYTVNEQNTEGIFTYTKKLNDDFTVDALAGFNIRNHSDANNYQKAPRLAVPDLYTLTNSRDPLTSSNTLSRLRVYSAYASAQFGYKNYAYLNLTARNDWSSTLPSSNRSYFYPSINGSLILSEALKLKSNTLDFLKLRGGWSEVGNDADPYQLSTVYNFQTAFDGNPIQTSSQKKLNENLKPETTRSTEVGLEASFFKNRLHFDFAYYNTNSFDQILEIKTTASSGYNSQLINAGKVNNNGIEIQLDGTPVQTENFKWNIGANYSRNRSKVEILDYAKQIQNYTIGSSGGVDVLASVGQAYGALYGTAYLRDASGNIVVGANGLPKADPTKRVLGHYTPDYLAGVTNTLTYKNLELSFLVDASVGGEIFSGTNRTGTYTGVLASTLPGRGAENGGLSYYLNGTTKTLVNGAAPGGAAVYDDGMVFNGVYDNGTPNTTIISAQEYYKASYNISEAYIYSSTFVKMREIKLAYNFNKSFAKKLGLEGASITAVGRNLFFIYKDAPNIDPETAFNTGNAQGLESLALPTTRNFSLNVNLKF

SEQ ID NO: 10084 - protein, 354 aa, Candidatus Hamiltonella defensa
MKKTTIASLIAAGCGCASANVNAQSSITLYGILDVGIEFANQVVQAQRSASAVREQSGNLAGSRWGFKGSEDLGGGYKAVFVLESGFNVNNGALGQGGRLFGRKAFAGISTPYGTVTLGRHQNLLYELMYRYDPLTLNPSYSAQAMDAQLVNRADNSVRYGVQAAGVTFAALYSSGYDSTIPNGANVPGATKVGREMSATLTYDRGPVSAGVTYDQLQGTSIATQSNTQKRAMFGVSYDFRPVTVLAGLRWLNVSNTSSPASSMLYWGGVNYRVTPPLLISAGVYHTQYRNPHGGPTMGILLVDYSLSKRTELYAEGAYVSNASFSTVGIRGAGNDVTPGADQSGVTIGIRHLF

SEQ ID NO: 10085 - protein, 356 aa, Endosymbiont of Crataerina melbae
MKKTAIALAVALAGFATVAQAAPKDDTWYTGGKLGWSQYHDTGFYGNGFDNRIANGPTRDDQLGAGAFLGYQANPYLGFELGYDWLGRMAYKGSVNNGAFKAQGISLAAKLSYPLTDDLDIYTRLGGMVWRADSKGAYDNGNAGRVSDHDTGVSPLAAVGLEYAWTKNWATRLDYQWVNNIGDAGTVGTRPDNSMLSVGVSYRFGQDEVAPPAPAPAPVVQTKHFTLKSDVLFNFDKATLKPEGQQALDQLYSQLSSMDPKDGSVVVLGYTDRIGTEQYNQKLSQERAQSVVSYLVSKGIPSDKISARGMGKSNPVTGNTCNSVKGRAAVISCLAPDRRVEIEVKGIKDVVTQPQD

SEQ ID NO: 10086 - protein, 150 aa, Listonella damsela
AADRPEDSLAYLGQFGGLTVRANYVFDADGTDFSAPVDSSDNSGFSVGSVYNLNNGLAFGLGYGEQKQQEKNLTAKQGFASVSYTSGDFYVAGLYQNARNIGYQYGYDDAKHSNEYQGYELATAYTINKLVLRSTYNYMENTDSNDKMAN

SEQ ID NO: 10087 - protein, 149 aa, Listonella damsela
AADRTSNNLLYTGNFGGFTVKANYVANGKADESDVNTTGYSFATKYDFNNGLAMGIGYGQQKNQGSNSAQDLNANQTFASASYTMGNLYFAGLYQYARNVGYLYSYDDQKNNDYQGFSLATAYTLNQLVLRSTYNYMEKTTDANVKMAN

SEQ ID NO: 10088 - protein, 155 aa, Listonella damsela
AADRPEDSLAYLGQFGGLTVRANYVFDADGTDFSAPVDSSDNSGFSVGSVYNFNNGLAFGLGYGEQKNQATANKSNSHTAKQGFASVSYTSGDFYVAGLYQNARNIGYQYGYNDAKHSNEYQGYELATAYTINKLVLRSTYNYMENMDSNDKMAN

SEQ ID NO: 10089 - protein, 149 aa, Listonella damsela
AADRTSNNLLYTGNFGGFTVKANYVANGKADESDVNTTGYSFATKYDFNNGLAMGIGYGQQKNQGSNSNQDLNANQTFASASYTMGNLYFAGLYQYARNVGYLYSYDDQKNNDYQGFSLATAYTLNQLVLRSTYNYMEKTTDANVKMAN

SEQ ID NO: 10090 - protein, 150 aa, Listonella damsela
AADRPDDSLAYLGQFGGLTVRANYVFDADGTDFSAPVDSSDNSGFSVGSVYNFNNGLAFGLGYGEQKQQEKNLTAKQGFASVSYTSGDFYVAGQYQNARNIGYQYGYNDAKHSNEYQGYELATAYTINKLVLRSTYNYMENMDSNAKMTN

SEQ ID NO: 10091 - protein, 158 aa, Listonella damsela
AADRPDDSLAYLGQFGGLTVRANYVFDADGTSFNKHNDKNEPTTFDSSDNSGFSVGSVYNLNNGLAFGLGYGEQKQQEKNLTAKQGFASVSYTSGDFYVAGLYQNARNIGYQYGYNDTKHSNEYQGYELATAYTINKLVLRSTYNYMENMDSNAKMAN

SEQ ID NO: 10092 - protein, 150 aa, Listonella damsela
AADRPEDSLAYLGQFGGLTVRANYVFDADGTDFSAPVDSSDNSGFSVGSVYNLNNGLAFGLGYGEQKQQEKNLTAKQGFASVSYTSGDFYVAGLYQNARNIGYQYGYDDAKHSNEYQGYELATAYTINKLVLRSTYNYMENMDSNDKMAN

SEQ ID NO: 10093 - protein, 243 aa, Pasteurella piscicida
AAAVADVSLYGEIKAGVEGRNYQLQLTEAQAANGGASGQVKVTKAKSRIRTKISDFGSFIGFKGSEDLGEGLKAVWQLEQDVSVAGGGATQWGNRESFIGLAGEFGTLRAGRVANQFDDASQAIDPWDSNNDVASQLGIFKRHDDMPVSVRYDSPDFSGFSGSVQFVPAQNSKSAYTPATLANGANNTIIRVPAVVGKPGSDVYYAGLNYKMAVLPGTMPLNMRDTPMWAVMLLICSCLGASA

SEQ ID NO: 10094 - protein, 641 aa, Gluconacetobacter intermedius
MRLRPPQATTIPWRAHSHSARVAATLLFLALFALAAPLWAANFGGTTENLPSWNFANPGYVGIYKSDTTGVTGGNVIFDPDITDLNISGPIIGGYSDGGNANGNQVTITSGTYAGEGLYGGFSDDSGSGNASNNTVIITGGTLSPLGVFGGFSTGGIATGNTLRIFGNPDLSRTALMGGRAEVGSGDPARDARTDNTLEIHTLNLQTLGIENFQHFRFYLPGTVRAGDTVLTVDNGVVIETPSSGPSIAPTTVGVGIMGSGTPLAVNDTVTLIKSTSRLYADTGMTNNVSGMAGISSLYTFGLETTLNSLVARVISIEQTDESVRKSPSEGKTASIALVTQGADLAAGPGMGNARAAASLGADNMAQAGWSGFGATSGATSRYATGSHVDMQSVALMTGLAKRLPVSGVDLLVGGFFETSIGSYDSHNETAAGDSITAQGDSRSVGGGLLGRVEVTEGVARGLYAEATVRAGRLRSDYRSDDLNPTLGEAEYDISVAYYGAHTGLGYIWNITEQAWIDVYAKYFWTHTNGADVSILGDAVTLDDVDSHRTRLGARFGYSLNECIAPYFGAAWEYEFDGTAHSVVAGVDAPAPSLKGGTGLGEVGVTWKPLPDTGFSIDLGAQGYTGIREGVGGNLSLMYEF

SEQ ID NO: 10095 - protein, 367 aa, Escherichia coli O157:H7 str. EC4401
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 10096 - protein, 468 aa, Escherichia coli O157:H7 str. EC4401
MLDVNVDQFDTEAFRTDKLELTSGNIADHNGNVISGVFDINSSDYVLNADLVNDRTWDTSKSNYGYGIVAMNSDGHLTINGNGDVDNGTELDNSSVDNVVAATGNYKVRIDNATGAGTIADYKDKELIRVNDANTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYETPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 10097 - protein, 614 aa, Escherichia coli O157:H7 str. EC4401
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQSVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTALGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 10098 - protein, 1173 aa, Escherichia coli O157:H7 str. EC4401
MNEEHKKRGIMHSKFFTAVAISALLLGSSNVMATQTAESSIYGVAEQLQTITVTGVVLDATGEPIIGASVVEKGTTNGGITDINGKFTLSVKQGAVLKISYVGYQTQEVKAVRTMKIILKEDSEILSEVVVVGYGSQKRANLTGAIATVDVSKTLEGRQIADIGRGLQGTTPGLSVVIPSGEIGSDPTIKVRGQIGSIDGSSTPLILLDNVEIPSIQMVNPDDVESITVLKDAASASIYGAKAAFGVVLITSKKGARNEKVEVSYSGNFSWQNISKKMEMAGVDGIQYRIDALKRAKGTLYGAFWYVDETSLERAKEWENTWGGKLGVNDPFVYGRDWYVDASNRKFSIRTFDPYDYMIREWTPSQTHNISLSGKSGKTTFNVGLGYLDQNGLMKVAKHDDFRRWNGSIRLSTEINKYITARAGANYSKRNKRYAYATNSTTADPWLYLYRWDSTYPMGYDENGNEMRSPVSEVHQANTANKEDNYLSFNVGATLKITKDWKFDIDYTYAGEDQIWKKNGTKYTAADTWTAPVKRLDGNGNQIYVNNKGEVVSAGSQGAMPAYDLNYRQYTADGGNPDHIRRQVTNAKRHTLNITTDYNWQINKQNNLKVLAGMNRTDWESEDNWSQITNLTDINNLSWDKTIGTQTSSGNLYWDGQLGFFGRVNYNFMDKYLLEANVRYDGSSKFPSSLQWRAFPSFSAGWRLSEEKFMTWSKPILSSLKLRGSWGMIGDQTVSSSLYVPTISQGQVSWLDPSGNKIIYAGTPAAVDPSITWQDIATLDFGFDARFFEGSLGITFDWYQRDTKNMIVPGEGVTWTFGAGSPKGNFGSLRTRGWELSIDYNHRFENGLGLNAMFTISDAQTEVTAYGDTKSISSWYVGKKYGEIWGYRTDRLYQKDDFVYENGKPVTVYALNGKEVPANTPGAKEMNKLKDPNGIYQDYFQTGTIKFGPGDVKYKDINGDGKIDAGARSVDTVTDKDDPNYGKRNTGDLEVIGNSTPRYEYGIRLGADYKGFDISIFMQGVGKRDIWGAGFLAIPGFNTSDGAMPQAIAENYWREDRTNAFYPAAYNMAGSNTGFNMQTQDRYLLNMSYFRIKNITLGYTLPAVWTKKVLINKARIYVACENFFTFDNLRGLPIDPEEISGFSMFNSTNYNSGRTGVGTPTMKNMSVGIQLNF

SEQ ID NO: 10099 - protein, 624 aa, Escherichia coli O157:H7 str. EC4401
MVVTASGFQQRIQDSAASISVVTREQIENKAYTDITDALKDVPGVVVTGGGSHSDISIRGMSAKYTLILVDGKRVDTRGTRPNSDGSGIEQGWLPPLAAIERIEVVRGPMSSLYGSDAMGGVINVITRKVGKEWHGTVRADATLQEDSNSGDIYQTNAYASGPLIDGLLGLKVSGLLSHRSEDKIIDGYNEQRLRNGAATFTLTPDDKNEFDFDIGHYVQDRNTTAGRSVALNGKSRDVQYDRNNYAITHHGYYDFGNSTSYVQRDETRNPSREMKSVDNIFNSQTSFLFDSHTLILGGQYRYEELYDEGNQLASAKDLTKLTRWSWALFAEDEWQMTNDFALTGGIRMDQDENYGTHWTPRLYGVWHLAEQWTLKGGVSGGYRSPDLRQATDNWGQITGGKGDPAIIVGNANLKPERSISQEIGILWDNQEGMNAGVTLFNTDFKDKITEVRRCTDTTGNASGQCMINGNSYKFISDRTNVDKAVTRGVEATYGWDINKDWSLTSNYTFTQSEQKSGQFSGQPLNQMPKHMLNGTLNWQASEELATWIRANYRGKTSEYLNRTSMGKTTPSYTFVDLGANYQLTKEFRLMGGVYNVLDKRVDIEVNDKVLDGRRYMVGASYDF

SEQ ID NO: 10100 - protein, 836 aa, Escherichia coli O157:H7 str. EC4486
MASTVEYGETVDGVILEKDIQLVYGTANNTKINPGGEQHIKEFGVSSNTEINGGYQYIEMNGTAEYSVLNDGYQIVQMGGAANQTTLNNGVLQVYGPANDTTIKGGRLIVEKDGGAVFAAIEKGGLLEVKEGGFALAVDQKTGGAIKTTTRAMEVFGTNRLGQFDIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTKVQANAVYDLGRSDQNGSITYSSKAISENMVINNGRANVWAGTMVNVSVRGNDGILEVMKPQINYAPAMLVGKVVVSEGASFRTHGAVDTSKADVSLENSAWTIIADITTTNQNTRLNLANLAMSGANVIMMAEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTVMWSSAINTRNNVTTDAGAGFEQTLTGLTLGIDSRFSREESSTIRGLFFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 10101 - protein, 660 aa, Escherichia coli O157:H7 str. EC4501
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVGASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 10102 - protein, 713 aa, Escherichia coli O157:H7 str. EC4501
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPHHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 10103 - protein, 1234 aa, Escherichia coli O157:H7 str. EC4501
MIASLFSANGVAAAIDLCQGYDIKASCHASRQSLSGITQVWSIADGQWLVFSDMTNNASGGAVFLQQGAEFTLSPENETGMTLFANNTVSGEYNNGGAIFAKENSTLNLTDVIFSGNVAGGYGGAIYSSGTNDTGAIDLRVTNAVFRNNIANDGKGGAIYTINNDIYLSDDVFNNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSSAAGGFMYLGLSEVIFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFAHSLTGFQNGTLNIDAGGNVTVNQGSFAGTIEGAGQLTIAQNGSYVLAGAQSMALTGDIVVDAGAVLSLEGDAADLAALQDDPQSIVLNGGMLDLSDFSTWQSGTSYKDGLEVSGSSGTVIGSQDVVDLAGGNDMHIGGDGKDGVYVVIDAGDGQVSLANDNQYLGTTQIASGTLMVSDNSQLGYTHYNRQVIFTDKPQESVMEITANVDTRSTTTEHGRDIEMRADGEVAVDAGVDTQWGALMADSSGQHQDEGSTLTKTGAGTLELTASGTTQSAVRVEEGTLQGDVADIFPYASSLWVGDGATFVTGADQDIQSIDATSSGTIDISDGTVLRLTGQDTSVALNASLFNCDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTQDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDASTISDDAVKQRGEIKVGVTGNISQRVSLRGSVAWQKGSDDFAQTAGFLSMTVKW

SEQ ID NO: 10104 - protein, 980 aa, Escherichia coli O157:H7 str. EC4501
MHSWKKKLIVSQLALACTLAIASQANAATNDISGQTYNTFHHYNDATYADDVYYDGYVGWNNYAADSYYNGDIYPVINNATVNGVISTYYLDDGISTNTNANSLTIKNSTIHGMITSECMTTDCADDRATGYVYDRLTLSVDNSTIDDNYEHYTYNGTYNNAADTHVVDVYDMGTAITLDQEVDLSITNNSHVAGITLTQGYEWEDIDDNTVSTGVNSSEVFNNTITVKDSTVTSGSWTDEGTTGWFGHTGNASNYSNTLTADDVAIAAIANPYADNAMQTTVTLDNSTLMGDVVFSSNFDENFFPQGANSYRDADGDVDTNGWDGTDRMDVTLNNGSKWVGAAMSVHMVDEDGDGSYDGYAVGTEATATLLDIAANSLWPSSTVGVDNINTQYDENGHIVGNEVYQSGLFNVTLNGGSEWDTTKSSLIDTLSINSGSQVNVADSRLISDTVSLTGGSNLNIGEDGHVATNTLTIDNSTVKMSDDVSAGWGLEDAALYANTITVTNDGLLDINVDQFDANPFQADTLNLTSTTDTNGNIHAGVFDIHSSDYVMDTDLVNDRTNDTTKSNYGYGLIAMNSDGHLTINGNGDNDNTASIEAGQNEVDNNGDHVAAATGNYKVRIDNATGAGSIADYNGNELIYVNDKNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 10105 - protein, 199 aa, Escherichia coli O157:H7 str. EC4501
MRKLYAAILSAAICLAVSGAPAWASEHQSTLSAGYLHARTNVPGSDDLNGINVKYRYEFTDTLGLVTSFSYAGDKNRQLTRYSDTRWHEDSVRNRWFSVMVGPSVRVNEWFSAYAMAGMAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10106 - protein, 199 aa, Escherichia coli O157:H7 str. EC4501
MRKLYAAILSAAICLAVSGAPAWASEQQATLSAGYLHVSTNVPGSDELNGINVKYRYEFTDTLGMVTSFSYAGDRNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10107 - protein, 663 aa, Escherichia coli O157:H7 str. EC4501
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10108 - protein, 330 aa, Escherichia coli O157:H7 str. EC4501
MARSKLNALVRSLTLAASVGAPCLAAAADLMLPPPPPPPPPPIEVGGGWYLRGDVGASIYTRPRYSDAYDYTGYAESNRAFGNAVGGGGFAGVGVGYQFTPFLRGDITGEYRYSTGLRGSEYYKGPDFDNGLGSYGVNKSSGNFDSAVVLANAYFDLGTWYGITPFIGGGVGYAFNHVSSYSTNQQFTSPTYGYDYANPIYGCGCGQPSYNYAPVYDANGNAVYNTNSGSKFYKDKTSGSLAWALHAGLAYNVTDALKIELAYRYLNLGKAETGPGFVPCCTGSLQAIKIKDIEAHDVKIGLRYYLGGVVAAPLPPLMPEPVPGPLVRKY

SEQ ID NO: 10109 - protein, 656 aa, Escherichia coli O157:H7 str. EC4501
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLRYLQVSGSQLKQDFLDLPHGVNNDIAGKHGKMINSSADDKRGIVKLGFTPRENDEYTLTYIKQDGEKDNPPYSGNSGQKSRYWQWPEYDKESFYYQGTTQLNDRFTLRSRLYRDTFENTLMMYNSLADLKNKKGSYSHYSDYSDGAGLQLAADVRENDLLSFAVNWKDDVHWEKGAPHAAYDRYEDRTWSLASEYQWAAADNVDVVAGISYDWRDSVEAKKHEKDDSITHYDDNNQSAFNWQVMGKYHFANEDTLALSYYDRTRFPTLKERYTTSKPAYNQIAIVNPQLKPERARGVDLTWNGAFTHDWGFEVSVYFNRVSDAILSHNIDADTIQNQNSGTVDYSGLDGGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 10110 - protein, 199 aa, Escherichia coli O157:H7 str. EC4501
MRKLCAVILSAVVWQVAAATPASAAEHQSTLSAGYLHASTNVPGSDDLNGINVKYRYEFMDALGLITSFSYANAEDEQKTRYSDTRWHEDSVRNRWFSVMAGPSVRVNEWFSAYAMAGVAYSRVSTFYGDYLRVTDNKGKTHDVLTGSDDGRHSNTSLAWGAGVQFNPTESVAIDIAYEGSGSGDWRTDGFIVGVGYKF

SEQ ID NO: 10111 - protein, 713 aa, Escherichia coli O157:H7 str. EC869
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 10112 - protein, 1104 aa, Escherichia coli O157:H7 str. EC869
MHSVVHPSPSRLMFRKLLSVLAGLLLLLPATVLAQDTGTVSGTVIDSTTSQTLPGVNVTVQGLNIGAATGPNGQFEISGVPAGEQVLQASFVGYTRKNIPVEVEAGETTTVNVRLAPQAVGLEDVVVTALGVEREERAVSSSVQQVSGADLDATDNANFVNSLRGKVSGANIRSSSTMGGSSNIVLRGYSSISGDNQPLIVVDGIVVSNRSRQSGGGTVEGNGGFDFGNAASSLNPSNIKSVSVLKGPSAAALYGSRGANGVIQITTKDGSNLDDEIGVSFSSSVSMSQAYEFMDYQNRYGGGAPSSTFSTLDGDFKKPDGDQYVVQYAVDESWGPRLDGRPVRQWYSWDDVNGLEGEATPWEAHPDAIENFMDTGAVFTNNVALSQQTESLNYRLGLTSRNQGSVMPNGSMDRYQVNFNGSVDLSDDLRATTFAKYSYQDVKARSGMGYGFEENPFAAFNTFTQRQLDYGPDSYMRDYQRANGQQRGWNYAGVSGAQGPATQFQYTDNPYVNRYANFQQDDEQRLLGKAEVAYDIVPNLTGTATVTTDFRTHRFSDRRSDISTGAPGSFSEDVIEEQETSSSLRFDYSRSLTDQVDLTSFVAGKVRYETYEQNLGSTQNGLASPNVFTLQNSVGRPAVEETFQESMVYSTYGLVSLGYQDIVFLEGTLRNDWSSTLPADNNSYLYPSISGNLIFTGLDALQDQDILSFGKVRASWARVGQDTDPYRLGVTYPGSTPFQGQALQNVQRSANNPDLKPERTTGIEFGADLRFFNERVNLSTTYYRDVTKDQILAVDVSGASGIESSLINAGEVSNRGLEASLTVTPVLQEDLQWDVTANFNKNVNKVVDLAEGLDTYNLTAGGVIFGPTIQAREGKAYGAMVQPSLRRDASGDVVFQRNGVPQTTNSPQVVGNFQPDWTGGLSTTVSYKGVTLSAVVDGQVGGDVYSLSNKFGTYSGLVESTVADNQRETGVIPEGVVVDDATPNENGNYDVEGTDFGEAVGRIPAASYWKNWFSAGGGDQFIYDATHAKLQELAITYSLPQRWFNDFALRRASVSLTGSNLMFLYKEAPNIDPSVTLGAGNVQGVESAQIPPQRQYTFRVNLSF

SEQ ID NO: 10113 - protein, 837 aa, Escherichia coli O157:H7 str. EC869
MIASLFSANGFAAAIDLCQGYDIKASCHASRQSLSGIAQNGSYVLAGAQSMALTGDIVVDDGAVLSLEGDAADLTALQDDPQSIVLNGGVLDLSDFSTWQSGTSYNDGLEVSGSSGTVIGSQDVVDLAGGNDMHIGGDGKDGVYVVVDAGDGQVSLANNNSYLGTTQIASGMLEVSDNSQLGDTHYNRQVIFTDNQQESVMEITANVDTRSTTTEHGRDIEMRADGEVAVDAGVDTQWGALMADSSGQHQDEGSTLTKTGAGTLELTASGTTQSAVRVEEGTLKGDVADIFPYASSLWVGDGATFVTGADQDIQSIDATSSGTIDISDGTVLRLTGQDTSVALNASLFNGDGTLVNATDGVTLTGELNTNLETDSLTYLADVTVNGDLTNTSGAVSLQNGVAGDTLTVNGDYTGGGTLLFDSELNGDDSASDQLVMNGNTAGNTTVVVNPITGIGEPTSTGIKVVDFAADPTQFQNNAQFSLAGSGYVNMGAYDYTLVEDNNDWYLRSQEVTPPSPPDPDPDPTPDPDPTPDPIPAYQPVLNAKVGGYLNNLRAANQAFMMERRDHAGGNGQTLNLRVIGGRYHYTAAGQLAQHEDTSTVQLSGDLFSGRWGDDGEWMLGIVGGYSDNQGDSRSNMTGTRADSQNHGYAVGLTSSWYQHGNQKQGAWLDSWLQYAWFNNDVSEQDDGTDHYYSSGIIASLEAGYQWLPERGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 10114 - protein, 541 aa, Escherichia coli O157:H7 str. EC869
MTVFNKFARTFKSHWLLYLCVIVFGITNLVASSGAHMVQRLLFFVLTILVVKRISSLPLRLLVAAPFVLLTAADMSISLYSWCTFGTTFNDGFAISVLQSDPDEVVKMLGMYIPYLCAFAFLSLLFLAVIIKYDVSLPTKKVTGILLLIVISGSLFSACQFAYKDAKNKKAFSPYILASRFATYTPFFNLNYFALAAKEHQRLLSIANTVPYFQLSVRDTGIDTYVLIVGESVRVDNMSLYGYTRSTTPQVEAQRKQIKLFNQAISGAPYTALSVPLSLTADSVLSHDIHNYPDNIINMANQAGFQTFWLSSQSAFRQNGTAVTSIAMRAMETVYVRGFDELLLPHLSQALQQNTQQKKLIVLHLNGSHEPACSAYPQSSAVFQPQDDQDACYDNSIHYTDSLLGQVFELLKDRRASVMYFADHGLERDPTKKNVYFHGGREASQQAYHVPMFIWYSPVLGDGVDRTTENNIFSTAYNNYLINAWMGVTKPEQPQTLEEVIAHYKGDSRVVDANHDVFDYVMLRKEFTEDKQGNPTPEGQG

SEQ ID NO: 10115 - protein, 199 aa, Escherichia coli O157:H7 str. EC869
MRKLYAAILSAAICLAVSGAPAWASEQQATLSAGYLHARTSAPGSDNLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10116 - protein, 1295 aa, Escherichia coli O157:H7 str. EC869
MNKIYSLKYSAATGGLIAVSELAKRVSGKTNRKLVATMLSLAVAGTVNAANIDISNVWARDYLDLAQNKGIFQPGATDVTITLKNGDKFSFHNLSIPDFSGAAASGAATAIGGSYSVTVAHNKKNPQAAETQVYAQSSYRVVDRRNSNDFEIQRLNKFVVETVGATPAETNPTTYSDALERYGIVTSDGSKKIIGFRAGSGGTSFINGESKISTNSAYSHDLLSASLFEVTQWDSYGMMIYKNDKTFRNLEIFGDSGSGAYLYDNKLEKWVLVGTTHGIASVNGDQLTWITKYNDKLVSELKDTYSHKINLNGNNVTIKNTDITLHQNNADTTGTQEKITKDKDIVFTNGGDVLFKDNLDFGSGGIIFDEGHEYNINGQGFTFKGAGIDIGKESIVNWNALYSSDDVLHKIGPGTLNVQKKQGANIKIGEGNVILNEEGTFNNIYLASGNGKVILNKDNSLGNDQYAGIFFTKRGGTLDLNGHNQTFTRIAATDDGTTITNSDTTKEAVLAINNEDSYIYHGNINGNIKLTHNINSQDKKTNAKLILDGSVNTKNDVEVSNASLTMQGHATEHAIFRSSANHCSLVFLCGTDWVTVLKETESSYNKKFNSDYKSNNQQTSFDQPDWKTGVFKFDTLHLNNADFSISRNANVEGNISANKSAITIGDKNVYIDNLAGKNITNNGFDFKQTISTNLSIGETKFTGGITAHNSQIAIGDQAVVTLNGATFLDNTPISIDKGAKVIAQNSMFTTKGIDISGELTMMGIPEQNSKTVTPGLHYAADGFRLSGGNANFIARNMASVTGNIYADDAATITLGQPETETPTISSAYQAWAETLLYGFDTAYRGAITAPKATVSMNNAIWHLNSQSSINRLETKDSMVRFTGDNGKFTTLTVNNLTIDDSAFVLRANLAQADQLVVNKSLSGKNNLLLVDFIEKNGNSNGLNIDLVSAPKGTAVDVFKATTRSIGFSDVTPVIEQKNDTDKATWTLIGYKSVANADAAKKATLLMSGGYKAFLAEVNNLNKRMGDLRDINGESGAWARIISGTGSAGGGFSDNYTHVQVGADNKHELDGLDLFTGVTMTYTDSHAGSDAFSGETKSVGAGLYASAMFESGAYIDLIGKYVHHDNEYTATFAGLGTRDYSSHSWYAGAEVGYRYHVTDSAWIEPQAELVYGAVSGKQFSWKDQGMNLTMKDKDFNPLIGRTGVDVGKSFSGKDWKVTARAGLGYQFDLFANGETVLRDASGEKRIKGEKDGRMLMNVGLNAEIRDNLRFGLEFEKSAFGKYNVDNAINANFRYSF

SEQ ID NO: 10117 - protein, 199 aa, Escherichia coli O157:H7 str. EC869
MRKLYAAILSAAICLAVSGAPAWASEQQATLSAGYLHVSTNVPGSDELNGINVKYRYEFTDTLGMVTSFSYAGDRNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPIESVAIDIAYEGSGSGDWRTDGFIVGVGYKF

SEQ ID NO: 10118 - protein, 199 aa, Escherichia coli O157:H7 str. EC869
MRKLYAAIFSAAICLAVSGAPAWASEHQSTLSAGYLHASTNVPGSDDLNGINVKYRYEFTDTLGMVTSFSYAGDKNRQLTRYSDTRWYEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10119 - protein, 472 aa, Escherichia coli O157:H7 str. EC508
MIHAQSIRSGLASALGLFSLLALSACTVGPDYRTPDTAAAKIDATASKPYDRSRFESLWWKQFDDPTLNQLVEQSLSGNRDLRVAFARLRAARALRDDVANDRFPVVTSRASADIGKGQQPGVTEDRVNSERYDLGLDSAWELDLFGRIRRQLESSDALSEAAEADLQQLQVSLIAELVDAYGQLRGAQLREKIALSNLENQKESRQLTEQLRDAGVGAELDVLRADARLAATAASVPQLQAEAERARHRIATLLGQRPEELTVDLSPRDLPAITKALPIGDPGELLRRRPDIRAAERRLAASTADVGVATADLFPRVSLSGFLGFTAGRGSQIGSSAARAWSVGPSISWAAFDLGSVRARLRGAKADADAALASYEQQVLLALEESANAFSDYGKRQERLVSLVRQSEASRAAAQQAAIRYREGTTDFLVLLDAEREQLSAEDAQAQAEVELYRGIVAIYRSLGGGWQPSA

SEQ ID NO: 10120 - protein, 286 aa, Escherichia coli O157:H7 str. EC508
MIASHRSALAATLATGTLLGLLAGSCALPGRAAAADLPPPPPPPVEAAPVAIGSGWYLRGDFTQSWYDHPRDDAIPDPSDPGMPPLVGLRLSSESGYGGGIGYQINPWLRVDATIDQRGASSFRGYSSRSVFETGYNLEAGKVDVLTGLVNVYADIGTWYGFTPYVGAGVGFADKRMSRNYTQTTCLIDGCDGLEGTGPRNAAFRANHSVTTFAWALTAGLSYDIGAGFSLDAAYRYINLGKVRSGFDEYGGATRLKDLAANEFRVGLRYRFADGLLPAVARGYGN

SEQ ID NO: 10121 - protein, 244 aa, Escherichia coli O157:H7 str. EC508
MKSIATLVVCAISGIACVNLSAHAAEGNHTISLGYAHFQFPGLKDFVKDATAHNRETFSHFVNRNYFSSLGEYTDGRVSGYEGKDKNPQGINIRYRYEITDDFGVITSFTWTRSLTNSQTFIDVQSADHTRKIKNPAASARTDIRANYWSLLAGPSWRVNQYMSLYAMAGMGVAKVSADLKIKDNINSSGGFSESNSTKKNSLAWAAGAQFNLNESVTLDVAYEGSGSGDWRTSGITAGIGLKF

SEQ ID NO: 10122 - protein, 199 aa, Escherichia coli O157:H7 str. EC508
MRKLYAAILSAAICLAVSGAPAWASEQQATLSAGYLHASTNVPGSDDLNGINVKYRYEFTDTLGMVTSFSYAGDKNRQLTRYSDTRWHEDSVRNRWFSVMAGPSVRVNEWFSAYAMAGMAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10123 - protein, 961 aa, Escherichia coli O157:H7 str. EC508
MGIKQHNGNTKADRLAELKIRSPSIQLIKFGAIGLNAIIFSPLLIAADTGSQYGTNITINEGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSSIKTNGDNAHGLWSFGQVSANALTVDVTGAAANGVEVRGGTTTIGADSHISSAQGGGLVTSGSDATINFSGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGTASFSASSQVELGGYLYDVRKNGTNWELYASGTVPEPTPNPEPTPAPAQPPIVNPDPTPEPDPTPNPTPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAHNGFYSDLVVKASRQKNSFHVLDSQNNGVNANGTANGLSISLEAGQRFNLTPTGYGFYIEPQTQLTYSHQNEMAMKASNGLNIHLNHYESLLGRASMILGYDITAGNSQLNMYVKTGAIREFSGDTDYLLNNSREKYSFKGNGWNNGVGVSAQYNKQHTFYLEADYTQSNLFDQKQVNGGYRFSF

SEQ ID NO: 10124 - protein, 995 aa, Bacteroides intestinalis DSM 17393
MDLLSGFNTLWTTGATWDTGTPTALGQSLLRRNLQIVVDRANSRTLAQETAAYFDDRRDQSYSAISGLGSLSDAYKAGAGAFTTITQFDDSNKTVRYDDKGNGAGSSSSALGKVVDLVGAVRNDASTTPAKSHYLYPRPWRQSLDGQSLAFVVAPSLRPAESTTPASDSGFPSGHTNAAYLSAYALAYAIPERFSELMLRASEIGDNRIEAGMHSPFDVMGGRITATYFAIDNLSNPANAQLRADARAQALAYFTAQCGGNVNNCMTAIDPATDRTSQHAQDKALYTARMTYGFDPVGPTNLAPVVPTNAEVLLETRFPYLDASQRREILATTELSSGYAVIDQSGGYGRLNLYAAGDGYGAFNSNVTVNMNASLGGYNAIDAWRNDISGSGALIKNGTGNLILTGNNTYSGGTLIKGGTLTGHAQAFGSGTITDNATLVVDQSTNDTLANTLTGNGALIKRGVGSLNLTGNSSLSGATTVQAGRLAVNGSLGNSIVSVQQGATLGGNGTVGGINVAQGGVVAPGNSVGQLNVNGDVNLAQGSVYQVESDASGKADRIVASGRATINNSTLSLVEGGNWLAASRYSILSAAGGVSGAFAAVQTNFAFLTPTLNYTATDVGLTLDRNAQTFASLAPTRNAKAVAQGLDSAGAGNALWRQVVQDDASTAQATFSALSNELHASTQSALIEDSRLVRNAMNARMQQAQSAQAFGSTTQTLAGDASRGVVWTQAIGATGQTDSSRDASGLETRTSGLLFGADVPLDDTWRVGALAGFSNSSFDLRHASGSTDSDNYHLGVYGGAKWGQLGLRLGAVRTWHELTAKRTLDLPGSSEHFKEDYKAATNQVFGELGYTLEMGNAQLEPFANLAHVRLDTDAFDENSNAISLQNKSQDNHITFSTLGLRAATHLSAGNVVIKPNATLGWRRTYGDVTPESRSAFSGGSTFELSGAPIARSAAVLGAGVDLGLSDTLSVGLSYDGQVSNDASDQSLNARVTLAF

SEQ ID NO: 10125 - protein, 1096 aa, Bacteroides intestinalis DSM 17393
MKNIFLKSHLIFSLLFLGTLFNILSAQNTRNISGIVKDLRGEPVIGATVVVKDLQIGTTTDLDGKFVLEIPHESKQVQISYIGMKTMWLRLSNKEFYEITLEDESIALEEVVAVGYGTQAKATVTSGIASVKKGELLSSVSASPLNNLQGKVAGLDIRQTTGQPGAQPVVLIRGGSTDPSKDTPLFVIDGVIRENMDGINQEDIESMEILKDAASSAIYGAKGANGIILITTKSGASNAGKATISASYRMGIEKIRKHYPFTNARDYLYASRLAGARGINDPNVTGRLEGGAYPYSTGNINYKNGDLIGYGYSRFTTEYLDDLIANMGQAYVDDLLHNQGYETMTDPYSGKELIFKDNNYQKDVLFTTAVTHNYDVSASGGTEKANYYVSLGYINAEGIVLGTGYDRFSLTANGNYSLKDNLKINLGIKHSTISNKGTDPEGSGTSTLDRSSRYPTTFRLYYDDGTPGIGESGGSPRNRLHELYYQDITDKSYITSFQMGLDWEILPGLHFKPSASYYMKEYVYRFFEKYNEFNKSRITREDHNQYRQVMADAVLTYDKKIREHSISAMLGMNYTVNNDYKLQGTGRNAATDYIPTLDPSKEDDQRTTSSLYEERLLGYFTRMTYDYKRRYLLSASLRYDGASQFSEDHKYALFPAVSMGWNMHYEDWFPKNFVNRLKLRVSWGETGNNKLSYSNTQGEYKTFLYGGNPGVLNSVLANNALVWETTSNIDLGFDAAFFDNRLEVSFTGYNKLTTDRLYDKALPAETGFASIKANLGTVQNKGVELSITAHPLSPSSPIGWEITGTFAMNRTYMKKLPDNGRDKNRVQGGLIWDSQSGTYIEAGGLAEGERIGGRWGYIYQGVYDTDEEAAQAPEDTKVSGSKLGKNKVAGDAKWADLDNNGIIDDRDIAFIGWANPDKKGALINALTYKNFSFRFVVDYALGHSIANIWRARANANARNAIITTTDVINGNIWWNPGDAATCKYPRYDNASDWDNGYRNHMRTIAYAGMNSNGNADNSAYYSKGDYLCFREITLGYDMPKKVCTKLGVNSISLSAGVHNLGYITAFDGLNPEQYDGQETGEYFIPLQVNFGVRLTF

SEQ ID NO: 10126 - protein, 624 aa, Bacteroides intestinalis DSM 17393
MKKSALAITLASLLSPVSYLQAQEISVDETIVVTANRFKQIDGAVLAQTVTVTKEDIRRQQADSLFDVFRTLPSIEVAQYGGRGQSASIFVRGGSATQVLVLVDGVRMPRAIMGGIDFNQFPINSIERIDYIRGARASIYGSEAISGVINIITRASIDDDASRVSAGYGSNNHKKGTFAVSKPVGEGKHIKGVLGYEKTDGFNVKPLPGLNDGDEHGFETLNLKLGYQQNFSDNFSGYVGFSTYSNEYDYDNSSYGNPGWGTVDKHEKKTGEVEYVGADLSLEYSKDVYTSELKLAYGQQDNYDLKSGQSKSTGDHVAIEQFNAIWLNSYSINDELSIGGGLDYRNEKLAKGYLAPSDWGPAKDYNPEKNPRTNIGISAIAQYALNAWTFEASVRNDENNQFGNNTTWQTAAGWKVYEGYELTLSHGTAFRAPSFVDLYYPGYEMPNLKPEESKNTELSLSGVASIVDWTVTGYYNQIENMLIWKGAGMQNIGEAEIKGIELEVKLDTDIVSHEFYLDYKDPVDKSGAEDTQLAYRSKRGAKWNAYATFDQWTLGSQYLYQGERFNGSTRLPSYSLWNFTASYAVNSSWDINAKLSNAFDKNYEMYSGYATPGRQYFVSADYRF

SEQ ID NO: 10127 - protein, 1065 aa, Bacteroides intestinalis DSM 17393
MYKLKELFLMFILAFVSISAYAQSLTVTGKVIDSEGYEVIGGSVTIKGAAGVGTVTDVNGNYSLKVNDASKDVLVFSYVGMTSQEVKVNGKNVINVTLKADAVLLDEVVAIGYATVKRKDLTGSVASVNSKELSKVPTSDITQALAGRMAGVQVMQSEGAPGASISIRVRGGISITQSNEPLYIIDGFPSEDGMSTLDPAEIETIDILKDASATAIYGARGANGVVVITTKSGGKESKATVTFDSYVGFKKIAKKLDVLSTAEFAMLDYERRVYDATTQEDWDKDITAFETLYGKYSDIGTNYSNRKGIDWQDETLGRTALTQNYRVGVSGGTDKLNYNLAYSYYDEEGAMVYSGNKKHNISFNMNHKLNDRLSVNARVSYDQMKVYGMGTSEGGDRFNKMQHILQYRPMIGIGGTDDLLLGDEDPIFVDDTGNVMQNPLLSAAEETNDREYRTFQANGGFTLKLFKGFSFRNTTGMRYQTRRNDIFYGDKSITAKRSSINGSIQNLENSSFQTSNVLNYTWSGKGHDVTAMVGQEYVNRWSRNFKAAAANFPNDDIGLGDLSLGLPTAVSSAENYDDKLLSFFTRVNYGFKDKYLFTASFRADGSSKFGKNNKWGYFPAFSAAWRLGEEEFIKNLNVFSDLKVRLGYGMAGNNRIDSYLSLAVLNSVTYPNGDSTQSGYVPKQIPNPDLKWEANKTFNFGLDFGFFNQRLTISPEFYINRSSNLLLSAKLPTSAGYDSMVINAGETENKGIDLTINSTNIMTKNFTWNTSVTLSHNKNSVKQLTGEEVQLWEANFGYSQNTHIIGINQPLGQMYGYITEGLYQVSDFDYDATTQTYTLKDGIPYAGDKANVKPGMWKFKNVDGSEDNKITEEDKTVIGNAYPKFYGGINNTFTYKDFDLSIFLTYSFGNDVLNATKLTNTKTALQNKNVLAAADSHNRWVLVNKSGELITDPQEMAEINRGKTVAAIYDNEVGDTYIHSWAVEDGSFLKLSNITLGYTFPKKIIEKIGISKLRLYATGSNLLTWTKYSGFDPEVSTMGNGLTPGVDFGAYPKSRSFVFGINLAF

SEQ ID NO: 10128 - protein, 1038 aa, Bacteroides intestinalis DSM 17393
MKDAFSTRHTSVKSLRQAIRAVNRASCGALACYLATLGVAHAAPYVEAGQAGNAASWRSAEFNADWGLGAINADQAYAAGYSGKDIKLGIFDQPVYAPHPEFDSPNKVVNLVTSGIREYTDPYIPVKAGDAFRYDGAPSLDSGGKLGNHGTHVGGIAGGNRDGGPMHGVAYNAQIISADNGDPGPEDGIVLGNDGAVYQAGWNALVNSGARVINNSWGIGITDRFDKGGRDPAFPHFTVQDAQVQFDQIRQILGTRPGGAYQGAIDAARSGVVTIFAAGNDYNLNNPDAMAGLGYFVPDIAPNWLTVAALQQNPDAAAAATTPYTLSTFSSRCGYTASFCVSAPGTRIYSSVLNGTSLADLTVGWANKNGTSMAAPHVAGSMAVLMERFPYMTGAQVADVLKTTATDLGAPGVDALYGWGMINLGKAINGPSMFVTEADIPAEFRIDGAYGDSQFVADLPGVGAIVDAGKPTQRTCSGPQCGLDVWSNDISGHGGLTKQGIGTLVLSGANSYSGPTLVNQGRLAINGSLASAVTVNNGGILGGNGSVASLNANQGGTVAPGNSIGTLQVAGDLNLAPGSTYAVEFSPTASDRIVVGGTATVSGANMALSLENDNPALLSSNQTSSVLGQQFNVLQAAGGVQGQFGSVTDNYAFLDGNLAYTGTGVTLALARNGDSFASAAQTDNQRSVAQAIEQLSAGNSVYESIILSQDTASARRAFTQLSGEVHPAIATQLINDSRQLRDAVGDRLRVEGLYDQPAPGSEDNSVWVKALGAWGKNSGSSDSASSTSSLGGLLAGVDGLISEHTRLGAMAGYSDTSLSLGDDTHSRASADSYHLGAYIGHEQGALRLTAGASHSWHRIDVKRDLQFGAFSDRQKVKRDAQSSQVFTEAAYRLNLQPLALEPFANLAYVHFDSDSFTEKGGATALKGSDDTRDTVLSTLGMRAGNRFNLNDTQKLDVSATLGWQHNLSDTSSEQHLAFASAGNSFNVQSVSMDRDAAVVGARASLALGRDARINLDYNGLLGARDKTHGVGLSLDWQF

SEQ ID NO: 10129 - protein, 764 aa, Bacteroides intestinalis DSM 17393
MKHFIFLAQLLVLSLLLNAALAQNRGGMLRGTMTHIQYTKKSISTSDSLSGETQARSITIRRELPLVGATVKLNGTTIQARTDSAGKYFIGKIPRGLYDILYQADGFETDLFRNVFIKNDTITEIDILLFPILSAAQETLVTLSRVPQKLSRIPLSVELLDLDFIQQRNTATLDDALRFLPGVTFSGSAMQIRASPATDPTPNASARQSLTIDQTPVQAALNPQSAWDLMPLNFLDRLELGKGAFSGVYGNGALDGALNAVTGSNFASKTMLRTYAGIYSNAPNELSDWTNNTQFLSGTEVAHVQSFGKFNAYASAGYFSDEGYRENGDAGKWRLFSKSLYQFAPRHQFSLLAGFTENRQGGNTRWINADSALFDASAAHDERYSNLLFLAPTYEFPVSRVTTFALRGRYIGEKLHNQSDFSLSRKHSGLEIQTTLDLGSGYYFTAGFDGYYTDLTANSDSTRTAKGFAIFLQSENPLVEPIRITYGLRYDGLWADQQKLEGKINPHIGLSTPIGKAGSAWTNFRLGFRFPTLAERFFMQDYNGISILPNESLKLENSLTYELGYRYDYIRPIALSKQISLSSISFETAFFYNSFSDMILLVETDSGDLTYQNASSDLKLLGLELTTHLNFNKKLLCLSLSYTYTHSPKTESADAWAFYRRNNLFYGDVLINLGRLSFGFDYRYVSGLSDEAKSLWREVFSQNGTEQAMLQNSAHVLDVKFGMRVFEGVSANLVAKNILNEVYLESPALLASLRNISLQLNAEF

SEQ ID NO: 10130 - protein, 753 aa, Bacteroides intestinalis DSM 17393
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTTHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNDLEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMPEVIGNDWEGISDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 10131 - protein, 730 aa, Bacteroides intestinalis DSM 17393
MMLASPTMYSASAYAEESSYQSAEETMVVVASRAPKSISDIAGTVWYVDSEQIDQEYRGGKNLSDILSSAVPSLDLGSQGRTNYGQNLRGRAMLVMIDGVSLNSSRSISRQLDSIDPFNIDRIEVLSGATSIYGAGATGGVINIVTKKAEDGEVQAETYVSGSSGFNSGDDFDYKLAQSVSGGNDKVRGRASLVYGETNGYYDANGDIIVPDITQGSLQFNRVIDAMGSLSFTPTDTKTINVLAQYYLSEQDSPYGIYFGQNLAGAPNNITGNPADTGLIETRKGYQSDRQASTERLMLNATYHDAEFLSHELFVQASYRSEEMSFSPFIYGTYLAASQQNTDVFSVRAAMVKSMDRLTLTYGVDGYIDKLDSDQVIFDPATSYQSGGLVNKTKDTIGRYPETEVASLAGFVQAGYDITDAWSVEGGYRYQYMKNTVDDFVSSKMQTQIALGAGTSADAVPGGETDYKIGLFNIGTIYRLSSQTQIWANFSQGFDLPDPAKYYGVGKYSDSNNDGHYELVDGIDVANTKLEGVKTNSYEVGFRHNVDAFSVQAAAYISTSDKVVKHSSKNLSVEVIDADKRVYGAEAQASYWVMDNLQLGAMGHFVKSEEKDANDDWKKLSINYASASKAGAWIGWYESNYSVKLQNQTLFDLSDDADGEIDGYSTFDVIGSVELPVGRLGFGIQNLLNEDYTTVWGQRAKGWYAYYGPEEMFDYKGRGRTYTVNYQVKY

SEQ ID NO: 10132 - protein, 690 aa, Bacteroides intestinalis DSM 17393
MEKLFNIYNHIAKPSLYVTLMSVSMLSHAAPANTISNANDKTIKQAEEKTGDTLVVIANNNAQDDGKISSNEIKVRQPQSVGEILKNVPGVQAGHPSGLGQRFKIRGMDDQFINITIDGARQEGYHFHHAGNYGIDPELLKQVDINIGSNSITYDTGAIGGALKFETIDTDDLLTPGQLFGAKSKLSYSSNGSEFQKSLAAYGKLGAVDLLGYVNHRNMHDSESGRDGRGRDSIPTDGKLLNYLLKTKFNLTDEQYISLSKEHYKNDAETNFRLNFGHDINNGKKGRYEIDRDTHNITYGYTPTDNDLIDLKISAYHTEQTFTHMKPVSGDGKGFDTIVKTQGIKLRNTSNFDTQNLFHSLTYGYEYFDTRMAYTDVEENINKKDIEKGKASSFYLEDDVQLGNFHVIPGIRWDHYKYQTVNKKEQPFEKSYSHISKALGLKYELGKSTTLFTNYTELFRGPLGKEIGLGLTNHSNNLKATTGYNLEAGLIGSYPAIFTDNDTLTISGKVFQTNFKNLSTTLANRELHNIPKARLEGFELSTGYRIKGLGLRASYAKVNDKIVKGNELFKEGLEFEPSLGDSITVGGSYLFDKTDIEAGWNSRFVLSKNSKGKGGKGGNSAVDVHKSGYGVSDIYIAWSPKTGTFKNTEILLGVDNIFDKRYNEHSYYLNTTQGQEEKGRTYKATISYKF

SEQ ID NO: 10133 - protein, 327 aa, Bacteroides intestinalis DSM 17393
MKVKNTLGVVIGSLVAATSFGALAQGQGAVEVEGFVNRYFADSQRDFAHDEGNLFGGSIGYYLTDDVELALSYGEYHDIRGTGALGSKNIKGNLTDLKAIYHFGQPGVGLRPYVSAGFGHQSIGDANSGGRNHSTLAIAGAGAKYYFTEMFYARAGVDALYNIDQGDTEWQAGVGVGLNFGGGSKPAPAPAPVAAAPEPMPEPAPEPAMETVRVELDVKFDFDKDRVKEESYGDIKNLADFMNQYPQTTTTVEGHTDSVGSDAYNQGLSERRANAVRNVLVNQYGVDGNRVNAVGYGETRPVADNATDSGRAINRRVEAEVEAQIKQ

SEQ ID NO: 10134 - protein, 383 aa, Bacteroides intestinalis DSM 17393
MLTKKHILTQAIGLGLAIGSASFAANAEITVLKQDPQAGDPLSRLNFTVGGSIRPQFNNLTGDGDKGSYKRNGFDGGSRLRFAADYYLFDDISWVSYYELGIDLPTLFDWDHHHADGANNTTRRMLYTGLKSKTWGQLTFGQQNSVYYDVVGAKTDIWDYDMLGQAPGNGIKGDYDGSYRSRKMLKYKNTFGDADIYASYLFADNEYLPGNGLRYKRQGGGSLGVDYHLSKDLTWGTAWNYTRAEMRNPGNGNEKSYDQNIFGTALSWTPDNWTFTFGGGWYDNFLPSKKVDVNHYFSGDAWGIEYLAGYTVAVNQYGLKSVMPYVMGDRMQYVTGRDYQRIDNGVGVTFKLDYGFRVDYEHVFTSSTDNLGDMNLVRLRYDF

SEQ ID NO: 10135 - protein, 437 aa, Bacteroides intestinalis DSM 17393
MGAVLKAEANIFRSHPFRPMNQATPKKLRSAPCIGVALLLMATGSIQAAEAPPYSVLLQQSLAMAPTMMVQAANVRAAGADAAQARAWLNPRFDTLAENLGAPSSGGQSQRQNTYSITQPFEIGGKRGARIEVGERNYEAAQARERQLRVNYAAELAVAYATAEAAFGRQALAEENLALANEELTVARALVETGKEATLRTAQAQASVSAAQAIEAAASSDVTSTLARLSALSGATEAYTGISSSLLSAQPAMTPGGTTTDDSPAVRTAEAERNAFDAQVNVERKRWIPEVGITAGVRRYGWSNESGYIVGLTASIPLFDRNRNGIDAAVQRVAAAQARLDTVRLEANAARRSAVSQVAATDKQLAAASQGEQAASEAYRVGRLGYEAGKTPLVELLAVRRALVDARQLTIDARLARVRALAALAQADGRLAFEESR

SEQ ID NO: 10136 - protein, 1009 aa, Bacteroides intestinalis DSM 17393
MKTHDNRVLFSKALLKAATCLFLTAGAGMSPVFALPGTAESMKMEITQQTVTVSGVVKDKKGEPIIGANIMEKGTTNGTITDFDGKYTLKVKSAQSVLTISYIGYKTQEIPVGNGGKKDITMQDDSELMDEVVVIGYGTQRKGDVTSAVASVKAEDFTAGKIGDAAELIKGKVAGLTIAKGSGDPNAESTIRLRGVISLQGGSTPLVLVDGIEGGLGTVSPENIASIDVLKDASAAAIYGTRGANGVILITTKNGQRESRTAANYSGYMSLSKFGKTLDFYGAEEIRQGLTNYADKGYDTDWLDAVSRTAFTHNHNFNISGGSKNTTYSADFTYRKEEGVLLETYNEEMRMRFDVSHWMLNDMLKVNFNMVKTFHKNGPIDAAGLGIYRQAIMRNPTEPIWNEDGTFYENFAVNYYYNPVGIIREQDGKYNSENTRMTGNITFEPIKNWQTNLMLSRRVTSDHNRGYYTSEYFSQKSENHTGYAYHSQNEYTTDNLEVTSKYNHTWNKHRFDALVGYNYQYNVNEGFGANNYDYPTDFYLWNNLGLGTALKDGKAGMSSYKNDNTLIGFFGRVSYGYDNKYNVLLSVRREGSSKFGENNKWATFPSVSLGWTISNEKFMEGLTWLNNLKLRAGYGVTGVIVGDSYNSLTRYEYGSPYFYDNGVWHQGLSVKSNPNPDLKWETSKEFNIGLDWAVLDERLSGSIDVYQKKTSDMLYDFTVPTPPNLYNKTLANAGKMRNQGIEIAVNAIPVRTKDFEWKTTVTASHNANKLLSLSNDLYETSNQIDHAYLGEPINLSTQRMEVGRSMGQFYGMKSVGVSENGLWMVENTKTGEIEEFTDNMLSNDDYRQYLGNALPKLYLGWNNSFRYKNFDLSFQMTGQFGFKILNEPRAYYENNSIAYNRLKSVQKAPYGGQYTLSTAQKQTFVSYYLEDGDFLKMTNITLGYNIPLKSSKFVKNIRAYVSADNLFCITGYDGLDPEMSNGDIWSLGIDWRDKYPSTRSFTFGLNVSF

SEQ ID NO: 10137 - protein, 1141 aa, Bacteroides intestinalis DSM 17393
MKNILYQESIVENKHLFHIMKITALILFIFVGTTFATETYSQTMKVTVVADKISTDKVIHEIEKQTDYLFVYKVNEVNLKRTVQVNAENKSVAEVLNKVFEGTDIYYAMEGKNIMLMSKAKAGVTAQQTNKVTGVVKDKAGIPIIGATIIEKGTANGTVSDIDGNFSLQLNSQGTIIISYIGYITQEINVDKNQELVIVLEEDTETLDEVVVVGYGAIQKRSVSTAISTVKGGKISDMPTSNISQSLVGMSSGITLQQISGEPGAAPAIRVRGSGSINSGNDPLFVIDGYPTTDAELFNNINPADIADIQILKDAASSAIYGSKAGNGVIIVTTKQGQTGKAKVSFSTQVGWSEAQNYVDVLEANDYMDMIIEARTNNGTIQDFPQLVQMRESGNYTNTNWQDAIFRNALNYRGNTTITGGTETLKYNFSANYQNEDGILLNSYYRRTGIKGGFEANLSKKVKLGVNLNTTYSKKRIQQPTGGNTEDVTGVIAQALSMPPILPVYQPNGDYTQIAQHYAGLGLNNQLRNPVANLMENRNDAWSIRTMSNAYLEVKPIKGLTLRSSINFTTNSAKKDYYQSAYLLGKKYTGNKSTPDLTSIDGYRMSGFGYNTYWSTTATYDVMFNEKHHLNAMIGYDFEYNNDFDVQQDDRTDSDNPIAYNNTSITNINGATLWTGSSNYSNYVFDAMFARVVYDYNYKYVFSGSVRRDRSSKFGPDKRAGWFYSGSLAWNLTEEEFMKNISWLNIAKLRASYGVTGNDQIGNDYAWISSISSDQNVVFGNTAISTYYPSGYSNRQLGWEKNKQIDLGFDIGIFNALNVVVDFYKRTSDIVMPANIPNFNGISGSVYMNAGQIENKGIEIQVSATPFKGEFSWETTLSWSKNNNKILSLANNQNQLANAKAGTKWSNVIRNYVGRPMGDMYMLKVIGTFNTEEDLAKYATNGTQGIGDLIFEDYKKDGTIDVNDYQLVGNYQPDFTFGWNNTFKYKDLDLAITIDGQCGGNVIYAAARAFSLNRYDDNVLAESGLGRWISPTNTGNGTSHKAGTNNLGSNIGPSTRYLYDADFLRIRNISLGYTLPKKFCKTIGIEGLRISANVQNLWTFDKYPGYSVEANYEGNSATNNGVDFGGYPISRTFTFGLNFNF

SEQ ID NO: 10138 - protein, 638 aa, Bacteroides intestinalis DSM 17393
MENIAGAYNALAHRNEQDSRDISLKLASSFLDKKVLLDTNVGWHHQNDSSLPVDGSGIGNEEGWSGVPQFEMQRNQPFYSITDLETIPDPSVCNPVNGVSPCTVTNYLLGGPGFLLDRTVERYQGNIVGTLLLNALGHHVVKAGLDVEVMQNKDTRAYSGKVLYRENVNGGTFQDFRAFGYLIGPDEEVVQASVPTSTRANAVGGFLQDSWSVLDKVTVNLGLRYDAQTIHGNGGTEAFDLSNQLSPRVGVIYDFTQQGRSKLFASYARYYQNAVLAMVNSQFSNITRLQATRNRAAQGDAPGCDPLRQAAPYTECRDERNIVRGAPESVSRLYNQTFAINSPVDPDLKPQSSDEFVIGGEYELLPGASVGLTYTHRNMNDVIEDMSRNEATNYFIGNPGRGIASDFPAAVRDYDAVSLLFNKAFSNLWLIQANYTWSRLYGNYSGLFRPENLQLAPNVTSDFDLVSLTENHMGLLPLDRTHSLKFYGAKELVLSGSASINLGLSYRGASGAPLNVVGAHYIYGPDFTFILPRGSGGRLPWVHAFDTRLAVNYRLTGDMVATVSLDVFNLLNFQAVTSQDQRYTADTVDAIVGGSADDLAGLMPRGNTSRTVVVNPNYGKPLSYQPPRSVRLGARVSF

SEQ ID NO: 10139 - protein, 770 aa, Bacteroides intestinalis DSM 17393
MKRHAMATCLLMAALGVCAQTQEQDSLRVINLQEVEVISTRATNSTPVAFTNIGKEQLKKQNFGQDLPYLLSMTPSAITTSDAGAGVGYTTLRVRGTDGTRINVTANGIPINDAESHTVFWVNLPDFASSVKDMQVQRGAGTSTNGAGAFGASINMQTGDFSMKPYAEFNGSYGSFHTHKETVKVGTGLINNHWSFDARLSNISTDGYIDRASVGLNSYYLQGGYYNDNTSVKLITFAGKERTYHAWNYASKEEMERYGRRYNSCGFMYATDRDGHVYSKEYYKDDNGEKHYLTDEGGALHFYDDQTDNYTQKNYQLLFNHNFTSQWNLNIGLHYTKGDGYYQEYKGERSLAEYGMSPFEYNGGKIEVSDLIRKKAMDNWFGGGIFSVSYKADRLHASLGGALNRYDGDHFGKVLWVKNYIGELNPDHDYYRNNATKNDGNIYLKANYELVSGLSAYLDLQYRHINYKINGLNDKYNWTATTPGMQKLDIDEDFDFFNPKAGLSWQIDRNHRLYGSFSVAHKEPTRNNYTDGYFTEHPKAERLFDYELGYTFANSWLHAGANFYYMDYKDQLVLTGELNEIGEAMASNVPDSYRTGIELMAGIKLDCGFQWDINATLSKNRVQNFTETLFENEEAGSEAWVIEHGDTPIAFSPDFILNNRFGYTFKGFEASLQSQYISKQYMSNAKQEECTLDAYFVSNLNLSYTFKLPKVKSITIGCTIYNLFNEEYENNGYAGSGYYLDDNGGKVRYNYAGYAAQAGTNVLGHIAINF

SEQ ID NO: 10140 - protein, 1107 aa, Bacteroides intestinalis DSM 17393
MNEDRKKRGLANGKFFTAVAICALFLGSGNVMAAQTASNDSQGVQEQMQSISVTVTVVDTKGEPIIGANVIEKGTTNGGITDLDGVSKLNVKPGAILQVSFVGYTTQEVKATSVMKVVLKDDTELLDEVVVVGYGAQKKVNLTGAVANVDVQEAIASRPVTDIAKALQGITPGLSITTNVGGIGVDSNIKLRGATGSLSATEGTSPLILVDNVEVPSLSLVNPDDIASISVLKDAASASIYGTRAAWGVVLITTKTGKKNDKPRVTYSNNFSWSTPTVMPQVAKTYEGAQAMLLAANRSGASTVSSIGYNVDEIAVQKMKEWYNTYGGMSQSELGEMQLGRDFEERGGKYYFYRQFDPLDMFMKDWTPQQKHNLSVSGGSDKTTYNISLGYLNQQGILKVNTDEYDRYNFNANVNTQIRDWWSVRANVMFSRSTKSEPYQYTSGYTDVWYYLLRWPSFYPYADYQGIPFRSAMTEIAQANRESLTNNFTRVNLGTTINPIKDLAINFDYTFALLNDYQKRNGGEVGGWDMFNSSNPLTYNSSFYGATHNRVVERSRYTMSNTFKAYATYEKSFVQKHNLKVMVGMDAETREKLGHSSDRRTLVNFDKPEINLAIGDQYVDGTTYHNDFAAAGFFGRINYDYMGKYLLEVNARYDGSSKFPSGDQWALFPSVSAGWRLSEETFMKWAKPVLSDFKVRGSWGTIGNQDVAANSFLSVMSVNKSSGWVIDGKQVPYIGIPSVVSPSLTWERVTTIDLGFDARFFNNELGVSFDWYQRTTSDMHSPGETLPSTFGSTTMPKVNSGELQGRGFELSIDYNKRFACGLGLTARATLSKIREKITKYNNPNKNIYGNYEGKIIGEIWGYETDRLFQYEDCYQDADGKWFIDTNKVPSQALYETGAFKYGPGDVKYKDLDGNGEITYGEQTLEDHGDLKRIGNTLPNFEYGFSVALTYKDFDFSTFFQGIGSRDVWAVGQTGIPGFMPGEGWLEHQMDYWTPENTDAFYPTPTSHSWINNGQNFLRQTRYLQNMSYLRCKNITLGYTVPEKWMKVITFTSGRIYVSAENLFEFDHTNIPVDPETTEKAAASNGEYKFGKSYPFMRSISFGVQLTF

SEQ ID NO: 10141 - protein, 1111 aa, Bacteroides intestinalis DSM 17393
MNEDRKKRGLANSNLLIAMAITTLIIGSSNAMANQTASGSSYKVTEQMQIQTVTGVVVDANGEPIIGASVVEKGTTNGIVTDMDGKFSLNVKVGTTLQITFVGYQPQDVKATKSMKVVLKEDNELLDEVVVVGYGTQKKANLTGAVSTVDVSKTLEARPQSDVSKALQGVVPGLTITNTSGKLNSKPTMTIRGTGTLSNSATSNPLIVVDGVPMDDISYLNTQDIDNISVLKDAASTSIYGTRAAFGVILVTTKSAKKTDKVTINYTNNFSWDTPTILPNYPDVATQARALRAANTRANLENELFGMYMDDNFIAKAEAWKQRHGGKKAGYREMIPGDDFDLGEDGSALYYADWDVVGIMFRDWKPAQSHNISIQGTSGKTSYFLSVGYNHEEGVMTFNPDKLNKYNANMNVTSDITNWLQIGGRFSYSDKAYTTPNTRRNTYTYMWRWGSFFGPYGTYQGIDMKNDIAYLKQAGDDKTNDSYTRIGAFLKATIIKGLTLNADYTFNINNKTTKSVGLPVICWNSWGGKLNTPTTAAGANGDTWVYQNSVRDNSYALNVFANYELTVAKDHHFNFMIGANAEEGEYQNHWSQRKGLLDDKLPEFNLATGDQTVGGTHNEWGTAGWFGRINYDYNGIWLLELNGRYDGSSKFPSSDRWAFFPSGSVGYRISEEKFFGPIKKVVSNTKIRASYGEIGNQAVGSNMYISTVSKRTDGNTHWLNGSNKVVAYDLPSLVSPTLKWERIQTLDIGGDFGFFNNELNISFDWYQRTTKDMLAPGQTMPDVLGAGAPKINAGTLRTRGWELSIDWRHHFNEVNVYANASIGDFKTVITKWDNDSQLLNENYSGKVYGDIWGFETDRYFTKDDFNADGSYKEGIASQKKLEQDGFVYGPGDIKFKDLNNDKEINGGEGTVKDHGDLKVIGNTTPRYQYGFRLGGEWKGIDIDMFFQGVGKCDTWTQSAFVMPMMRGADAIYANQANYWTDENPDPNADFPRMWPGNAGKGTVSVLDLGNHNFYPQSKYLVNMAYLRFKNLTIGYTLPKDWTRKVYMDKVRVYFSANNICELINKSNAPVDPEVNTSEAIANGGSSDYGNGTWGRVDPMYRTVSFGLQVTF

SEQ ID NO: 10142 - protein, 338 aa, Bacteroides intestinalis DSM 17393
MNEEDNSSEGNSESTETPTPVLRPEAGSYVANLAAANTLFVMRLNDRAGETRYIDPVTEQERSSRLWLRQIGGHNAWRDSNGQLRTTSHRYVSQLGGDLLTGGFTDSDSWRLGVMAGYARDYNLTHSSVSDYRSKGSVRGYSAGLYATWFADDISKKGAYIDSWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGASNLGEIKLGVNGNLNPAASVWGMWACSWVIMATMTPQ

SEQ ID NO: 10143 - protein, 1001 aa, Bacteroides intestinalis DSM 17393
MKRNLMFKVLLMLVIGCFLSIDAFAQQITVKGLVKDTAGEPIIGANVVIKGTTNGTITDFDGNFQLNANKGDIIVISFIGYQPQEAQAAASMNIILKDDTELLDEVVVIGYGSVKKDDLSGSVVAIKAEEMNKGAVTSPQELIMGKVPGLSVSQGDGAPGAGSTIRIRGGASLNASNDPLIVIDGIPVSNDAAPGTPNALATINPNDIETFTVLKDASATAIYGSRASNGVIIIQTKKGTQDKIKVSYSGTFTAKDPYKRIETLDAQSFREVMQAQYPEGTAQSADIQRILNVYPNQSTDWQDAIYQTGLSTDQNIGIAGKAGFMPFRISLGYNTEKGTLKTSKYERYTGAVNLSPKFFDNHLSVDINVKGTINKNRFADSGAVGAAAFFDPTKPIYDEENRYNGYWNWGIVQGAQADLATQNPLSLLYDRNNHGTTKRSLGNIQLDYKIHGLEDLHANLNLGYDVAKTTGRNFVNSNSVQSSLDKTFTGLGQGNTWNNLRRNHLLDFYMNYAKNIESIKSNFDIMAGYSWQHFYYANHDITYSNPTEDLGAKEGYTYDANERHYIRDDHRRIPYENYLISFFGRLNYNFMDRYLLTATLRRDGSSRFSENNRWGLFPSAALAWTISNEPFMKATENVLSKLKLRLGYGVTGQQEIGDYQYITSYSFSTNPNTTYLGTTLLKPNGYSPDLKWEQTTTYNVAIDFGFLNNRINGSIEYYQKHTKDLLNTISAAAGTNFINLITANVGKMKNKGVEANVNAIAIQSKDFTWEVGYNITWNDSKITKLTTTFNPDYQGIDAGTNQKHQVGEMPGTFYLYQQVYDENGKPIQNAFVDRNNDGQITEADRYLTHKSPMAKVYMGFSSQFSYKKWDLGFNLRANFGNYVYNGVASGNSTSNNYGGKGFVTNLYNGFQDTGFTLLNTSEQMASDYFLENASFLKMDNITLGYSFQNLFAAKLSGRISASVQNVFTISKYSGLDPECGAIDSNIWPRPRTYTIGLNLNF

SEQ ID NO: 10144 - protein, 504 aa, Bacteroides intestinalis DSM 17393
MKKKTLHQMLVKSGVASGLPLLLSLGIVQPALAQASSPTAAPAENAAPPAPATRAPDGVPGGNGATAVQTDAAPTGFWDRSNLFGDMGGLRTKLGDHGITLNLQETSEYLRNLSGGTSRGGAYDGLTQFGFSVDTEKAIGLPGGTFNVSGLQIHGTSLTARNLQLLQTASGIEAEATTRLWELWYQQSFANGRADVKVGQQSLDQEFMVSQYASTFINATFGWPVLPAVDMPAGGPAYPLSSLGVRLRAKPSDAWTVMAGVFDGNPAGGVGDAQQLNRHGTNFNLRNGALFIGELQYALNAPPADPKAPQAGLPGMYKLGVWYNSERFADPRYDTNGVPLADPASNGVAATHRGNYGFYAVADQMVWRPGADSPRSLNVFARVMGAPGDRNAVDFTLNAGVTLKAPFAGRDNDTAGLAVSYAKIGSRARGADGDTGVFQTPGYPVRRAETLIEATYQYQVTPWWQLQGDFQYAFRPGGGIPNPNEPGSRIGNEAIVGVRTTITF

SEQ ID NO: 10145 - protein, 247 aa, Bacteroides intestinalis DSM 17393
MKIKALLCSTLVAVTALPTFAGETKLDVRFGHNTASDIRDSRVKFMHTFDTGFYFSAEAAQIHNDGYFAGNDSNDPDKNGLKAAAQEFEATYKFDLGEDWYWAPGLVMVTAPNWTEYRPYLKLGTTFDNGVSLTGRYRYNWSNDENGKNYLDGSGTTRGASNQFDLWISKNFGDVGLMYNPRYRYQDGVDQGTGRDDYWEHTIMVNYKLNETWTPYMELVSVDETYVDEQGNRENDYAVRLGFVMNL

SEQ ID NO: 10146 - protein, 946 aa, Bacteroides intestinalis DSM 17393
MRQKITLTILLFFTFIIGFAQNGSIVGKVQDKETNNDPLPFVNITVKGTSKGTTSDLDGLYQIPDVAPGTYTLIFSFVGYKTQEVENVIVNAGKITNVDVIMTVNAAALDQVVITATTRKVSEAATLLEQKKSKDIVQIIGAEELARKGAGDAAAAVSKISGISRQEGSSNVYVRGLGDRYLNTTFNGLPLPSNDINKKNIELGLFATDVIENISVSKAYSSKQYGDFAAGNVNINSKDYKGKGYVEAFVGTSVNTNAIGEDFVVSEGSGFFGDYARHNQNPFAVILSHGVDPEDVSAPINVNFGISGGKSWDFENGSRLSVFGTASFENGYEYRRGEATDFTTVEKKAFEDAEEFEYSTTTTAMGTVNYKIDDKNKLKFNSLFINSSTNEVGYFGIDGQGRNRDAILNTDEGFYQMNAQFDQNQVYVNQLIGNHKSGKFELDWAAGYNFVLAKQPDRRRISIENYQFAFDNDPTTNPTFFSNVDYDNQRYFQDIDDTEFNGRINLQYEANENFKLNFGYNARSKERNFENIRYGYDIIDSDFAVTDVNNLDAVFNPSNLSLSSGQGIYAIKVINAIPTLSNTNRPGLPENTYTGNLDLFAGYADAEIKSDKWLIVPGIRFESFDQSISYDVINLGNNGNSSASAYENFILPSLNIKYALTEEQNLRLSASRTVSLPEFKETAPFVYIDVTNRIGGNPDLLGSNNPDFINVSDVSYSNVLNFDLKYEWFYGKGEIFSVSAFAKRISDPVNRVVAFDATGTQRYFRTGEEARVYGIEVEFRKNLLQNEDEETLLAAGFNTTLMHTEQDLFDVIQGTYSVNFRNDKDELQGASPIIINADVSYSPTFGSYKPTGNLVFSYFSDRIDALGSGQLGNIIEKAVPTLDFILKNKISDKFEVNFSIRNILNPDIKYVRETSGGDVLVTSTNGKGVSGYDRGRNIGLQLKYKF

SEQ ID NO: 10147 - protein, 3685 aa, Bacteroides intestinalis DSM 17393
MGKIIMANKLLTGLSSLLLPLGFYGMPAQSSMGYQRSYLSASINRSSDITAVNMAATRILHEAATVVTGELDIINASPVKELVIIDAAVADKQVFYRGVKPGIDIVEIDSSASGLSQLTAILADYKNLTALHIVSHAEDGVLHLGSSRVDAAMLKQEVETFAALQGALVEGADLLLYGCDLASSEKGDELLEILRNNTHLDVAASTNKTGNTEQGGDWELEIQRGHIETGLAFSEKSLRDFSAVLAPTAYNSLSFCWGPAAPGYGAGGNSDMCIGPLTSQDGRIVLTASPAAVLSSGPNWGAGYSLITQNASAGQNSGWIEFSADGANLSAFTLSSVTRGYTMYESCTSVTVTGTRQSDGTTVSDTLSGAAVGYGNDAVHTPVNLAGIALTSVRVSFNSCTQNMGFFNLRGFTIEPAASNAAPVNTVLPSISGTATVGNALSTTTGTWTDADGDSLTYTYQWYRADNNSGTNLAAIGGATSASYTLTTSDAHKYLRVVVTANDGNGGTTPANSTYTQITNSAPVNSTPPSISGTATVGNALSTTNGTWTDADGDSLTYTYQWYRADNSGGTNLTLIAGATSASYTLTTSDAHKYLRVEVTANDGNGGTQAANSAYTQVTNSAPVNSVAPSISGTATVGNALSTTDGSWTDADGDSRTYTYQWYRADDNGGTNLTLIAGATTASYTLTTSDAHKYLRVEVTANDGNGGTQAANSAYTQVTNSAPVNSVAPSISGTATVGNALSTTDGSWTDADGDSLTYTYQWYRADDNGGTNLTLIAGATSASYTLTTSDAHKYLRVEVTANDGNGGTQAANSAYTQVTNSAPVNSVAPSISGTATVGNALSTTDGSWTDADGDSLTYTYQWYRADDNGGTNLTLIAGATSASYTLTTSDAHKYLRVEVTANDGNGGTQAANSAYTQVTNSAPVNSVAPSISGTATVGNALSTTDGSWTDADGDSLTYTYQWYRADDNGGTNLTLIAGATSASYTLTTSDAHKYLRVEVTANDGNGGTQTATSIYTAVANTAPTDITLSNSNVNQSGGADAEVGVLGSVDPDADTTFTYSFATGAGDTDNGSFNISGSSLRANDSSTLAAGTYSVLIRTTDSFAGVFDKAFTITIVDDISPTITIGSDKASLKAGETATLTLTLSEASSDFAAGDVTVTGGTLSGFSGSGTSYSATFTPSDNSTATATIDVNAATFTDAAGNDNTAATQLTMAVDTELPDAPSTPVLDAASESGSSNTDNITNNTTPTITGTAEAGSTVTLYDTDGSTVLGTTTATGGNWSITTSALSEGDHDLTATATDAAGNVSVASAALTITIDTTAHAKPAAPVLATASDTGESDSDGITRLTDLTLQGAVGSVEANAIVHARSDVEGGLTNTTANADGSWSLDISGLAENTHQLQINATDVAGNTSVYSDALTVVIDTTAPTLGSVAFDQANVTTANQTAVSFSLSGAETGTKASYSITSSGGGTAVTGSGLDVSTATQQFTDIDTSSLADGTLTVSLTLNDLAGNSATQTNTIAKDTGAPVNNVPGAQTTTTVEPIVFEGSNYIGVSDAGSLTTVVSVDNGTLTAITTGGAGILGNGTASITLTGTASDINTALNGLIYQPGNAGSATLTIDSTDAVGNSDSDTIAITIGNSVLRVTSNLDTGDDASIGASYAADQADGDGLSIREALYWARAEDTITFDLDSATAGNQGGTITLDGGQLNITRSGLKIQGDLDGDGRPDVTLSANNASRVMSVDTGLSNIELTGLTLRDGNDVAGAGLAIGFNTSLTLRDSVITNNNEPGIGGGGIYGSNVMLTIINSTISNNTSGSFGGGIRIVGGSTLNLINSTVSGNTSDDNGGGIQYAGPGLTMVNTTVSGNTARGTNSDGGGLQVSSGTANVYNSTIAGNAAGHAGGGVSANGTEAFINTVVAGNTAGTGATAGASGSPLATGGSADDVSGTIETGINNFFGTAATVTVDTNNLNNQGTGSLLLGDLTYNNGGNAQTHLPQPGSALLDAGSNADLPVDTYDLNGNNDTAEPLPVDANGNKRISNIVDIGAVESNNPPVLGNVNGGGTYVENGSAIVIDSDITVSDTELDLLNGGNGDYDGAAIVIARNGGALATDSLGFHDGNGLSLAGGNLLKNGQNIASFDTSTAGQLTIIFTNANGETPTTTDVNRVLQQVTYSSTSEDPGTSVSLDITLDDGAGGSVTETASLTITEVNDAPSLTATGATPTFTEGGAAVSLFSGATATTVEAGQSLIGLTLTLTNLSNGSAEILGLDGSDVALLHGNALTTITNAVNVTVSVTGTTASVTLAKPAGITTAALATLVDGITYRNTSNNPGTQNRVVTITSLQDDGGTANGGVDTATLAIAATVTVVSVNEAPVISGTPATSVNQDEAYNFIPSASDADGNTLTFSIANQPSWAAFDTATGALTGTPTNADVGTTNGIVISVSDGLASASLPAFNLTVMNVNDAPTISGTPATSVNQGAAYSFTPTASDIDVGDSLSFSIANMPSWASFNTATGELSGTPGNDDVGTTSGIVISVSDGSASASLPAFSLTVVNVNDAPTISGTPATSVNQGAAYSFTPTASDIDVGDSLSFSIANMPSWASFNTATGELSGTPGNDDVGTTSGIVISVSDGSASASLPAFSLTVVNVNDAPTISGTPATSVNQGAAYSFTPTASDIDVGDSLSFSIANMPSWASFNTATGELSGTPGNDDVGTTSGIVISVSDGDDSASLPAFNLTVVNVNDVPTISGTPATSVGQDAAYSFIPTASDADGDTLTFSIVNKPSWASFNNATGELSGTPTNADVGTTNGIVISVSDGDESASLPAFNLTVVNVNDAPTISGTPGTSVNQDTVYSFSPTASDIDVGDTLTFSIANKPGWASFNTTTGELSGTPTGADVGTTIGIVISVSDGALSASLAAFNLEVVQVVDPTQPVLTAPADIQVNATALYTPISLRQLLSLQAGASDETVAQALAALASDGVNGNSCCTTHPQGLNANNVLLLSPGRHELTWTTSNSQGKTATATQVINLHPLVSLSKSQVAIRDSQVEFRVILNGNAPSYPFEVPYVIDTSNSTATGDEHDLVDGSVVFTQKGQTQISVPVTIHALSGLGDRQLVVGLGSGINQGAANRHVISIREGNVAPTVQLKITQGGASTTIVTPSGGPVTVTAVVTDPNPNDTHSFDWSATRGLPDTDGNPVDAARVFDPAGLSGSHSVVVTVTDSGGASTQAQTYFRILPNLPILSEDVDTDGDGISDLDEGAGDDNGNGIPNYLDNMPDTNVLPQVGLITNAYLIECDPGVRCGLGLYAMGGGSGGVQILDNELGTIDNLIVDSRYTPVGGIFDFVIQDLPTPGQSVRVVIPQQAAIPANAVYRKFQDGSWNNFVANANNAVYSAPGNPGYCPPPGTDDWQVGLVAGYYCVQLNIEDGGPNDADGLVNSAVVDPGAVSVEIVIPEPPAPIDIKSSSGGGAMHTLWILLLGVLLMTRKVSTKTLVVLALLVSAMTSQAAQDKPFYVRADIYDVNSTVTKQDFRQALEDAGYEVTLNRYDTDRTGYQISVGYQWDQHWFSEAGYLDLNKVRVNLTLAGDTNLDEFTRDFAAKYPISAQGFTLVQGLKVNLIGSINLLGEIGIYLWQSDIDVRNNVLSIDEDEGADPLVGVRLEVPIGDSLGIGVGIRRIYFDQQQADLFSVSGTFRF

SEQ ID NO: 10148 - protein, 76 aa, Bacteroides intestinalis DSM 17393
MRELSGLRKTLGFELPDSDGWIFSLGSLYRPEPKVEIGVAYLLFLKKDRNVDNQTIKGEFKDISAHMLTLSVGYAF

SEQ ID NO: 10149 - protein, 672 aa, Bacteroides intestinalis DSM 17393
MYITNRVANHDAYIVQYSLSTPFDISTATRTFVDGAGTKLTCSTDMQLPHAIEFKPDGTRMFITTNKDHSGNPGVAVYQFKLTTAWDTSTLDCEKIFEVDITGVGNEDQVRTLTFKPDGTRMFVGGKTQDKIREYILTTPFDLRSGVSVGSLSASLASSSDGGMRNIQLHSDGSILYVAGDGNNNIHKYTLSTPWDITTISSTSTEYELGSRVSHMRGFIFTANFTKLFVTNDAGSTASTNKIFEYSLACAGTITCIDASNNNDVKAIIEANVELSKRIIKNNTLPIFHRIEWLRRHKNKDNLSNLNAEIDFTNEKISKLVSALKNSKKENDRSYDSEDWFKWSEGRISLGKNKSINSSSRDFHSYGISVGADKIKDDDRDAMHGYVFQYANDNVDIGSSGTKLETDAYSFALYDTKLRDDHVFTDALIGVSLLDIDQKRVIYGNILEGNREGQQIYGSFNFGKRIVDEDLNLNPGIKLDLGYTKLKAFRERTVVGDSLADALLYKEQNIKSALITLGVLLDKTDTDKEEDEIINHHGRLEYIADLSPSSDAEFYYLNSQSTVYNYNVENKSKHNLRIGYGFDVTSITGWSFVGNFERFQSNGKGHSNEIYLSVGYVPIDEMKFVFDLNNFENTSFSYTNNINGFDLKMSSNYNFISDVPDYGANIEISNKF

SEQ ID NO: 10150 - protein, 764 aa, Bacteroides intestinalis DSM 17393
MAFHSFYYRIPLVANTTRGMTMRAILLAGCAAFALTAGTAAAQDGPEFAIEEVVVTAQKRSENLQDVPVSVTALSGEALADRGVTNVTGLNNLAPGLRVSSGDAAANPKIFIRGVGLSDFNPNSSSGVGIYVDGVYVSSPLAQMAGFFDIGQIEILRGPQGTLYGRNTNGGAVNVTTKRPTRSFSAEASAEYATYDAVNLTGAVSGPLIEDVLLVRAAGQLVKDDGYTYNRLTGNDLNDTDYWAVRLSALYTPREDVEALFQVNRFANRGDATQPQHRALFPLTAEAAGADGFCAPGFYGSGQCGDAFGYADLDDDDRATAVNQEGKDKIDLFGASAHVTWDLGPVSLVSVTAYSWAHRNAFENTDSSPARMIEINYLARQRQFTQELRLQSDGGPDARLNWVLGGYYMDETVKDASTQDVLGDLRPLFPDGFSLADSVGAFSYPYTQETKSYAIFGQADYRLTERLVGTVGLRYSADDKSFDYRSQAEGGLIVLLTSQQDKTFSAWSGRLGLRYEVSDDLNVYATYNRGFKSGGFFGGLATTPEELIPYDNEQLDAYEVGLKSQLFDRRLRLNLSAFYYDYQDQQVFAQALRNGLTVLVLDNAANSEVYGAEVEATARLSRNLTIDAGLSLLDAKYGQYVSEGDDFTGNRLPQSPKVTFNAAANYVRPLPWGGDVVATVDAAYSSKIYFDNSNAQRLSQDGVWVFGAQAGWRAPGGGLEAGLFARNLFDETYAVSISNIDSLGVDLLTLNRPRSLGVYVRYRY

SEQ ID NO: 10151 - protein, 423 aa, Bacteroides intestinalis DSM 17393
MKKVMLKTTLSLAVTVASTQIFAAGFAINEHSISGMGTGYAGRSSSADDASTVYGNPAGMSRITREQVTGGVAFLDAKTDISDASSSPNGGSNKGDMVPFTSVPMGYYVKPIDEHWAFGLGVYVPFGLITDYENGFAGRYFGSKSEVKIITFQPTVSYKFNDVVSIGFGPTINRIDGSLESNLSITQAAPDGKVKIKGDDTALGYNIGVLVQATDSTRLGLTYHSKVDYKLEGNTKVNYGVLGAIGLGANQKYDASLKITTPESVDLSVTQAINDRWNVYAGTTWTRWSQLEKITVKNSGVQPLLAGQFGEITEEQNWHDTWAYAIGTSYQLNKEWVLRTGLTFDQSPTNNVDRSPRIPTGDRTIFSIGAGWSPTEDLTIDVAYSYLKEEKVNIRNTNDRGQSYNSQYENSANGFGVGATYRF

SEQ ID NO: 10152 - protein, 365 aa, Bacteroides intestinalis DSM 17393
MKRNLLAVIIPALLIAQTAQAAEIYNKDGNKLDFYGRVKALHYFSDDAGNDGDKTYVRIGFKGATQINDMLTGYGQWEYQISANHSESDSAKDTKTRLGFAGLKYKDIGSFDYGRNYGIIYDVGAWTDMLPEFGDDAYVKTDNFMNGRTNGVATYRNNDFFGLVEGLKFAVQYQGKNENDGRANSKANGDGWGLSSSYEIIDGLSVGAAYASSNRTAGQKAGTFGKGDKADIWAGGMKYDNNDVYLAATYSQSRNIAPISGTATINNTSTSVSGFANKAEGLELVAQYQFDFGLRPSLGYVQQKGKDIEGIGDADLVKYIDVGAYYYFNKNMSTYVDYKINQLDGDNKLGLKDDNVIAVALTYQF

SEQ ID NO: 10153 - protein, 1145 aa, Bacteroides intestinalis DSM 17393
MRKISLNGLFCPKSFENKQLLRTMKTTLFLLLFVTFQAYCGNSYSQNAKVSIPDSQLRVGQILSQIESQTDYLFVYNKKSVDVRRTVNVDAKNKAVAELLDEIFAGTNIRYVMEGKNIVLTKRGESIENVAGTQQERVTVKGVVTDSKGEPIIGANVLEKGTTNGIITNLDGEFTLNAPANATLVISYIGYEPINVTLNGRTSLKIQMKEEALALETVVVTAMGIKKKEASLTYSTQQVGGDELTRAKDPNMINALAGKTAGVSITRNSSGLGGSAKVSIRGIRSANADGNNQPLYVIDGVPMLNNVAEQAFSAMGGNNDAGNRDSGDGISNLNPDDIESMSILKGASAAALYGSQAANGVILITTKKGKAGMQRIVFNSNLTIDHAICLPEFQDKYGASGATSWGTVPENANSTPIKAYDNVGDYFSNGVTATNSLSIMTGKEKMQTYFSYANTTAKGIVDVNKLQKHNITFRETASLFNDRLTLDANVNLMTQKIKNRPTSGGYYMNPLVGLYIFPRGEDLSIYRDNNGFEKYDENRSMPLQNWYTDISGFNQNPYWLTNRVTSNDKRFRTLASLSANLKISDWFSVQARGNVDYINDNYEQKMYAGTTADVAHQNGRYIKMNRQDFMVYGDFMAMFNKTWNDWSLNAAIGSSINTTKVNSLSLDSGKSGLYKANVFTVPNMNLSGAGTSYIDETANQRRTIQSVFATAQLGWKESIYLDVTARNDWSSTLANTKSEDSGFFYPSVGLSWILNKTLNLPEWISFGKVRASWAQVGNDLPIGITSPAQTITAGGVVKPIDYYFAEDLKPEISNSIEVGTEWKFFNSRLDFDFTFYRTDTKNQLIRVNTTAEQRPYRWINAGKIRNTGVEITLGATPLMNDNFRWKTQFNFATNKNKIVSLGGTPNFQYASGNVSMPYKMMVVEGGSLGDIYGNVFVRDANGKILLEPATDKDGNPNAKAGLPQVTTDKAAKIGNFNPDWTLGWSNTVTYKGFSLYFLIDARVGGDVISLTQAGLDYAGVSKATGDARDAGYYMLEGQKINDVQKFYQMVGDRGNGTTEFYRYDGTNIRLREVSLGYSFPQQMLEKTGFIKGIDLSLVARNLFFIYKDAPFDPDATMSVGNDNQGLDTFGMPSTRNIGFNIKFTF

SEQ ID NO: 10154 - protein, 1149 aa, Bacteroides intestinalis DSM 17393
MEKHQLFSLKKTEEKQLLLIMKFFSFFLLIGIGHCLATNSYLQSKLFTMKTSQKTVKQVFQEIEKNSEYIIFYMDQIIDTNRKVNIDVKNQQVSAILDQLFLGTDNTYSINDRQITIYHKGEQPNSQQQSNKFTVTGVITDAQGESMIGVSVKVKGTTLGGISDMDGRYSISVPNKNDILIVSFLGYATEEIKINGRRNINIRLREDTKALDEVVVIGYGQQKKESVVVSMSSVKPSEIAAPTRNLTNNLAGQVSGLIAVQRSGEPGYDDAEFWIRGISTFASNSSASTPLVLVDGVPRKITDIEPDEIETFSVLKDAAATAIYGAEGANGVILVTTKRGKDEKPKITFKTEHSISSPQRLPEFVGSADYLSLYNEALNNDGEPDLFSAELIEKFRTSTDRDLYPDTDWIGELLRKNTHNHRYTLNVRGGSARSRYFVSGAYYTESGIYKGNPTEKYDTNIGLDRFNLRSNIDMDVTSTTLVSIDLAGQYLIGNYPGESSSTIFRSMLITPPYCFPAVYSDGTVATYEQERGVNMRNPYNQLMNSGYTRQWRTGIQSKVGVRQKLDFITKGLSAKVNVSYDFDATFKSIRSYNPSRYHATGRDENGNLTFIQVVSGTPDLSDLKDNGIEAQKKIYIDAAINYKRIFAEKHDVSGMLLYMQKETQLKTQPLPYRKQGLVGRFSYSYDGRYFLEGNFGYTGSEAFAKNHRFGFFPAVGLAYYLSNEPFYPGVLKNYINKIKLRASVGKTGNDTTSDRFIYRPTFSMNAGSWSQGIGSNGGTNSIGQGIIEGFPETLDIGWEIEKKQNYGFDLGLFNNKIDIVFDYFRSERSNILMQRKTTPTLSGFRVNQYANYGIVSNHGVDMSLNAHHQIGKVKLSARGTFTFARNEIKEYDELPQKYPWMERTGKRINENNLYIAERLYTKEDFIINKNSNGIESYTLRPELPQSTLGGLLGPGDIKYKDVNGDGVIDSYDKVVGVGHPNVPEIVYGFGLNIEYKGFYASVFFQGTGNCSVLLGGNTPEGWYPFAWGVDQSSYRTFALDRWTESNPSQNVLMPRLHKDNANNANNQVASTWWLRNGGFLRLKNMEFGYQLPKQFLKKFNVQAARIYVMGYNLALWDNLKYFDPEAGNANGGNVYPKNRTFTLGIDFTF

SEQ ID NO: 10155 - protein, 1001 aa, Bacteroides intestinalis DSM 17393
MKRKLHGFLTLLLVLVVQIGFAQDKTVSGTVTDDEGLPLPGATVVVEGTSTGVQTDFDGKYEIVATEGSTLNFSFVGFTSQSVPVGAQNVINVTLDVDQGALEEVVVLGYRTSTKEKSSVSSVTVTAETIENRPNASFVQTLSGQVAGLNISTSSGQPGANSTVNLRGINSINGNTEPLFIIDGAPVDEDNFRSLNPQDIASISVLKDAGATAIYGNRGANGVVIVETRRGSFNSPLKINYTGILGVNTLQDNDYDLMSSQEQLRLEQRYGNGRGTGLTDEEIAAAETTDWANYFFRDALTKSHTLNLSSGGAKTTQFTSLGYSEIEGILRNSDLQRFNVRSNVSGRSENDKFNYGLNLSVNYSENNEPNSIGTGGINQNYILGAYQSVPYISPDDYTNGADLTSPLSFTNTPLFLIDKLRTFTRLEEEVKVIGSFNASYEIFDDLTAGIVASADYNSEFLTNATAPDSFNGLLFGGAANPTAGDQSQQTTRVFSFNNVTSLNYDKEIGDHTFGVGAYLEYFKAHLRTFGYTAEGLDPKTFSPGDGSGFVDDNSENDFFVDQANANILNAGLFSYFGTLDWDYDGRYGLSGSVRRDASYRFSESNRFATFWSIAGRWNIHNEAFMSGSVFDVLKLRGSYGTAGNQRITGTTYFSGPDLTRNFFATGSGYGGQNSIFLSQIANTTLKWETVTSSNIGLDFELFQSRLRGSVDAYYKETEDLFQSTPVSAINAITSINANVGSLSNKGVDLTLNYDVVRSLEEGGFNMRVNLVGNYNETEILDLPSDDGEIIGIGREGGKLFEYYTIEYAGVNPANGNALFYTADGEVTENPNADTDRVWLDKNIYPDFTGSFGLNMDYKGFFLQTQFNYVIGVDRYDFDLSGFQDPTSIGQFRSSNDLQRAWTPDNRVTDIPALRATNIGVYESTRYLVDADYLRVRFATIGYSLPKTSLDQMGLTALRVFLQGENLATFSEWRGFDAEAQDNTSRIYPTPRTISLGLEIGL

SEQ ID NO: 10156 - protein, 719 aa, Bacteroides intestinalis DSM 17393
MQKWKFLCPALLMAVRRLPLSERFSIQPSRLRWRYAHAALLALLAGGALAAEHDHAAHGEQADSVELAPMVVTGVSQQSPLTVVTDPKIPRQPMPASDGADYLKTIPGFSAVRNGGWNGDPVFRGMFGSRLKLLSNGGEMLGACPNRMDSPSSYISPDTFDKLTVIKGPQTVLWGPGASAATVLFEREPEQLSEPDYRINGSLLNGSNGRFERKLDAAGGNAQGYARLMANSSQADDYDDGNGDTMPSRYDKWNTDVALGWTPDADTLVELTAGRGDGYARYAGRGMDGSQFQRESLGLRFEKTDIGETFYGLEAQVYYNYADHIMDNYSLRSPGGMIAGPDASRVDRRTLGGRLVGTWQWTDVELKAGVDAQREASETYEIHRLACEIYRVAAAGKRPRLPWIPDAMLHSYGWFGELSWQLSEAEELISGLRLDLHEAKDQRRLFNSHNASTMKKEDWDNPTAGDTRRDTLYSGFVRYEEELPSLPATWYVGLGHAERFPDYWELFVSNPGPVGTVQPFDSVRPEKTTQLDVGLQYAKGPLEAWVSAYAGLVEDYILFSYVPGVMPGMLRAEVSNVDATIAGAEMGASYPLQQNWKGDASLAYAWGENRSDDRALPSDPPLEGRLGLTYSETTASTSGLWRARLPRREVGRREPGHGMVGKDFDESAGFGDDAMGSAKVMPDRLNKNCKLSATYDNLLDKAYSEHHPAAAARHYAGYQ

SEQ ID NO: 10157 - protein, 988 aa, Bacteroides intestinalis DSM 17393
MKHFLIWIFLFFFAMSGLAQNLNIKGQITDTSGESIIGVNVKVKGKDTGTITDIDGNYHLQATPNDILVVSYIGFITQEVPVKNRTVVDIRLIEDVKALDEVVVVGYGTQRKADLTGAVIRADIKTLKRSPNSNVLQSLQGNVPGLNIGQVTNSGGTPSMSIRGTNTLGGNKDVLVILDGIIYTSSLSSINPDDIESVDILKDASSTAVYGAQAANGVVMITTKKGMEGKPKITFSSSYTFSNPTHNYRPMNREEYLDNVRDFYYTEAFLGPDYTTPNPDFDLASKLPDAPLRDENGNVSPYNYNWWDEGTQSGHLFENRFNISGGSKSINYMLSYSNTDQRGFIVNDDFKRNSVRMNLNAEIAPWWKIGIQTFGAFVNQDGAEPGLWNLITQSPLIEPYDENGKIKPYPFNTLDTNPFMGSDIDDYERHNYFFGNISSEIKLPLKGLVYRLNFGNNYRIDNHFQASQYGYNLQGEAYKEHTGYYDYTIDNILAYNATFGEHHIDATLLYGASERKYDYTKALGQGFTRMTLGYNSLEQATTRYVYSDAWREALCYQMARVSYRLMDRYLITGTVRRDGFSGFAANNKYATFPSIALGWIISEESFFKIPWIDYLKLRGGYGISGNQTSRYKSLSTVASEIRYVFGDGGKPVIGQEISALGNNNLKWEKTAGINLGLDFTILGQRLTGSVEYYSTTTKDLLYDVALPDITGFSKIASNLGKIKNKGFEFILTSKNIQTSDFKWTTSLNFSTNSNKIVTLTGEDNDGDGIEDDNISSNLFIGQPISAVYGYVVDGIYQLGDDIPAGFHPGNYRIVDMTGEGEITPEDRVILGKGDPAYRFGIMNTLEYKNFTLSFFINSVQGGKDGYLAANSSSLVRDQNNLRWNRISAWDYWSPRNPDAVYARSISTPKITPTVYEDRSFVRLQDVSLSYAFPKSVTNKVGLSEIDLFFSGKNLLTFTKWHGWDPEAGSTYSGRPVMRSFSFGVSLTY

SEQ ID NO: 10158 - protein, 712 aa, Bacteroides intestinalis DSM 17393
MRNRLTTLALATALALPAAAHAYSNIYFFGDSLTDIGAFGGLGGLPSTARWTLGYGPGWSQDFGGRFGIAVTPNNPNNSTITAKNGNNYAQGDARAQPANPVNTNPESPTGSPVPGAINVSDLVDLTVNGAVTNPGQISTYLAQSGGKADPNALYSIWIGGNDVINSLTVGQTAMATALAGGATQAQAQTAASNAIQSYLTTSATNTVQAVGALKARGANTILLPNLPNIATAPLAVFATINAKYSTPADAANLATAWGAAWNVLSASPTATSAALVQQALAAAETSVGLSSGTLSNIYSTQVQPTLQSGSSGYNQLVDMQLVGAGLSHGIIRANINGLFNEILANPTAYGLTNTSGSACPQSALYCNAQVVAGINYLFTDPLHPTPQAYKIVSDYFYGLTQAPYFAAAIPESSLNNARQLGGALDARYQAIRSQKRAVGEVSAFVNGAFGDGKASYGGLSAKPKGQLYTVGLDFQATPALSVGLAMSRQQGKTDVDSVGTPGSIDDRTTLMSGFASYNQNKFWVDGDLHIGSGDLDTHRNVTLGPTTVGIDGKTRATQFGLRAAGGYRMQYRGVTTGPVAGLDYAYAKIAGFAEQGGTSSSMSFSSQNVSSLVGRVGWQLDAEVGRFSPYAKVSFAHEFKQNDRSVTAGLATTVGDWTTNLGKPDANWMEWTAGVSANFNKTITAFGQLTATSGKNGGNQTGGNIGVAMSF

SEQ ID NO: 10159 - protein, 361 aa, Bacteroides intestinalis DSM 17393
MTTGLYYFSQDLRYAELRNLLGGARIVSGGGTQDQTTWGIFASTDWHFTDTLTLNLGARYSWERKAVRVSALRANGCNLDTLICATNFADAAKWRGFTPKIGLQWKPDDDTQIYGLYTRGFRSGGYNLRNTDPAVPPGPFNQETQDSFELGAKKQFGRHRINLAAFYNRMKDLQREINLPGPLGVSQVIRNTADATIKGVEAEGQFFLLSNLVISGQLGYVNGQYRNVQFDLSGDGVINDVDRALKLPRLSPWTYGVGLTYDQQLGELGTATARVSFTHRDKAAFTDNNVGFLQGADMLDASLTLATDNKHWRFSIYGRNLLNEVTIGGDTPLPAAFGGTGASLSPLNRGRVIGGEVAISF

SEQ ID NO: 10160 - protein, 184 aa, Bacteroides intestinalis DSM 17393
MIEALNKMKTALRTICAAGVALGLAGFASAASAQETETRGNIYNQTHFQPGLYVGGGLGWGWSDDDDDWTWKGIAGWRLNQYLAVQGFYADLTDITVAGVSSDVDTFGAELLASFPVSDTMAIYGKGGLHNYDEVGSGRDTSWLAGAGVDFALSDNMSLRTEWTHYDLDSDDVDEASVQIVFGF

SEQ ID NO: 10161 - protein, 1102 aa, Bacteroides intestinalis DSM 17393
MKENSFKRNRKAMMALLLCTGFIVTQPISVMAEEIMIFAQTAQQQKQSVSGVIKDATGEPVIGASVLEKGTTNGTITDFDGRFTLNVIPGTTLIISYIGYKTIEMKTVAGQPINLTLIEDSEMLEEVVVVGYGTMRKKDLTGSVVQINPSKIADQNPTSVQDVLRGTPGLQIGYDASAKGSDASILLRGQNSLGTNASPMIVLDGMAFYGELSEINPDDIAQIDVLKDASSAAIYGAKAAAGVIIITTKKGKEGKPVINVGANLSVSRKSDYRDYFDAAGYLKFHQDWRKMYYTYGQGEDGLYDYYQAKDGSGNLLYPAGYYDDPRTLTEAEQKAWASNIGVSGIGLSESESMLGLFARRLEFNNSPMMMENFLNGRMVDWNDATFRTGFNQDYNASISGATERVNYYFSLGYINNEGAVQGNEYNAFRSNMKINAKITDWLEVGANVNFQDRSDGDIQVSLGSNYWDNNMLRNSPYASMYDNNGNYEQYPMSGLPTNGGYNYYFDRQYYDLEKGYTVLNTIFNAKITLPAGFSYQFNIAPRYQWFYDRYWMSADLPNASAADRGVNRGWSKNFDWNLNNTITWDKIFGEHHFTATLVQEAEEHRYWSDNVNARNITPSDALGFHYTQGANKTQSGFSTNDTHYTAASYLGRLFYSFKDRYMFTGTFRRDGYSGFGSNNPWGNFGSVGLSWVFSEENFMSDAHDWMDMGKLRLSWGTNGNREFGDVYSTLSNLSLAGGSMVYYQNGNSNVVNPLYMSRLAAPNLEWEKTKAWNIGLDFSFLNGRLTANMDYYLKKTTDMIMSQRLPSFSGFGSIMANLGEVQNQGFEIALNSTNIQNRNFTWNTSVGFSINKNKINHIYYDYDENGVEKDDTSNGWFIGQAIGTIWYYETDGVWQNTPEDIASAALVGQKPGDPKVVNHYTEDDRILEDGTRIPVYNDNDKVYQGTTAPPVYWNLRNDFTLWKDLTLSVSLYSYMGHKSRAGYWLNQENGGSQVTNGFNVAARKYWTPDNPTNDYCRLNAAGPNTGLANGVDKVYNRSFVRLDDITLGYTLPQKWTRKFMIDRIRLTASCKNVCTFDNWEYGDPETGGLATRTFNFGINVTL

SEQ ID NO: 10162 - protein, 473 aa, Bacteroides intestinalis DSM 17393
MMKNTNTKEIKNTRMKKGYSQYHALKKGLLKTALLFSLPLSVALAEDDGFYMGVGYQIGGAQQNINNKGSTLRNNVIDDFRQVGVGMAGGNGLLALATNTTMDALLGIGNQIVNTNTTVGNNNAELTQFKKILPQIEQRFEANKNAYSVQALQVYLSNVLYNLVNNSNNGSNNGVVPEYVGIIKVLYGSQNEFSLLAAESVALLNALTRVNLDSNSVFLKGLLAQMQLFNDTSSAKLGQIAENLNKSGGAGAMLQKDVKTISDRIAIYQENLKQLGGMLNNYDEPYLPQFGPGTSSQHGVINGFGIQMGYKQFFGSKKNIGLRYYAFFDYGFTQLGSLSSAVKANIFTYGVGTDFLWNIFRRVFSDQSLNVGVFGGIQIAGNTWDSSLRGQIENSFKEYPTPTNFQFLFNLGLRAHFASTMHRRFLSASQSIQHGMEFGVKIPAINQRYLRANGADVDYRRLYAFYINYTIGF

SEQ ID NO: 10163 - protein, 339 aa, Bacteroides intestinalis DSM 17393
MKIKHALPLAALLVSSTAFAAHTDNDWYTGLRLGATDYTDYKISGGESSSAIDANIGGGLFLGYNFVDWFALEGGYTYLGELETSEKITNHALELVGKFTLQATDNLDLFVKAGAFGYKTDADSANDDGFNATAGFGAEYFFNDNVSTRLEYQYYNNLTLDEAKWDAHLLAVSLVYNWGSPAAIAAVAAPIVASQLVAEEPVQEKVEAVKEKVQDKMMKIASEKVQVAFPFGSSVLSEESMQQLTPVIEHLKAYPDAKLFLVGHTDASGPAEYNQTFSVKRADALATYLSEEFSIDKSRMTVSGEGESMPIATNDTTEGRAMNRRVSVFSPSFEMMANK

SEQ ID NO: 10164 - protein, 1016 aa, Bacteroides intestinalis DSM 17393
MKKQILLLCLALISLCGYAQQITVKGVVTSATDQQPLIGTTVQVKGTGTGTITGIDGDYTLPNVDKNAVLVFSSIGFESQEIAVGGRTTINVVLKEAAELLDEVVVIGYGAVKKSDLTSSIATVKGDEITETVTGNAMDALQGKVNGVQVTSGGGPGATPKVLIRGVTTVNGTNPLYVVDGMPVGDNINFLNSNDIASMEVLKDASAAAIYGTRASNGVILITTKKGKTGKARINWNSSVGFQTVAKPNIAGAAEYKEVFNTRYTNDGLSSIWNDTGATTNPGGTDWWDTVVNKTALVQNHSLSVAGGSEQFVYNFSVGYYRNNSQFDVGYWDKINIRLNTEYTFNKYVKLGVDIAPRVESWDDTPNQFSAAMAMDPTTPVFRPQDQWEDNEYNNYQRSYNNQEWNPAGSIARSNAHSRELGAILNTYLQVTPIEKLTLRTQFGANAHYRRSDSFVPKFNMDPLEKQDLNEITRRNQEWFDWNWTNTATYMDTFAEKHNLNVMAGFTAERFAWYNTQARRDNVPNNLDQMQEVNAGQQGTDEANGETTYNTLVSFLGRVMYNYDNRYYISASLRADGSSRFPKGSKYALFPSVSASWRVISEAFMQDQDIFSDLKFRGGWGRVGNQNINNNATLTLLSETQYYYGNTLANGYFVSTVGNNQLKWETVEDWNVGVDMSFLDSRLGVTFEYFQKKSIDMLYQKQNILSLGYDNWNSQIWMNIGSMQARGWEVGLTWRDEIGKDFSYDLGLNLSAVRNKAIKFSGDGPINVGGFNSDQIIRNEDGGFISRFYGYVADGLFQNWEEVYAHTDEHGTLIQPNAKPGDIRFKDRDHNGVLDANDKDYIGNPYPDLMMGLNIGMRYKNIDFAANFYGTFGNDIYNVTKGRYSGSGGQNVWAGTLEKAWHGEGTGNDIPRLSSNDLNLNYNRVSSFYVEDGSYLRCKLLQIGYTLPKKWVGGADLRLSFSAQNPFTITGYSGMDPERPMVDGTTDSSGSAINTGIDNVAYPNPRTFLFGIDFKF

SEQ ID NO: 10165 - protein, 277 aa, Bacteroides intestinalis DSM 17393
MCSKKIKNLILCLSFVFNLHAEENITKDRGAPILSEEKHPQTLELNEEKKEVAKSVDEKSLLEEIHKKKRQLYMLKGELHEKNEAILFQQMAKTKSGFFVGAILGGMRINAHPNAHSYDNFNITGGIQAYPLLYGLRSGYQKYFTSGISGLRLYGEYLGGAMKGFQSDSLASYQTASLNIDLLMDKPIDKEKRFALGIFGGVGVGWNGMYQNLKEIKEYSQPNAFGLVLNLGVSMTLNLKHRFELALKMPPLKETSQTFLYYFKSTNIYYISYNYLL

SEQ ID NO: 10166 - protein, 720 aa, Bacteroides intestinalis DSM 17393
MSKKIIATNLLLTLPFSLLSLQIHAAMTQNSPDKIIVTASPSQDPQGPISGLVATKTLSTNKILSDIDKTPQSISVITRDQMDAQDVSSVSQALRYTPGVFTEYRGSSNRNDEIFIRGYSYAPRFLDGLSYGMGASSSTGAIDPWLLERVELIRGPSSVLYGQLNPGGLVAMTSKRPTSTTINHIQARVGNDKLAETAFDFAGSLSDDNRILYRLNGLAKTQQTQIKDYKEERFALAPAITFLPNEQTRLTLLSFIQQEPEAGYRNFLPAYGTVKTTPEGTIPFDFNVNNADYHQSWRQQYGVGYEFEHEFNDRLKLIQNARYSHIKQKYKYLVFGSLRKDNPYILERRAQQEKRETDTFGIDTRLQADFDTEKLAHTVIIGIDYQWSKNKDNLLQAMGPEYDLDWRNPNYHYPIDISLQKPVTNQLQKHDQLGIYLQDQIQWKNWILLGGLRQDWAQVRTYDHIKSSKDQQDDQKLTGRVGLLYAFDNGISPYISYSTSFEPNLQTRRAPGSAPFEPSEGRQLEVGIKYLTPNEQTLATLSIYQLQQRNVTNYNAEKAYFEPVGEIRSRGIEAQINSQLTENISFISSYAYTDTEVRKTITAGTQGKELPRVPKHMASFWGQYDETSGLFNGAKAGFGVRYIGVSQGDTKNTISVPAVTLYDAMVGYSLGELSSSLKGAEVQLNMNNIANKHYVASCAGETACFYGIGRTMTATINYRW

SEQ ID NO: 10167 - protein, 1040 aa, Bacteroides intestinalis DSM 17393
MKQKILQFKSFTVYSLVLIFFSFSFEAKATTISDVQQTVSGTVTTAADGMPLPGVTVVVKGTSNGTTTDFDGNYELEVAADAVLTFSYVGMKTIEIPVDGQSTINATLEEDMGVLDEIVVVGYGTARRKDLSGSVSTIDLEDSPIANAPNTNVLQSLQGVSPGINIGPQNSPGRTPNILVRGQNSINGNNDPLIVLDGIIFLGSIRDINPNDIASFDILKDASAASAYGSRSANGVIVITTKKGKIGKPVINIQSSMGVNTWQNKFDMMNLDTYERKYAAQLGVDVDEITFDNPVATAYLEQRIDTDWMDFVSRNGVIQNHQVSVSGRTDNMDYYFSGGYSSEEGVIIGDDYTRLSLRARLNTDITDWLEVGIDGTYNNNDYSGIGGNVSDAYLMYPSAFPYRYDNMPQNAAASTNRELERWPMGSSVQNPLWGTNGTIQDIDKSDFFRFAGHALVKIPPIKGLSYRFNYSIDANYNIQDRFTFEDYYIGEAGANNYIERYSDEALRDRLSQANGYNSRTNRYTYVIDNIINYNRTFDEHYVDLTLVATRDFSYQKNVFLSGNDFSDNGNTSLGVNGISKATTILSSQEVIERSNVGYLARLAYTFKDRYHLNASIRRDGASVFGARRRFGNFPSVGLAWTASNEDFLSGNSTLSYLKLKASYGQNGNQGLEPYQTLARVLNGSDGNIEYEFGDAPSTIVYGVALNSLSSPDLGWETTSTFNTGFQSRFLDDRISFDLDLYFSQTTDQIFNRNIPSMTGFNSILTSLGQVNNNGLEINIGSTNIETEDFSWTSNLVYFRNRNKIKKLYGDDLDGDGVEDDDISNSLFIGEPIGAIYGFVYDGVVQADDTEYIANTGAVPGDAKFVDLNGDGEIDATNDRKILGYRRENFRMSLANTFNYKNFSLYVMLNGVFGGNNYYLAENPRHNSFGARFDTNEINHGWWTPENESEEFLRPNYLGNRYLGLQSRGFVRIQNVSLSYNFPSELLDKIKFKSAKVFANVQNLYTFTNWFGGGDPEVGIRPGDGTYPVPTTVSVGVNLSL

SEQ ID NO: 10168 - protein, 1084 aa, Bacteroides intestinalis DSM 17393
MKHFLNELISAGNRRKNFFLLLVVLVSSAMLQAQNIAVSGIVKDVTGEPLPGVNIMEKGTTNGTITDVDGKFTLSVKGTNAVLTVSFVGYAPQEISVKGKRNLDVTLKEDTELLDEVVVVGYATQKKATVAAAVSSVNNKDLTRSTSTSAANALVGKVSGITARQKSGQPGTSTNLEIRNMGTPLYVIDGIMKDETAFNALDIHDIENVSILKDGAAAIYGVKAANGVVLITTKTGKKGQKPQINLNAHMGWQGWTKYPELLNAYQWKWGNYMKQANDGNLTGADNIANAKADLEKWRTGYYNPATGEDYRGYDWKDNFVSNAAPQYYVNANISGGTEKTDYYISVGHIDQDAVFKEYNYNRTNLQANFNMQLTDKFKVGFQTLGKIEQNVNPALPGGDDYFQMRNSIFNLIPTMRPYANDNPDYLNYITPTHDGARNMAAYTIDNAGKHQKDFRTIQLSANLEYKTPLPGLTAKGLLSYYYETLHQTDNEKSWNEYRYDPATQEYKVASTKTDTYRGDVRNHKVEMMGQFTLNYDHIFAKDHHVTAVAGFEFFKEDRKYLTVAQSPVENPFVENITTNANNTVSNSVRTITTASFIFRAGYSYKEKYIIDFAGRYDASWRFLPGNQWGFFPSVSGAWRLSEEEFYKDSKVADWISSIKLRASYGEMGDDMARNFNSSYPDFAYLPGYAFNNGGAIISNNPLGNAPDAYTTGTAYKGIPQTGLSWMKISMMNVGFDMGFLNDRLKLEVDFFKRKRSGIPATPTDIIYPYEAGYSVQKQNLNSDQVSGIDGMVRWNDRVNDFNYFVGVNLTLARQKTINNYGEVFLNGWDQYRWAQTNRWSNVKNGAVWMWETIGVFQTQEEIDNYPVNIDGANNVNLRPGDLIFKDVNGDGLIDDYDKRPLGYAATDYDWDSGNANKNPLLSMGINLGFEYKGIDFAADFAGGFMNTFIGDWHVKYGIGTDQMGYVYNVIDSWQHEDIFDTKSPWKRGKFPAVRSNNPSIRDWNDFYAKEINYLRLRNLVVGYTLPIKWTKKALIQKLRVYFEGSNLLCWDSLNDFGFDPEISSVTGFDYPQHKVYTVGVNVTF

SEQ ID NO: 10169 - protein, 941 aa, Bacteroides intestinalis DSM 17393
MKQKVLALAIKRIVWAELALTAVLVPPAFAQSQPAPGAASIADAVANGAPVTVSQANGTAGAVAATGAAASSAAAEATPAAPGANGQGKVAQIKRFEVTGSLIRQADKVGFNQVQTITSKDIQNSGQTNVADYLRSTSANSASSWSEGSTNSFAPGGAGIALRGLSEKYTLVLIDGMRVSPYAFAVNGSDQFFDLNTLPLNIIDRIEIVKTGAVSQYGSDAIAGVVNIITKKNFQGLELGGSYGGATNGEGGQGTTQFSVLGGIGDLNADRFNVTAALSYYKSNGISIADRDTTQNQDFSNFPGGLSNQNVSYWRNPTTGAKVPLSPCPNGGQAVPGTSVAQVNGPGTVCANNTAYASSLSPWTERLSAKVHADFKISDAMQAFADLWESNNTTVTNNFVGRLGNSTQTYDPATGGLNPVSNLVPGSNPYNPFGVPAKLVYSFPATQSVHTSSNFWRAATGVKGSFSTPRVGDWDWTASYTHSQNTVSNNYSNLINAAALENIVQNGVFNFANPSSTPNGLNGLYGSTSTQAITKLDAVDATLSTPNLFTLPTGNVGLGLGTQFTHQSQYIGTGADYANGTLVQPSLQSVNGERNVSAVYYQIDIPILKNLTFSQSGRYDHYSDFGGAFSPRFALRFQPIRELTVYGSYNRGFRAPTLIENTSSRTYGAQGAVDSNDPNNPNAYNLVEEVQAGNSKLQPERTKNYNIGFQLSPTRNTDFGFDWYKIHIDNVIGTEDIQTVVDQNDPSKVIRNPNGSIAYVVLPYMNLSSLDTDGFETTFRQSVSTKIGTFTLSGDWAYVWHFKMPVGGETTDFAGNNGSLNEPFGGSFPRWKGNTSLNWNYHNQWNATLTWMFTGPYSQAILSPGQYPNMQDSVASYSQFNLMVSYTGFKHWTIYAGIDNIFNRAPPFDPVFMNASYQTGYDTSLYTYVGRFAQIGATYKF

SEQ ID NO: 10170 - protein, 390 aa, Bacteroides intestinalis DSM 17393
MAGLKLQIFAQKDGAVTTTDHSSTNFSVQNARIYFMGKLNKIVEFGANFDFSDNNLLSPDGTARTHTGMHQSIVKDAYINFRFSKSFNIMTGLFMDPYSRISLTDSYYTVIPTMEGVGTINSFIMNKSLKGPMFVNPFTPLDIGSDIQNAYRDMGIAIWGSKFHSAIKYYVDIANGRYDYELSNDNITSPSLKYGFRLELSPTFLGFSNNEGYMDEDTYFGNKNILALGIAYEQDKFTNQSGSTNSKSFDTDLLIEKKFNSLVPNLQMGYSNTTDLPYGMSVSQYTVKAPIKATGYYIQTAILYDKHIGIGKPSLALRYETDENTNNYSNKAKINRLSIFGTYYINGESAKISLGADFINPNSNLIYDTENGQTTLKNYWDYTLAFQTMF

SEQ ID NO: 10171 - protein, 448 aa, Bacteroides intestinalis DSM 17393
MTDTQSPNPQKPRHLGERALALMLSGLFATVLLGGTAPAVAQALPNCAKYDQLNHRGSEVPYPSNCEAIDPELGGLREKLFSRGWNLQVVTTQGLTYDLRGNDGGPQIYTGQKPTANASVSLVFTHDLSRYGLPDGSLLTFAPVAGYTSFSGAGLSHAYINQLSAMVPLNDGQVVLQAGQYNMASQFYGQAIGNNLAASALGPQSFILYGLGVGGLKPTPAFDIRLSSADKRFYTHFGVARSISPDGLFADGEENHSGLKFSTRGAKAVFINEVGYRVQPDVNQRNIWLRAGAVYNTSDFAHLDDPATTGKNYGGYVVATYQLSQPDMSAPYRGWYFTGSVNFARKQVNAFSHDAGLVFYRIGTFKSRPYDVFSIGAAKTYFSDVVVQNATDLGLEAASSSTSFLASYTYRLQQGAYLQSAITYIDNPTLAPVRPSALNASVNLTLVF

SEQ ID NO: 10172 - protein, 99 aa, Bacteroides intestinalis DSM 17393
MLNTTLFYTLDGFDTRVSMRYRSDYVSDLMSVEPQLVFFEAETIVDYQASYALDNGLKFLFQINNLTDEPDKTHYGEEHQTGTIQYFGRQYFLGLNYSL

SEQ ID NO: 10173 - protein, 727 aa, Bacteroides intestinalis DSM 17393
MSFKHKTLALFVAHACCTSALAENAATTLEPIVVSDLSHTTLNLDQNKLEKESPKDLKAIFATTPNINVIHTGHAQLGDIEIRGMGSSREIFATGANRVTMELDGMDISPSFYFGHSSRHGRQYFDPSDLKRVEIHKGPNSQGVAGHVRFQTKDPRDYLLPNQRTGAQLRAGYLGDSDAYYVGITGATLLDEHSSALVSYTRRWFNEFNNKGGLDVTGSQRTKSNPSSGYSNAVNSKLRYSPNDRHKFTLNLQHYDLKRTAYLEDSLGTTATRRGTKTVHHNTNIQKNQRHAIAFSHDMQQTTAFFDHLHWQIALQQTKSTSRNTGAVTSTSVSPPPSTPKFSQERSLDGFKTKTISLKTEFNKSLGQHVVHELHYGLKLQYSQMQALRQTQSLNEQGSNTRTSAFFPTQQQWQSKLHLSDRISFGKSGLSLTPSIHLTQIRIKPKTENVSKKNREQLFTYKDTALGYGLRVDYALNEANLLSLNYQHATRLPGYGENNAQSYGHWPAKPNPHLQPETSDGIELSWRSAGAIGQQTTTLFYNRYNDLIYLDTTACYADRTGQVPCDLANEKGRSYSYGIEFDGKLNLDTIGFAQGTYLNAGFAYSKGKTANKQPQGRLDPLTGFVGLGYQQPMDVWGIEGKLKFAAKKKTKDLLANQGFEGLPGYAVVDLTAYYNVTKQLYLGIGIYNVLDKKYARWAMARGDIKHGNYDKHTEAGRHFGANIRYHF

SEQ ID NO: 10174 - protein, 858 aa, Bacteroides intestinalis DSM 17393
MRNKLLLLLLLMFMTSGMMYAQQQKTQQSQQRTAAPSYTLKGVLLDSLTQEGEPYATIKIAKKNAPQKALKMAVTDLNGKFQEKLTVAPGEYIITLSSVGKVTIVKDFTVKASEKVIDLGKLNMAEATNELKGIEVVAQKPLVKVDVDKIEYNIEDDPDSKTNTVMEMLRKVPLVTVDGEDNIKVNGSSSFKIHVNGKPNNMMSNNPKDVLKSMPANTIKHIEVITSPGAKYDAEGVGGILNIVTVGGGFEGYTATFRASGSNRGAGAGGYATIKSGKLTITGNYNYNYDTSPKSYSDSYRENYDSEDQKYLESKSSSDYNGSFQYGNLEASYEIDTLRLLTASFGMYGGANDNKSDGLTTMWNAQRDRLAYQYRSLSDGDGSWYSMRGNVDYQRTSKKNKDRMITLSYKISTQPQNSDYYTDYKDIKDPFEMDIVKKFLLNNSHSDGKTNTTEHTFQVDYTTPIGKLHTIEAGAKYIIRNNLSDNKLFEAEGVSDNYEYNNDRSSKYKHLNDILAAYLGYTLRYKTFSFKPGVRYEYTSQDVKYLAGAIGPEADFSTSYNDFVPSVTMGIKIGKTQNLRGGYNMRIWRPGIWNLNPYFDDRNPMFISQGNSNLESEKSHSFNLSYSMFSMKFNVNISLRHSFGNNGIERVSRLIGKGGEEFPGGHHAPEGALYSTYENIGKNRNTGLSLYGNWNASPNTRIYLNGDGSYVDIKSPAQGLHNYGWNASLYGGIQHTFPLKIRASLNAGGSTPYISLQGKGSGYYYYSLGVNRSFIKDRFTVSAYVSNIFEKYRSYNNTTMGENFLSKSSSRYQSRSFGISLSYRIGELKASVKKAARSINNDDVKGGGGQGGQGGGAN

SEQ ID NO: 10175 - protein, 493 aa, Bacteroides intestinalis DSM 17393
MKNHLEPVARKPRLPAFATLLLSLASAPALAQALPPAAAPEPAAGASGAAAPAQAADAAEPTGLWERSNLFGNIGGLRDVLGEHGVTLNLQETSEYLYNAAGGTQRGGAYQGLTQFGFTVDAQKAIGLPGGTFNVSGLQIHGTNLTSRYLQTLQTATGIEANSTTRLWELWYQQAFFDGKADVRIGQQSVDQEFMVSQYAATFINSTFGWPVLPATDLPAGGPAYPLSSLGVRLRVKPADAWTAMIGVYDGNAAGRSDGDAQTLNAHGTNFNLRSGAFVIGELQYALNAPSSDPKAPPSAGLPGTYKIGFWYQTQHANDPRVGTDGLSLANPASNGIAATHHGNYGFYAGADQMIWRPAPDSPRSVGVFARVMGAPGDRNIVDFAANAGITLKAPFRGRDDDTAGIAIGYTKIGSHARALDGDTGTYQTPGYPVRRAETVIEATYQYQVAPWWQLQADLQHFFRPGGGIPNPNAAGARIGDETVIGVRTTITF

SEQ ID NO: 10176 - protein, 403 aa, Bacteroides intestinalis DSM 17393
MKKLILMVVMAALSLAAMAQHEEDTENGVVSLAGREGFTIETKKGDFVFKPYLLVQTCANFNWYDDEGLDKAYNQDNVANSGFSIPYAVLGFTGKAFGKVAFNLSINAAASGGALLQQAWFDVQLKKQFAVRVGKFKTPFSHAYLTTLGETLLPQLPVSLTSAIILPYSLNAVTPNIGTGFDLGVEIHGLLADKFGYEVGLFNGTGSSVNTATKTLSDDWHIPSLLYAGRFTYMPKGVMPSTQGNPNRLNEDKIMFGVSASINVESENESTNDTRVGVEFAMLKNKLYLGAEAYYMNVGFTDRQKINETYNYLGGYVQGGYFVAPRLQAALRYDFFNRNGTSDDGFLNMPAVGVNYFFKGCNLKLQAMYQYIARTGHDTQLDRDNDNLGLATHSATVMLQYTF

SEQ ID NO: 10177 - protein, 1107 aa, Bacteroides intestinalis DSM 17393
MRKRHLCILICLFANALFFANAANRTITGIVISGEDNEPLIGASVYVSADELKKAGVPQTSLGTITDIDGKFSLSVPEKVTRIHCSYIGFEEQSVPLQSGKENYHIVLQASSHTLGDVVVTGYQELERRKLTASIAKVDVTDAMVGAAKSIDQALAGQIAGVSVTTTSGAPGAPARIRIRGTASLNGTQDPLWVLDGIPLEGTDIPDLDSDTDNDIVNIGQSSIAGISPYDIESITILKDAAATAIYGARAANGVIVITTKRGRTGKPIVNFNTRLSYTPNLNTSRLNLLNSEQKVNLELELMKEPDDIFTAHPFYRKGGVASVLRQYNLFETYQQQGWDGLSSEAQNAINRLKTINTDWNDLLFRSAFTQEYNFSISGGSEKTTYYNSLSYSKENGNVPGVDMSRFNLTSKTSYQVNRMLKIGASIFANRRKNQDFVSDKYGYSNPIYYSRVANPYQEIYDAENNYIYDYDIRSTSDNEPDPKRGFNILEERNNTSKETVTTAINSIFNVDLRFNDHWKVTSQVGLQWEQSKVEQYIGPNTFSMRYMREESKDGESYIIPEGGMHKVSNSTTSQITWKIQGEWNQTFKDIHEVQIMGGSEIRKNWYDALASTAYGYDPKTLTTKPLNIDPRDADDYPLHIKSYTENAFASFYANGSYTLMKRYTLGASVRMDGSDLFGVDKKYRFLPIYSISGLWRISNEAFLKPANQWMDNLALRLSYGLQGNIDKNTSPFLLGNYSNQTVIDKNETIITIGSAPNDKLRWEKTASYNAGIDLSVLKSAINLSIDYYYRRGSDLIGYKDLPLENGFSSQAINWASMENKGVEINLQTRNITTKDFSWYTTFNFAYNNNKVLKDHKKENSPTPGLEGYPVGTIFAIKSKVDPETGRILIYPKGSDEAVTVEKLFEMVDLTGGLGGFYEYDATAEFQQSLYEYAGTNDAPYTGGLINTFNYRNWELNLNFSYYFGAHVRTNPSYDIVGFDPGHNTNQDILERWTPENHSGKFPALLTKNNYPADYALFGDLPAIYKNLDLWVKRLNYVRLQNIRLAYKLPQEWLRKININGATVAVEGRNLLVFGSSYKNYMDPESMSNLYSTPVPKSVTFNLSLNF

SEQ ID NO: 10178 - protein, 380 aa, Bacteroides intestinalis DSM 17393
MNELPRYAALFALCLCASGTSYAQSAVTLYGVLDDGLNYTSNAGGHHAFAMVSGDTAETSFGLKGTEDLGGGLSAIFTLESGVNINSGQLNEGGRLFGRQAFVGLSSAPAGTLTFGRQYDATIDMWSPFTAAGNSIGDLAAHPFDNDNADFDFRLSNSVKYVSPTLAGFQLEGVYGFSNATNFASNRAYSAGVTYGTGPLSVALAYLHLNGAGTGTNGAVTSDSVFVATRQQNIVAGVKWTFSNNANVALAYSHVDVRSPTGNGYAPDIGTQTWTSWKFDNIEINGQYYFMPDLSLTGAYTFTHGKLESTAGSDSPNWHQVALMLNYSLSKRTSVYVQGAWQHTNANTGTDLDAAHIVGSAGLSSSGNQAVARLAMSHKF

SEQ ID NO: 10179 - protein, 441 aa, Bacteroides intestinalis DSM 17393
MRKFSLIGIAMLIVSIPTFAGGILTNTNQHVSFLRMLARGASIDIDGVYSNPAGLAFLPEDGLYLSLNGQSAYQTRNIKATFPLFIEDGNTRYYKGKASAPFIPSFQGAYKKGDWTISGSFAVVGGGGKASFDDGLGMFDSMVMGQVHTISGGQITPNMYSINSAMDGSQFIYGVQLGLSYQVNDWLGVFAGGRMNYFTGGYEGFLTATAHSNIPTYGGMELVGIDLDCDQTGWGLTPILGADVKLGKWNIGLKYEFMTSLNLENKTKKAEVRAMGTAMGDEGNPLADYKDGVNTPSDIPALLTAAVGYEFLPTLRATLEYHHFFDKAAGMANDKQKALKHGTHEILIGAEWDIAKQLTISGGYQRTDYGLADDFQSDISFSCDSYSLGFGAAIKMTKHLTMNIAYFWTNYDDYTKKISETTKNVYSRTNKVFGLGVDYKF

SEQ ID NO: 10180 - protein, 808 aa, Bacteroides intestinalis DSM 17393
MNMTKRHLPFAAAAIAMAVQLEANAMLEEVVVTATKRQQTLQEIPIAVSVVTAESIEQSQVLDIKDLQTLVPSLRVTQLQGSAQTNFIIRGFGNGANNPGIEPSVGVFVDGVYRSRVGSALADLPKVERIEVLRGPQSTLFGKNASAGVINVVTAKPDLVGYSGSIGATVGNYNQTIIRGDVTGPLSDNVAFSLFGSVNERDGYFDNLTTGNEFNELNRWNFRGQLLWAPSDRAEVRLIVDAEEIDEVCCGVANLVDGPTGGIVRALGGDLVGDAPFAYENYQDFDPKNEIETNGVSLQVEYDFDNFSLTSISAFRTLDQFQSGDVDFTSARLISADKADARDTEIDTFTQELRLTSTTDGPLQWMVGAFYFNEEVTNDENFGLGPDFRSYVDVLLASLGAPGALGGIEQVLGLPPGFIYADGTGNQSETYTLDDETLSLFAQFDYDLTDKLTLTAGVNYTQSEKEASAAVVNDNFFGTIPLAAFGLEALLPAQFLPPFVAYPNSVEDGRSDDSDTTYTLRLAYDLTANVSVYGGVSTGFKATSWNLSQDTGPLAADLDALLAAGDPALPALTAFGLPPGFSNYPGAISDATRLAGPEESEVYEIGLKGEWDTVAVNLAIFQQEIDGFQSNSFTGTGFVLANAGKQSTDGVEVDIKWAPTDGLRFGFAATWLDPLYDDFQGALGIDGPEDFSGRKPSGIPEFSANTNVTYNFMAGNAMSYVRLENVFEGEVQVVDNIPSSIASRKVNMINASAGVTFGNGVQLNLWGRNLTGDEYLLSAFPSVAQTGSISGYPSQPRTYGLTVKYNFD

SEQ ID NO: 10181 - protein, 797 aa, Bacteroides intestinalis DSM 17393
MKNKIAILTIGASLVAPHAMAAAEITKVERIQVIGSRIALRTATDSAVPVDIITAEQLEATGMSETAKALQFAAPSYNFPFSSITDGSDAVRPASLRGMSPDQTLVLVNGKRRHGSALVHLGGTTGKGSSNVDLNAIPMTAIKRIEILRDGAAALYGSDAIAGVINVVLKDSAQGGSISLQTGQTYEGDGEQIRVGINQGISFSEDGFVNLTFEAHQKNSTNRAGLDPRQQYPLLQDGSLDPREDSFDRLNHHVGDSDYNNYSLFLNGAQIFSDDSKLYAFGGVSSRNSTSGAFYRRAKDSRNIIETYPDGFLPQISPEIIDYSLVTGYEFDLGQWSLDASAGYGSNSFQYRVVNTLNASLGPTSPTSFDAGTLSNYETNLNLDASTYYDFLNESDILVAMGISWRDSRYQIESGQQESYIKGDYQDKAGASQGFGGFSKGSEIDINRQNTGVYLSLENQISDDFYWAMALRYEHYSDFGGNTSWKISGRYDITDQLAIRASTDTGFRAPSVQQLYFTNVSTFFDPDPITGEFVPRESGTFNSLSPITKGLGVEALMPEISHSYSLGLVFTSSYGLTASLDMYQIDLDDRIILSGSVDSDSSEEIAAILADTNADSARFFLNAIDSRTRGVDLVLSQQLDLGSLGDLETNLSFSYNQTEVQDIHLPSILSGQQEDLFDHQEEVNMTEGTPHNKGNIGFTHRYDDFTTNLRFSYFGSYTIGYSSTDVTYGDKWTTDISMRYQATAGLALSAGVQNLFDVYPDKRPEDNNFNGIFVYPLTNSPFGFNGGYYYVEAKYTY

SEQ ID NO: 10182 - protein, 1129 aa, Bacteroides intestinalis DSM 17393
MDKKHNYTNHGKSSKRLWITFLFFCIITTGFMQAANKVFAQATVTASFKNATLSEILWEIQRQTDFTFVYSTNDVKQIKVQNLNVNNEKIANVLDKCLMNSGLTYSVHNGVIAIKQIEEKESAVPQQKTTLTGTVLDETGEPIIGANILVKGTTNGTTTDLDGYFSLDVDRIPATLIISYIGYAKQEIKATAGKILKVVMAPDNNIMEEVVVTGYGTFKKSAYAGSASTVKTGELKDLPVVSFSSLLEGNAPGVQVTSSSGQPGASTSIRIRGMGSFNASNSPLYVIDGVPVQSGSVAATSSDSGFDIMSTLNNSDIENITVIKDAAAASLYGSRAANGVILISTKKGKSGKAQISLKADWGSNDFAMDYRPVMGGEERREYIYNGLILYQQRKLADKNPNISEEELMSQSKTYADGQIDKYAPIPWCGFTDWNKELFQKGHHSTYEASLAGGSDKFKYYSSLSYMKQNGIVQGSGLERVTGRLNADFSATDKLTVGAKILFSNVNQSVYDEGFTYTSPFYSSRNWATPSDPVYNEDGSWNRKFIRKANDRNPKLSAEYDYKHEKMLRAFNTLYAEYEIIKNLKFKTTFSYDYTTVKGEKWYDPRTSNGEDENGEVVKRIREYKKMVWSNTLSYLTTFNNIHHLDFLAGYEIDDTYNDYLSGEAYNFTTPDKHAISNGMKTVSVGGSDSRYRLVSYLSRLNYDYKNKYYLGASFRVDGSSRLHRDNRWGTFWSVSGAWRTIEEEFMQPVKDWLTDLRIRASYGVNGTLPSDYFGYMGLSSISGGYLEQPGIQMSQIANPNLKWETNYNMNIGLDFGFWDRLNFTIEYYTRTTKNLLMDCPVSMTTGFSSYLMNIGEVKNKGIELTINSTNIKIKDFSWNTTFNLGHNSNKVVKLDGEQTQIVSGTQIHKVGSSYRTFYVQEFAGINPETGNPLFYTNELDENGNYIKEITENSKNAQFIPYKHAEPTVNGGISNSLRYKWLDLNFLFSYQFGGYSYDTWAQKTEHGGYDSYANIPTYYRDSWKKPGDQTNIEVYMPGKSSSVSMHKITSSRRIHSTDYFRLKNITFGITLPKEWTNKINIGNVRFYASASNLWTWAAYDNYDPEAVSAGSATQTTPPLKTVTFGFNINF

SEQ ID NO: 10183 - protein, 929 aa, Bacteroides intestinalis DSM 17393
MKRIRLSLVKVAFVLLLVLGVSAESVFAQTGKVSGRVIDKESAEELIGASVSIVGTTKGALTDLDGSYTIAVAPGKYDLRVSYIGYQVKLVKGVDVKAGEVAKQDILMEIEDVQADEIVVEAELSTATEGALLTERKKSLAVSDGISAEFIKKTPDSDAGDAIKRTTGVSVMGGKYVFVRGLGERYSNTQLNGVNIPSPEPEKRVVPMDIIPASLIENIITIKTFLPDQPGTFAGGLVRIKTKEFPDEFQLNFSASGGFNSNAHFNDIWGYDGGSLDFLGIDDGTRELPNYGDISNYSKTQLGNFLSSFDNNTYLPKESRYFPNQSYSVSVADQINVGELPVGFITNLTYSSSAEYKDQYSFFPSPNEGEFDYEWNSQVATYNVNWGGVLNFSTKLNNDNKLGLKTTYNRTAEDEALYSTGIKYYESPTTTLRNTRLRYVERQMWSTQLSGNHYLSWLAKSELEWKAQYASAKRYEPDNKETQFSYDEDTQEYTFYPDNQRNGRYFSDLDDNEYDFLADISVPFKQWDGFKSKFKFGGLYTSKDREFWARRFKFTQIIDMGDGISPEDLFTAYNVAEGYVGLIETTQPTDSYSADEKVAAGYGMVELPLTRDLRFVGGVRVEKNEMTVKSYKDKDKTIPINGGFDETNVLPSLNLIYELNDQMNVRSAFSQTIANPELRELAPFKFDSYRTSMVGNPYLEQTTIQNYDLRWEWFPGFGELIAVSLFYKNIDKPLEVVALAGFGTSPEETVNNGKTATNYGVEFEFRKSLNFITPTLENFSVSTNITFVHSEITQGDSLYRYSTSSGLESFPVATSLRGTRKMQGQSPYVINVNLSYNNTDYGFSGMLLYNIVGERIYRLNGNPNLNYNFIEKPRNQLDLSLSKTLNTNFKVKLNIKNILNDRYLIMFGDDVAERYKTGTTYSFSLSYAL

SEQ ID NO: 10184 - protein, 394 aa, Bacteroides intestinalis DSM 17393
MAKKLFLTLLSLFSFACASGYKIPEQSLDSTALSGAHVAGSYGADASYYNPANMAFASLEAEMESALTYIHLTSVHFEQGAYKEDSKRENFLVPKFFYRSPAMGDWRMGLSFTTPAGLSKRWEEGVRGQSNANEFTLEVFELNPSLSYKISDSLALGLGIRGVYSKGIVKNDMVTLGSYQELKGDSLDFGWNAALAFKPVESTNLSIAYRSKVNLSIEGDAGIRTPFGNINPEARVTIPLPATLSLALAKQWDDFLVEFVWDRVYWSAYKELDFDYDHDMTSNPILRALDASKAKNWKDTNTYRLGLSYQMNEAWKLMAGFGIDKNPIPDDRLGFELPDSDAKIYSLGARYKINSRHEVGAAFLVSDKEDRTTSIGTFSHTQAHLLTFGYTYRY

SEQ ID NO: 10185 - protein, 1056 aa, Bacteroides intestinalis DSM 17393
MKKEPVFATLVLLSVMTSPTIMATPWHSNTKVGPESIVTKTSSKQNYVNAKTVKGTVVDENGIPIIGANIVVAGTTHGTVTDIDGNFTLEGVNNGDKLTISYIGYIEQSLVVNQNSEYKIVLKEDSQSLDEVVVVGYGTQKKVNLTGAVAAIGADEIIQAPVANISNALAGRLPGIRVQNTGGTPGAESSVDIRGFGKPLILVDGVEQPGFQVDPNEIESISVLKDASAAIYGVKAGNGVVLITTKKGAEGKAQITYNGSIGWQNFTSYPDMVDAAGYAELTDEDAINRGNAPVYGPDKLALFREGTQEGYKSYDWKDILTRKNAPQTQHNINVNGGTEKVKYFMSVGYLNQEGLYATKDINFSRYNFRSNISAKISKYLTADAQLSGHVQDKMAPYDDDTYIIHGITRMHPYYSPYANDEEGKHYGLTNFQNPLARSDADVSGYRKERKKLFNGVFSLKYDMPFIPGLSAKVLFSYLTKVEEFKTFAKEFKLYSYDKESGKYNTVFTGNSPSNLTRKDYTQEQNMLQFSLNYNRTFLDKHNVQALFLYEQREDLDDYLQAYRQFAIDALDQINSGSDKNKNNAGVASELANASFVGRINYDYASKYLFEFSFREDGSAKFYKNNRWGFFPSVSVGWRLSEESFIKNNTQIFDNLKIRASYGVMGDDQFLDSSGNPQVLPFQYLTGYNYPGGTNYIFGSDVVNSLITKGLANTEYSWLTSKILNVGFDASLWNRKLEASVDVFYRKRDGLFAYRSGSLPNTFGASFPQENLNSDDFRGFELVLGHTNTVGDWTYSVKGNMSFTRAKNRHIEQADPINSYKNWTSNFSDRWNNMSFGYKCVGQFQDQEDINNWAIQDDAGNTTMMPGDLKYEDFNGDGVIDNNDIQPITRSNTPEIYFGLDLSASWKGFDFSLLMQGATNYNVYMSGCLGNAMFNGSNTLECFMDRWHREDLYDPESAWIPGKYPSTWNSGKPSNTRVSTFNHISSYYLRVKNIEFGYTFPKEWLSKVYVERLRLYVSGNNVLTFDNLPFGDPEAPSSDRILYPQLKIWNIGVNVTF

SEQ ID NO: 10186 - protein, 372 aa, Bacteroides intestinalis DSM 17393
MSYLKKSLLATAVTGLMFSGAAFAEGANSDAAKNYLTKDSFAYEVYGVIAMQAAYRDYDSGDAKTDDNLGGMQFNNESRIGFRGKKNFANFGPTFIWQIEGGYVDPSFGGEGAGLGERDTFVGFESESMGQVRVGRVLTPLYEVVDWPGSNPGLGDVYDWGGAIGGAKYQDRQSNTIRWDSPMYGEAFSLDVAAGAGDKAGLGEGDDFWAGLAAHYKIGPIQLDAAYEGNRNIVAEGQTWDNDTYLVGVQGWFENGISFFAQYKMMEASANNGVDEKQNAMTAGLMYTTGDWQYKLGYAANFELERNGKTINNTDDNVISAQVMYFVDPSAVLYARARTLDFGDGAEALDGSGARWKSADYTEFSVGVEYYF

SEQ ID NO: 10187 - protein, 708 aa, Bacteroides intestinalis DSM 17393
MAATALNIPHGFKCSEISTALTLALGLSFAPLAMANDNEQTQIERILVHGEQSICRNALGSADALLKDQGVDFSEAGGVSALPVLNGMMGDRIKVLVDGADITASCANQMNPPLSYVSANQINSVEVVAGVSPVSAGGDNIAGVIKVNSLNPKFTDSENLSFESGEISSGYRSTSDSLLLGAKAGIASKNVSLSYQGAYEDANSYHDGNGDKVLDTLYRAQNHALTAAWRDEKQQLAVKLTHQAIPFQGFPNQYMDMTDNKSYGALVRYLRDLENDGEFSAQLNWHSVKHEMGFFTPEKTGKMPMNTEGSDYSYQLHWRLTMGDDSTLLLGQEYYSYQLDDIWPAVPGTMMAPNDYININDGERRRAAVYGEWQQNLNPLWWLSAGVRYEYVTTDTGEVQAYSNMPMMGMPNVDAEAAKAFNAMDRSRDDNLIDATLLARYQLSAKQQLEFGLARKNRAPNLYERYSWGRGVMATTMIGWYGDGNGYVGNPDLKPETAHTLSAAYKFNGDAWQFSTTAWYSAVTDYIDAEVIGSFNRTSTPAGKRNILKFTNEDANLYGAKFSALYLLADTDSGKWQMLGKLNITRGERDEGNEPLYQIKPLQTELALSHQLGDWENRLAWQWVATKDRVDDRRLENETSSYSLLNLSSSIKWQELSLTFAINNLFDTYYELPLGGVSIAEFKADSSNGFSQVAGSGRSFELGASYRF

SEQ ID NO: 10188 - protein, 1202 aa, Bacteroides intestinalis DSM 17393
MKKQNLYKYLFLISLFYPLNSAKADDSNCYSNQYVGTVGAFGTVCANMLIVDRDLLDEGIANGAVGSDFQITKNGITYNFGDTGNKIFTGQIKNFSSLFKDQTNFNADIGYWNTSRATTMSRMFMNASSFNQDISNWELNNVTNINGMFQDSLVFNQDISSWNISKVTRLNSTFRGAAAFNQNLNSWDVSNVTRLDRTFLKAINFNSDLNSWDVSKVVSMHRTFAGAKTFNGNISSWNTESLRSLRRTFDGARAFNKDISNWDVAEVTNFTRTFKNAKDFDQNLTSWNVEHYAQTPILFAPILSSNKQPCWGFNGCPSGPNLTSTNPSDNSFGVNTSLNLTLTFDKDIKASETSGNITLHKSDDTLVKQYSNDSLNISGKVITLPAELIANTDYYLLIEPKIIESSNGISYKGITDKTELNFSTYSNDSVAPVITSQSPEDNATDVSTSDPTVEIIFSENVVRGSGNISLYNYSTDALIRSFNMSNTTDISVSGNEMSISLRDSDGSVLINDGTQYYILISTGAVVDEAASPNSFAGIDSKNTYNFTTKSASCGSISGVVRYKNGDPVNGSTVKLYKDDSLITTTTTNSVGNYNFFPNSAGTFKVEFIKLAGKRGKGKVDLTDGPVSSGRFIKNIQISSSCEEISDIDGLLIDPAGVIYESSTRQPVSGVTVKLLYEGSLVNNDWLDDSGGNNVHETGSDGKYNFVLKGDVAQSGNYSITVDPPKGYGFESTKIISENGIFTPDLGGGAQTIQIQEDAPDSGELTTYHLNFNFTFTGVSSTTSNGVINNHIPIDSKGDPTLKPDVLGLAEAWTDASIRFSKAGLDAVNRRLEWLARNKRSDKKSFQGINFSFSNPTLEKVFNGSGKKFKDIESKDFENWARANWNDERLKNESDQIIDDLRNSSVEIAFAELREKTFDPDLNPKGGKLFGNWFLWTDGEIVVGDYKKNSTSSNQKSDALNLTFGADKKLKNNSLLGFAFTYGNDHIKIGSQGSKLNSDNYSVSIYSSQKFKSFLPTDFQLGIGKMDFYTTRFEDSIAHKGQRDANLIFGSLSFRPDPIYKGNITFNPYARIEASHISLKPFSESGSHLALTFKEQTVNHRILALGSDLFSEFEIKEWKIKPFAKIEYNFDFTDDSIVDLHYVDDSTTNYRFSILNSSDNFLSNTIGLQMSRKNRFGAVLSYKNEQGDSKNSDSYQFQINWNF

SEQ ID NO: 10189 - protein, 917 aa, Bacteroides intestinalis DSM 17393
MVIKISNNRLYSCVFTAAIFSFLLNINIEAHSRSFVSLSCDEKKLPYECSDGTKHTISDKIYKFTTPVKPKNEKGSSLTLLAAIGVQKPNTVIQAMRIEVEGIAGIEDLYGAVVSQGGKIVLSDSAFKNVSIGLKADRGMIEVNRGTIEASQVAAYAEKVGASVTLTNTKVKVEGQGLGQESALFVSADADIQMKGGFIDVNDAAALYVGRGGRATLDNVTITSKHQKTEDRENTNEKIAHTVFNVKQQGSIYLKNTNIISTDVHVLTVGQDFNTQSGDGWKGNILISRVNIEDSTIKAIGNKHGMHFEMGGENNAFEQGLVFLKRTVFEVPAGTAIHSHNSRSYIGVTEGTKISGDLLLTAEKGGTVAILADSSSLIGGTRVDDNSIAELYLTKGSKWFLTGRRKTDSHAANRTSSFISFVKLSDSFIAFASPMFHEYQTLYIGKGEKEVYNAQDKADIYLNTHLKSDGLLDNKKTDRLLIHGNVSGKTTVYVQFVVGKQEEIATDENAHSISLIQVSGKAAEDSFQLNRAYIALEGLPYQYYLNGYGPASSLGPAKTSQRLVEGEGDFWDFRLESKYIQPALGMSVIPHSELKIREVVPQVPTYLLLQNALFHVGIMDINNQQKKLQTTRSISRKLLKVEGNFALSVYGYGGSSRYVSDLSALEYGYDGHVDYNAIETDILLKTIERAYSTISFGMMGSYGKLSLQPRNVKQSQKSPFNKWLFTAYGSVEHNTGFYVDGLLSYGFLKGDVLTYAWGKTATLKANPLNVSLSAGKAFMTGHEGLIFDPQIQLIYQHLQFDKFRDIDGFDVEMKKGDQWLMRIGGYLSKIFTASEKDHIIFFKGNIHFAHRFGEKQFVHLKDVFQLGAFGSSLETGLGINAQFSSKVTLYSDLSYQHKLTKAGFSGVRFSGGLRYHF

SEQ ID NO: 10190 - protein, 959 aa, Bacteroides intestinalis DSM 17393
MKRLIGPRRSCLAVQLSLCLIPTLAWAQQPEAAPNTRTLDSVQVTGTRIKTAELQGQVPIQTLNRADIERTGLTSIGEVLQELTASGSALNAKFNSSGNFGFPPDGSGVGAGSAQVDLRHLGSKRVLVLVDGIRWVNESSASGVGSSTDLNTIPLAIVERIEVLEDGASSLYGSDAIAGVVNIITRRTFDGAQVTLNYGQYGKGDGANQGMDLAWGKSGEDFSLFLGASYVKQDPIYARDRAQARFPIPGTGLTFASSATPDGRFQFVDPNTGVRQNLTPNAGVGTPQYDGSGGCTRSDDYHCFGTADRYNFAEQNLLLTPSERKGVFAQFRYYFNDDVQWYVKALGNRRESTNQAAPEPIFLGPDAGTGNPLADNIVISALNPFNPFGFDLDSATNLIQIGRRPVEGGPRRYEQQVDTQYFGTGLVGTFEGAGRTWFWDVNGMYSKNKAEQTNYGSYNLYNINLALGDPAACAAVAGCVPLDIFSGAGSITPEMLRWIQPVVRDRSQNELSLFTANLSSELFQLPGGAVSFASGYEYRKYEGSYQPDPLTVAGRYNGVPSLPTAGSYDVNEAYLELNIPIFANSALGDKLDLNIAGRYSDYSTFGGEFTPKYGLRWQVTDEFVLRTSYAEGFRAPTIGELFGSAARADLQLSDPCSIGLGGTAPRGSAASCAALGVPAGYQQANQQISVTTGGNAQLDPERSRSFSAGFVFSPGFASDASWSDRLDLEVTFYRHHVDGAIQAINAQTQLDLCVDTLDALYCDGIGRASTGGINAFNNRLTNLGSIKTDGWDVDLFWTLPQTAFGRFKLSWQNTLVGRYEALGAAGQRQPQGPGIEVVDSAIPEWTSNAVLDWSLGNWTASWTARHISKLTEQCGDAVEFAVCSDPSVGTNRLDAITYHDAQVGYRIDWLKGLQLTAGLNNVFDKDPPICLSCSLNGYDASTYDIPGGRFWYARVDLKF

SEQ ID NO: 10191 - protein, 1004 aa, Bacteroides intestinalis DSM 17393
MFVALGLNATSLEAANLKVMPSPIRTISNFKSQEITVTGVVKDEKNLPLPGVSVKIKGQPTGVSTDASGKFSIKVSSSTSIITFTFVGYKAKEVVVGEQKTMDIKLDPESTTLENVEVVAVGYGNLSQKEVTSAVAHVGTEDFRQSGARNPLDLIQGKVAGLQLSRPGGSNPNSSVQVQLRGAVTTQGSGAPLYVIDGIPGGNPDLLQQDDIASVDILKDGSGAAIYGTSANAGVILITTKRGKTGPPTIDYSSYVRKEYLQNRPDFLTAAEFREKINSGALDQEDFGSNTDFFDGLINHDNLSHNHNLALSGGTEQTTYRASLNYRNLAGLSRENGREEYSMRFNVNQKAFDNRVNIQLNLATNVNKANLLGGGGWESESAKNPTLSNYNPDGSFRYDLTSTNEFARLELETNKRKQQTSSADAKVDVEILPGLKGSVFGSITRDAYTDGQYRFLKSEDSMENTDFPGGGYAYKGDFLSQKYAVEPTLSYSKKFLDKHDFTAILGYSYRYEMEESSNASNRGFLNDQFHEDNLGAGAALGTGRASMASSKFDNAFVAFFGRINYSYNNKYLAQVILRREAAARFGDNNRWGNFPAVSLGWNISEEDFMKDIKFVSYLKLRAGYGETGNSPANAMRNVSRLVLGTGGKYLFPDGNYYQTYGPLRNPNADLRWERKKEFNFGIDYRLFDSRLSGSIDVFSRKTSDLLDSYDTPLPAYVRESIFTNVGTIKSTGIELGLGYQAIREGDFKWNFDVTASTTKNTLDSYSNSLFKRLYIQTGNINGAGDLGQAFTTYEGSKIGTFYGKRFAGFTPEGKWLFYNRNGEAVTNDQINNSRNDRSVSDLAPIGNAVPKFYMSMTQNFNYKNWDLRIFMRGKFGFDALNTTALTYGNKTWSGNLIKDTFTKYAEINDTYMYSDYYLENASFLKIDEVTLGYNFNFKSKGIRNLRIYATGQNLLTFTGYSGNDPDFILDTGIGNEVDGRSLGLDTRGPYPSSRSILLGVNVGF

SEQ ID NO: 10192 - protein, 694 aa, Bacteroides intestinalis DSM 17393
MIARIVDCFGFKVGMLAGVFIAMNLPSGMAVAEGEGLTEDDVFGDIPFVTGTSHFEQRILDAPTSVSIIDRKMIDASGAVEIVEVFRMVPGFQVYFPHTGRAAINYHGFPQEYSYRMEVKIDGHSVYEPAENAVLWSTLPIELDDVDYIEVIRGANAPADGANATVASVNIVTKTPVASKGWSVRVAAGGLDTQKVSAAYSGLEDNFSYKINGGYRYTSGFDDRYGTEFDDDAESSYVNFRAIFTPNLYDSIDIQFGYSDNNIDMADSGRSISVEDIIKWDYISYYLSSSWERQLQNDNAVKLIFYHNHADIDAPEVLGLFSDIVGIDPEDVPLALPGLEDFNIVFGLYDSYAERTDLEVRYVGKFGANTRYMMGAATRYDRMKSERQFVRAVDVEESSQRLFTNMETKPSEKWTVNAGAIFEYNDIVNGYSSYRLSANYHISPGHTLRSTYNNGERSPGLYEANQQSGVEEGGYLLDIDTFAPGDLSTEKFESQELAYYGLLLDDALTVEIKLFKEKSRELVKYTLGNTIEYFGYSDNFDDKFTLRTNSAWVDVEGIETQIKYQPDSHWLINFQYSYTENEGLWLRSRRNPEEQTWEKIAPKEMGSLTVGYFFDSGFEASALWYYQGEVDWEQGDFADDFHRFDLRIAKRMRTSGHDVVLELIGQNVFDEGYTDFHRLNQHERRYMVRAMLEF

SEQ ID NO: 10193 - protein, 211 aa, Bacteroides intestinalis DSM 17393
MRHFSKDLLKKITPLFLSVSFLSPPIIKAKSRFYVASQYQVGKMIMQKYNDLKRTIEGASFSLGWEINPTNYWFYSRYYFFMDYGNVMLNKRTGAQANMFTYGLGGDLIVEYNKNPMYVFSLFYGMQIAENTWTISKHSANFIIDDWRSIQGFSLKTSNFRMLGLVGFKFQTVLFNHDASIEVGVKWPFAFEYNSPFVRMFAIFISHTFYL

SEQ ID NO: 10194 - protein, 823 aa, Bacteroides intestinalis DSM 17393
MKKLLRTSGSIIAVLAGMSAAAAFAQDNAKEAPGPGASQGEIVVTGTRRNDLKAADSAQPIDIITGAELLEKGTADMNDLLRTEVPSLNVQRLVSNDGAVFTRPFSLRGLPPDQTLVLVNGKRRHRGATVQFTNVPYIRGSQGPDLSAIPSIAIGQLEVLRDGASALYGSDAIAGVLNFGLRRDREGGLLIARYGQFYKGDGEDFLVQGNVGLPFTDAGFVNISGEYVNASTTSRGIQRPDAQALIDAGVQDVPVPAQRWGNPESEAARIFVNAGIELSEEMEFYTFGNYSWSRGTTAFFYRNPDASFISTSIPLTNTPGGQRFSFRQLFPGGFTPDFGATVTDAALAAGLKGEFSSGLTYDLSASYGQNHASYRIENTVNPSLGLASPTSFKPGQLEQRELAFNLDLTYPIAIGTSDPLTLAGGLEYRRETYEITAGDIASWQVGPFASVIDPDTGNRVGLPVGSNGFPGFSPIQAGEFARSNWAAYTSLEGNLTDALQFGLAGRYENYSDFGSKFTWKINGRYDFSDVFAVRGSVNTGFRAPTPGQSNASQVQTNIDSITGAPLTAGIIAPNNPVAQFFGATPLRPENSFNVAGGIVVKPSNRITFTLDYFNIKVEDRIAVSGNFNLTPAQRAQLAALGIPGGDSFQQVSFFTNSFDSRTQGVDAVLTVGFDLGDGKATLGLNGNYTKTDVIKASPVITADRERLLELEGFVPKWKGNASFTYAGERFGFVARANYYGKWTDYGAAPAADQTGGAELLVDLELSYKVSDMLKLAVGGENIFDNYPDVEARQSQINNGIRYLRFAPTGFNGGFWYVRATASF

SEQ ID NO: 10195 - protein, 728 aa, Bacteroides intestinalis DSM 17393
MKCSKVLLSSMLIYSFLYGAENITINSDTPASEYEKYLEDDPAAQGYFNFNPGKTSKSYSNNTLVWNGTPADIGEDLGVWIYGGLNNDFIPDNRNSSNNKVFINGGDRIQAVYGGSAETGGESVSNYIVINGQVHIVQNVYGGYSNSSTKQVASNSVIIKNGTINMNVMGGYSMRGVATLNSVIIEGGLISGDVRGAYSEGSGKAIGNIVTIKGGIIKGQIYGGKAEQATDNTVNLDANSLELNTIYGGNGAYGGRFVKGNTLNVRGKDIKAGNIVNFEYINFYLPSDIKANDIVLDLSGKASYSYISTDLKRSLIAVTMGAQSNNLNVNDKITLIRNPKGILYPTDFKNHKENLQAIAGISTIYEFALRKDGDASAAEGNNLYAVVASKISPISPDNGSKEKKLIETIQKSTIEPTAGVMAVVNQSSETVSNMDTSTVAGGNESNGGVITGTSASSTRQNSGSHVDVKSISFAVGLAKDFKDLITGAFIEFGGGKYDTFNEYSGTFNSRRIDDIRGNGKMRYYGAGLLAKFDLASDFYTEATVKVGKIKTDYESNLPTGARISYDVTRSYYGGHLGFGKILEINDISNANIYSKLFFTRVGKKRVDINGENILLGNSDSLRAKVGFKLSQDINDDLLWFAGLAYDREFKGKANGYNLTYGTDIASPSMKGNTGVAELGLKFKANRGFETDLKFEGMLGKREGVMAAVQLMYKFLIYIHSSTWTMSFA

SEQ ID NO: 10196 - protein, 512 aa, Bacteroides intestinalis DSM 17393
MDNMHNTNGLMRFAKVAAASTLLATLLAACAVGPDYQRPDAVVPAAFKEAPTLAAGEQAGTWKTAEPSDGRTPRRMVKVFGDPVLDSLETQALAANQNLKAAAARVEEARAATRSARSQWFPQVGAGFGPTREGLSSASQFQPQGTGPTNATLWRAQGTVSYEADLFGRVGRNVEASRADQAQSEALFRSVQLALQADVAQNYFELRQLDSDQDLYHRTVELREQALKLVQRRFNEGDISELDVSRAKNELASAQADAVDVARRRAASEHALAILLGKAPADFAFKETPIVPVAVKIPPGLPSALLERRPDVSAAERAMAAANARIGLAKSAYFRSSISPGRSAISVDARQPVPVVEPYFLLGPFAGTALTLPLFDGGRRAAGVQQARAQYDEQGANYRQQVLVAFREVEDNLADLRLLDDQIRAQEAAVNASRRAATLSRSEYQEGEVAYLDVIDSERSVLQSQLQANQLTGAQAVSTVNLIRALGGGWGNAPAPTAVGDAASGKADVAAR

SEQ ID NO: 10197 - protein, 1156 aa, Bacteroides intestinalis DSM 17393
MKKHLFVQSKRDNCSFNPLLKNLSLRMKTSALFLLCALSLSNASNIQAQKAKVSVAPGAYTVQSILDMIEGQTDYDFFYSNNHINLDRVVHLTDNAKDVNTILTKVFRGTDVTFSVLDKRIILTNVSTTTAKQTSYTVKGKVVGMDGEPIIGATVMEVGTDNGTITDIDGAFQLTIQSSENRIRISYVGYKEMTLKANILSEMIVTMSEDSELIEEVVVVGYGKQSRAKVTSAISKLEGSKLLQDMNVCSFDQALASKMPGVNIQQATGAPGAGIHIKIRGSNSINYSSQPLIVVDGVPLSSSSSSADMQGESTGFQYGSNPLSMINPADIESIDVLKDAASAAIYGSRGSNGVVIITTKQGKVGKTKVNFSMYSGISQITKKVDVMDAYELANFTKDSRDMAYQLAGGNPDDPMEMRTNPNHKYPSYMVPYIEGKQGLVNTDWQDAIYRTAFQQNYDLNVSGGNERMNFYVSGNFTDQDGIIINTGMKRYSLRTNLNANITDKLKMGLRMSAVQSDNKLVRSEDAWSREGLVITTLMYHPNLPIYNQDGTLATDLMLLENRGGVNVAQIQNPVALATMVKNQLTTRTFNGNLDLEYSLLDNLKLKTSFGVESIGMHREYYRPKGLSARYELAPTTTYNVGEDTRSSIFNWISETNLTYNQNFGDHSLDFMLNFSAQKEKSEYTYLHGMNFPNDNVTTINAAATTKGRSYGQEAAMVSFLGRVMYSYGNRYLFTASLRRDGSSRFAKNTRWGWFPSLSAGWNISKEAFYPENALVNNLKLRASYGITGNANIPYYGGTSVLASNNYILGNGIFQGFAPGNSPNQDLSWESTSTANFGVDFSLFDSKLSIAIDAYQSETRDLLLNVTVPATSGFTSALQNIGKIRNRGLEIMLSTNQSFACGLNWEGSFAFSTNKNKVLALGPGQEQILFRSGLNDDSYIVQVGESLGSFYGYKVNGIFTSQEQFDTTPHLEGQKQGVGDFIYADINGDNKVDANDRTIIGNANPDFTWGLNNTFRWKDIDFGFGLEGKHGGKIFNATHRYLAEAWGNNLKIYGTDKAPRSVWAYGTKSHTRPSTWHVEDASFIRIRSISLGYTFRNLFGINMIRLYASATNPFTFTDYSGYNPEVSNKGGSAITAGEDFGNYPVSKSFTFGLNVSF

SEQ ID NO: 10198 - protein, 199 aa, Bacteroides intestinalis DSM 17393
MRKLCAVILSAVVWQVAAATPASAAEHQSTLSARYLHASTNVPGSDDLNGINVKYRYEFMDALGLITSFSYANAEDEQKTRYSDTRWHEDSVRNRWFSVMAGPSVRVNEWFSAYAMAGVAYSRVSTFYGDYLRVTDNKGKTHDVLTGSDDGRHSNTSLAWGAGVQFNPTESVTIDLAYEGSGSGDWRSDAFIVGIGYRF

SEQ ID NO: 10199 - protein, 982 aa, Bacteroides intestinalis DSM 17393
MKNSKKIYGLFAFLLVCGNVNAGSVGVPETYPGIKYDYNNVNVSLPTFNFTENLTNGGNYIRVGGNSKLSISSNLNINLKSNIVNSFSPTVYGNAVGFGAYGTNSAAPTINAKNVKIKIEVGASDDYNAPRGMIVNDGANYFGEDVDINLITNSKPKGNDIIGLNYGADDENITRAYKSEMNVNNVNIKIQNNQVLTTGYGDNLLVGLWQTGDKNQNTHFTSRGNLNIDINDKSNKAQYHAAAGIILAGDNGAKMTLNNTNIKIKSITDNDYIGGAIVLGYPDYNNSSTGVGTVLESKGKMILDTTEASNVATLNLHGQGSLFKADFENSSTEIKSGGIAIRFAGISQALNADGENTKPGKDLTISLKNAKITSTATTYDNPLIQVEDGVKNATFNLTGSQSEAKAGANNDLLLVKGKSSVTLNISDGAKISGIINRASLGEITTNITNNAVWASPANKGSSYASTLTLKDGGTFDLSDNPNPTGVNYHEIKVFNGTETDGKIINDNGIITTANTSYNDVVEIYGNYEGKNGAKIKMNTLWNSPGNANGANSKSDVIKILRSGITNSGNATGVTGIIPVGIDGKENIIDGNIKKVAKAVNSIPVIIVDKAAAGTFVGKAQTTGAGEVQLTSRLNGGKREFFWTLNAIDGSNPYDDGTSKNYDPHSSGKTVTILNSAVAGYINTAKVNMNLGFQSLATLNERRGENNFNSTDEKSQAWARILGKHTKDEGKERFNFETNVYGVQAGYDFNIKNSENGKRYTGFYFTNTEAKTNFEDRYRAENGVVVSDKYTGKTKTKDFSLGLSTTKYYNNGLYLDLAGQFSFIKNKYNSRDGVSANQKGNAFGLSVETGKSYKLGTNWVIQPQVQLVYQYLKLKDFKDDVREIHYGNDSILRGRIGLRATYNSIFYSIANVWHDFSNSTEATIGSDNIKEKYSSTSGEIGLGVQIPIINSAYVYTDLRYERSFKSNPKHNGYRGTVGFKYIF

SEQ ID NO: 10200 - protein, 990 aa, Bacteroides intestinalis DSM 17393
MKTRLFTKTKLATSLSLVLGVSSVLPVHAADKASEDKIEVFQVTGIRGSLVKSMDIKRSSNGIVDAITSEDIGKFPDGNLAESLQRISGVSIDRSNGEGAKITVRGMGPEFNMVTLNGRQMPTVGGRAFDFSNIATDAVSTVEVYKTAKAELPTGGIGATVNMITARPFQNPGLQAVVSGKAVHETSVEDRGSELTPELSGLFSNTFADDSFGFLISGSFQDRDNREETAGVDNWIPNVGTGTGIITNNNQRADGANWYPQNSGYTIKDNSRQRTNGQIVFQYTPTDTLTSTLDYTYSKVETRGDFDSFGVWFNNGGSIVNGTINERGTYTQVAESGGDFATNVGRGESEKENKSLGLNIEWQATENFEFTFDAHTSSALDRGVGLGNDAFLIIGNTFCNWCGSTPGAGPSTAAIDVKSATFPASGIPIYDMTFVDGNGNPQAGLTAADIGSLFGGATQDSSENDMDQFQLKGKWLNSGNGSLVSIDFGVARTEQSFKNTKAYSGLLPAGWWNWSAQYWPDELWSQGSTNGLLNAFGNSGNITQGSYYRADFDTILHGYETITDTFASCCFNESWPDEFKNADGTGKFWAGSNDSDARVNEVVTSAFTQLTFEDEFNGMPINLVTGLRYEEAKISSQGLETPATNVIWSGGNEFVYEFGEAAFSDGEATTKQFLPSLDISLTVTDDLITRFSFARSLTRPNIGDLRSTTDFAGSPKVGQRKIVSGNPGLSPYIADNFDLSAEYYYAEGSYVSVGYFKKIVDNFLVKSSSKVEIDGIRDVYAGPRAEEARAQLVAEGLQATDPNVFARINENMGITDLTTPIRPNDDDPLAVFDRTGVTNGETANLFGWEIAAQHLFGDSGFGAMVNATFVNGDVEADPDAIEQEFALPGMSDSANVSMFYQNEQWSARVSYNWRDQFFSGLDQHGSPVYTEAYSQVDANVSYAITENFTVFAEALNLTEETQRSFVRYEEQLLRANQYGARYNLGMRYKF

SEQ ID NO: 10201 - protein, 187 aa, Bacteroides intestinalis DSM 17393
MKKHILAAAVMLSGSLSVFAEGFYTAAEFTRNKIEADVGDYSVSRSENGYGLGVGYNLTSRIALELAYRDLLSFTESDTYEDVEYSSTIDVTAIQFSITGSYPLNQQFSLYGRLGAGRIQVESSYYENAWGDIARESDDETKTRALVGIGVRYAITEHVGARVEYSRFSKISGTTLSSMHLGIDYQF

SEQ ID NO: 10202 - protein, 803 aa, Bacteroides intestinalis DSM 17393
MKRRLSKNVKCSFVPSLIFLALASNLHATTFWKSDLNENLTHITKRVGQDNFTVAEEGRLWPGIGPNGEAPGTVPLYYSRIPAMTITDDNKMVVMYDLRWNSASDQDRIDPGVSISEDGGNTWLSKTAWTFNDSKMPLRRAMDPTILYNSIDGSIYAMHGTWATGNGFWYQDRFNYFQNNIWATTIYKSIDGGKTWEKNAEFSKLSNPDVFSKVSKGPNNPVVSFLGGVGSGIVMRNGTLVFPIQTAHNYGIAATIMYSKDNGKTWEMPETTDLPAPNQISLENMVFEMGDKLIMVGREARVRGTQADKRWAYYTEDMGKSWHAYEPTSFGSSTAQPTQGSSIYVTLPNGRRVLLVSKPNGNNDNWARGNLALWMLDAKDPQHVYEVAIIRPGSGNKAGAGYSSLAYKEGNLFVAYEDDGNITVKNLTEYMTDIQAKALEWNLPDEIEPDVEKINALMHLNQGQKDELIAKLRRANDNAIAQSITLDQAMSELKLKSFALSQQAVSFEKALPSNLKNFQDALASINTISESKNTTNVNYLGVHDLYDSLYTMFLALNNPLDFTKYIEQAKHLNEYNHDILYRSFDDVFAHYSGGSKYNKLSLGGNKTVSEKVQAGLFFEYGNKHQKSYHVGMRAKYQLDNHQIAGFIRYRGVKHQDFIERNNNVDLYLNYAYQLRLSEDLSVSPSFGAYISRSNRTLLDQDVAVNKRTVYAGDVGVNLMYKINDINVNIRPNIAFINDSLKLSQSNDKSNVYKISSHNTIYGLATSINKAFSNGLKVGSTLELQKYGSQYSNVNLGVDISYTW

SEQ ID NO: 10203 - protein, 1155 aa, Bacteroides intestinalis DSM 17393
MYEFYASVRAKCFKRLLTSKIIVVMKLTIIILTIACLQVSANGFSQNITLSEKQIPITTVFNRIKQQSGYRFFWESRQLSDVKVSIDLKDVPLETALKRLFKGLPYTYSIAKKSIVIIEAPVPEPEEAFRYLQRIVTGVVYDETGGPIPGATVKVQGTERGAVTNMDGKFSIQVNKDTEVLVFSYVGYITQTATVGDKKTMDVKMAVDPKTGLEEVAIVAFGTQKKESVIGSITTVKPGDLKIPSSNLTASLAGRVAGMIAYQRSGEPGADNADFFVRGITTFGNNTRPLILIDNIELTTTDLARLQPDDIATFSIMKDATATALYGARGANGVILVTTKQGVAGAAKISLRVENSASAPTDNVELADPVTYMKLANEAVATRNPLNPQPYLEDKIAGTEAGLNPLVYPANDWRKMLFKDYALNQRYNLNVSGGGPVARYYVAGSYNKDNGILNVDERNNFNSNINLQSSSLRANVNIDLTKTTELIVRLSGNFDDYSGPLDGGTDMYRKVMRANPVLFPAYYPIDERHQFVKHIMFGNSGINSSYLNPYADMVKGYRDESRSQMLAQFEAKQNLKGLTEGLSIASLLNLTRTSNFSFNRSYNPFYYQLAGYDPLADQYQISKINEDGTEYLGFQEGAKNLNSTFYMQTTLNYTRTFASKHDVGGLLVFINRQSLNANAGDLQQSLPSRNVGLSGRATYAYDRRYFAEFNFGYNGTERFAKSNRFGFFPSAGVAWSVSNEKFFEPLKNIVSNLRLRYTYGLVGNDQIGSAADRFFYLSNVNMDDPNRSALFGRDLNHSLSGISISRYANPYISWETATKQNVAMELSLFGKANIIAEYFTERRKNILMDRASVPTTMGLSAGTKANLGEASGNGIDLSVDYQQAWSKDLWLSIRGNLSYAKSKYRVFEEPEYDEPWRYRVGSGLQQVYGYIAERLFIDDEEAANSPVQSFGSEYGGGDIKYTDVNRDGRISEADMVPIGNPTVPEVVYGFGFSMSFKKFDFSAFFQGSGNQSFWIDPAATSPFVSYLYPGENANGRTYTNQLIKAYADSYWSEENRNVYATLPRLSATPNTNNYQTSTWFMRNASFLRLKQVEFGYTFNKKFLERIRASNLRVYVSGSNLLMFSKFKMWDAEMAGNGLGYPVQRVFNVGLNLSFN

SEQ ID NO: 10204 - protein, 806 aa, Bacteroides intestinalis DSM 17393
MQQDRTRYTGPMKPLAVAILGATLIFQQALLAPLFAAGSAARADDASRRFDVAGGPLGQVLGQYASQAGVVLSFDASLTTGRHSDGLNGSYGIAEGFARILAGSGLEVRFVDERTVLLQKVPEDSAVVSLDAMRVEDNALGTITEQTKSYTPGTIATATRLVLTPRETPQTVTVVTRQHMDDFNLTNINKVMDHTPGITRHGTDNYRSYYYARGYQIQNFQYDGIPVLTGTDMGNTSVDMIQYDRIEVIKGASGLTTGAGAPGATINLVRKKPTHEFSGHATAEYGRWDNYRTEWDVGGPLNESGSVRGRFATAFQDQQSFMDHFKEQTRALYGILEVDLSSQTLWTIGANYDKRIPTGNNWAGTPVFDSHNNEINTSRSFNPGATWSRAEQFSHAFFTQLDHEFDNGWNSRIYYTFQRNAYDANLGSIKSIPSADNGSATLQSGQYRTKIRTQALEAYARGPFELFGRTHELAVGVSGYHNHLKGSGHNSVRTTINFWDWNGRIERPDWGGIRYRTEDRVNQRAYYASGRFSLTDDLAVILGGRVTNYRRGGDSNMRETGEVVPFAGITYDLNDNFSLYASYTKIFQPQSARDENYAVLDPDEGDSYEGGLKGEWFNGRLNASLAYFEIRQDNRAEFVGWNAERNYSMYEGKKAKTKGIELEISGELMPGWNIQAGFTHQVIREDETNEKLTTFEPENQFKLYTTYRLPGRFSRITIGGGGSYQGTTWRDGTDVLGNEHQYRQEAFWLVNLMGKYQITDNLSATLNINNLFDKYYYSNYGEVWTGVATKTYGEPRNMMLTTRWDF

SEQ ID NO: 10205 - protein, 972 aa, Bacteroides intestinalis DSM 17393
MKANKLSAITLCILGYAHTVYAESNMQTEKLETIVVSSEDDSVHNKNVGEIKKNSKALSKQQVQDSRDLVRYETGVTVVEKGRFGSSGYAIRGVDENRVAVVVDGLHQAETISSQGFKELFEGYGNFNNTRNGVEVENLKQAVIQKGADAIRTGSGSLGGTVSFESKDARDYLIDKNYHFGYKTGYSSADNQKLHSVTAAGRYSDFDLLAVHTQRHGNELRNYGYRHYDGSVVRKEREKADPYKITKQSSLIKIGYQLNDTNRFTLGYDDSRNTSRGTDWSNAFTSYNGGPFLKDVRHTNDQSNRKNISFVYENFDTNDFWDTLKITHNHQKIKLKARLDEYCDVNGEIDCPAIANPSGLYINDKGIFLDKHDGEITHKKEGEFNNYFDSKGKEVRVKGFNVDSILINCDQYDCSKPMQLLSSTNNGYGGSPNKYIYKTYELFEKTMNNGNGKYAVLEIRSSGHEKFSRVYLPSEKGYVENQWKDRDLNTDTQQYNIDLTKSFKLKSVEHNATYGGLYSEVKKSMTNRAGYEAYNRQWWANIFFGKENNKPNKCQPYNGNSFTTLCSHEDRLFSFLIPVKTKTGALYVTDKIKLNDKVNLDVAYRYDRIKHDPKYIPGTTPKLPTDLILGRFIEFKPKNTYATQDEKNENAEKNAVYLASKKTKFSANSYSATFSFDPMDFLKIQAKYATGFRAPTSDEIYFVFQHPSFSIYPNLYLKAERSKNKEVAITLHKQKSFLTVNLFQTDYKDFLDLAYLKKGSLPYGNGGSQLETLLYQNVNRDKARVKGLEVNSKLHLGDVWRTLDGFNLSYKLSLQKGRMSSKVGEEGKQRDTNKLDTPMNAIQPQTHVVGVGYEHPQEKFGVDMYLTHASAKKEKDTFNMFYDGKDQKDQHIKWRSDRYTLVDLIAYVKPVKNVTLRAGVYNLTNREYGTWDSIRSIRPFGTTNLINQETGKGIKRFNAPGRNFRVNAEITF

SEQ ID NO: 10206 - protein, 1063 aa, Bacteroides intestinalis DSM 17393
MQRLVRSTLSGLFTMSLVAVSIQARAAEYGQIDLSNPAGGDSMNLHPGDSVIYDGPGAAINISAKGNNLNAEGVDIQAGSPGGNFTVGVSASDGGHVTLVDSQVLSHRTYALEARGPGSEIVATGTSLTSRQSFGAYAYGGGRITLDGGSITTLGIYGYGVVASGAGTALDARNLSISTSNASGYGAEVSQRASMTLEAVTINTAGEDASVLYVRGAGSSLAFIDSHGTSASYSGARLYGGKFSMLGGSLTAHEDAVFLGYDFDGVGSSADIRDATLSSSNGYGLNLNGDAASATLNNVRISSSGAQAGGIWMFMPETKLVADRFSIDTYGAQFAHGLDNRAGQATLSNGSITTHGANSLGLYLYNQFDSDASIEASNIRIETFGAGSFGALAQTTGADLRLAQSEVVTHGQAAHGLFVRADDARLAVSSTEVITNGNGASALALGNGAVATLENSRLATHGDLASGVWSYVNSGTASNSLSLTGSQISTQDGAGLLASGGDHQFTLMNSSIVARADGQEARGIFLQTRQAMLNNVPVDTGQVSVEASGSTLVGDVFAQNGSVDLSLSAGSELTGALRAESGGRINSLLLDDSSRWNIRGDSTLGTLTNNGTLVFGAAGFQTLTVNDYIGNGTMVFNTHLGDDTSPSDRLVIDGGTASGRTAVRVLNAGGKGGLTQEGIPLVQAINGGTIAADAFYLDTGSSGYRWSVGSLSINGYEYSLVQGGISGNTNDWYLTSEASQVAPEGGAYIGTQQATRTMFDHGLQDRASKRSLGADRQDSGLWMRAQGRHDKGMRMAEGKVDIDSSSDVVQMGGAVLRRPVGAQGALYAGLMAGYGDARIDSTSTLMRRDTNTAVRAKAHGKVSGYSAGVYGTFYADDVNRLGAYVDTWLQYGRYTNRLSSELGSADYDSNLWSASLESGYALAPFAADSPFRAWVVEPRGQLIYSRYTASAADLRDTRLRNGTADAWRSSIGVRLYQQPGQAADESVLRPFVETNWLHSEAVPSVRMGSNSFDARPSRDALELKVGAQVRVARDVELSSHLFGHSGSASEHGYGGQLNLSYSW

SEQ ID NO: 10207 - protein, 704 aa, Bacteroides intestinalis DSM 17393
MDLKLRLLSLSIAQLCCIPATFADTNNSSTTLATIKIKAQQASDQTYKVDSSSSATRSEIALQDTPQSVSVVTQKVIEDIGATRLVEALDLAGGVTRANNFGGQGLTGFNVRGFTSGEFYRNGFPINRGYPNAPDSNTIERVDVLRGPSSSLYGRGDPGGTFNLISKTPNSEQQTTLGAQLNSEGLYRTTVDTTGTIPNAENIGYRLNVIAEGGDSYRDHVESKRYGIAPVIQWQATDATKVTFEADILRNQHPLDRGHTRYPTQKSFNSSPETYLWETGKYYNRLYNDNNMTQLRVEHDLGNDWKLNAGVQYLNGKLHGYAVEANGIQNDGETLGRNYNYRELKWQDTDAQINLTGNFQLLGLAHTLVTGLEYENYDYKSYIIRSSEDIGSYSINIYNPVLGQPLPELNTVTTHDRENLKTTALFVQDQLELNERLSALLGLRFEHYEHDYQDLRPGKPNWNTSHDAFIPRLGLVYKASDDLSLYGNAAKSFKPNTGASHSGEGFDPEEGMAYELGFKWLALNNMLSVDSAIFYANKENVLTNDPLFPNYKVAAGEVRSRGIELNIAGQITPAWKIIGGYAYTDAEVTKDNTLQKGTALANIPKNSFNLLNIYEFQDGPLQGLGLGINQKYIDKRAGQTANSTYIMKGYAVTDLVSYYQATPKLRLNLDVKNIFDKVYDESAFNLYAYPGESRTVQLGMSYTF

SEQ ID NO: 10208 - protein, 1045 aa, Bacteroides intestinalis DSM 17393
MKNIMLFLMALLMSSHVMAQESIVTGTITDANDGSPLIGANVLVKDAGVGSIADTEGRYSVNVPKGKNVLVFSCIGYKEQTITLKPGQRTLNVRMAEDTELLDEVVVVGYGTMKKSDLTGSVTSIKSDELMKTNPISINQSLQGRIAGVQVNQNDGAPGAGVSIQIRGANSFSTSTEPLYIVDGIPFTTSGTPGTGKDGMLQTTNPLSAINPADIESIEILKDASATAIYGSRGANGVVLITTKRGAKGKDNISFSANFGISKVVKKMDMLDGYTYAKYRNEAAEMFNKYDGANEKIPYPGTSTVDPATGEAVYSPGPDDYRTGKYPSVNWQDEVFETALSQEYNLSVSGSSDKGYYAISGNILDQEGIINNSGYKRYTFRANVARKVHEWIEIGTNMSFTNSLNKLAKTNSVSDGIIRGTLFYPATAPLDDETNNAQLNWFSSNPYVYTRAAKDELTTNTFFSSSYLEITPIKDLKLRQNVGFSYNGNERNVYYNRETVEGKDPVNGYASKADNWAKNLVLETMATYNKEFNKNHSLNAVVAFSYEKGDYGNKAMTATGFPQDITEDYDMSAAVNPGKPTSGRGMTSLVSFLGRANYSLMNKYLFTASFRRDGSSKFAPGNKWSNFASGAIAWRASEEEFIKRLNIFSNLKVRASYGQTGNQAIGAYATRDYLTVANYPINGALASGFANLTWRGPANPDLKWETTSQYNVGVDMGFFKNRVNLTVDLYYKKTSDLLQNIQIPQSTGFSNMTTNFGNVTNKGLEISGKFYAVATKDFNWDFDANISFNRNKISGLPGDQFAQGWSKADNVFLQRNGLPIGTIYGFVEDGFYDNIAEVRSDPFYANESDAVCKAMIGEVKYKDLDGVAGITNADRQIIGDTNPDFTFGMTHNFSYKNFSLSFFLQGCVGGDIFNANLMEVTMSGIGNIPQEMYNTRWTPENRAIAKWPKAYAGYGRTMKLSDRYVEDGSYLRMKNINLGYKWIPSFKGIESVNLYVSVSNVFTISGYSWFDPDVNSFGSDSSRRGVDMFSYPSSRTFSFGLQCTF

SEQ ID NO: 10209 - protein, 419 aa, Bacteroides intestinalis DSM 17393
MKNKLVSGLALTFTLGSFNVLATNGYFTHGYGMTHKGMAGAGVAISEELMSGANNPASFNVNDTEISVGLELFSPDRKYTASSVDTFYPNALYLEAKTQKSDNTLFAIPEFAIGHQLNDKINIGLLVYGNGGMNTDYNAESEPEGTFYAGTTGVDLKQMFISPTINYQLNEQTKVGVSPIYVVQQFKATGLGNFAPFSQSPQALTNNETDTSTGLGVQVGITQTVGTSFSWGASYRSSVSMEEFDSYKGLFAENGGFDLPSSIQIGAAYKLTPTNQVVFDWQKINYSEVKSIANPMSNLMSAPLGASAGAGFGWEDMDIYKLGYQWQRTAKQKIRFGVSYTQQPIPSSEVLFNILAPGVQEWHFTTGFSHEVSEKVQLNAMAFYSPAKKVSGANFLAPNQQLSIEMQQSGVGVSIVWGI

SEQ ID NO: 10210 - protein, 838 aa, Bacteroides intestinalis DSM 17393
MDNKRDDVCMTDGISAQDIGKFPAENIAEAIQRIPGVQISTINGRGSTISVRGLGPQYSATTINGQVIKSADFTDGFRYDIIQPEVAAGIEVIKSPSADMDAGGLSGTVNINTTKPLDYQQTKLLFSAKTQPSEFAGSSPTPKGVLTYIDQFQFGGGDLGVFLGAGYQKLKDRADYLWIDRWYTQATDAGTLYIPRRPRYRSIERETTRKMFNGGVQWKPGEQLDMNLTALYSQDRTANDMNQLVYSFERSPLTVLQTNGLTATQVSASDYWLENNHQIEQHNLSTQLLTYDFKWKGDAWTLRGAANDTQGKTDENERAAILGRIPSATLLDTFNPDAVSLTTDADANDASAWNTANLVRSEYPNGSIQSLSNKEWSLQLDAERYLDLGALNAVRFGAKYRRETFDRDVRRRDFLYLLRTGAVSGFDMFPELSAASSTVSNFLDGQLASQDSWVTPDVAAYARSLAAAGITVQVLFAPQSSYSIENDISSAYAMARIDTDIGSMRLRGNVGMRYENTRRTTDTYLTQAQAASADANLVVGTARAPYAYSNWLPRLNLVLDMREDLLLRFAAAKVLVRPILDSNTAIASTISTGTNTAGTTTYGVAQGQTDLKALTADQADLSLEWYYGNGGALTVAGFWKNIKNGTFNSIVCPAAFNGTALSSNAAGDCVSGNGDIYEITATTNDPSKVKIRGYELGWTQSLDAWLPIDGFGFTTNFTRVIPQRDTDFKIRNLSEQTWNATAYWESEHDSARVSLNHRSEYEQDSSDSFFAREGHIMKARTQLDAVLGYQVNDKLSVQLGGLNLTNRKEQAYKDIPSRWQMTGVTGRSYYLSMQWDML

SEQ ID NO: 10211 - protein, 700 aa, Bacteroides intestinalis DSM 17393
MYNKSLLSIAIVLALSPSAYADDYASFDEVVVSATRTNQTLGNTAAKVDVVSDKDIEKNMSKDVAEVFEYTPGVTVNGSNRQGIQTVNIRGVEGNRVKILVDGVAQGQSFDGGNTEFVNSSAVYIEPDMVKSVEVVKGAASSLHGSDAVGGVVAFETKDPRDFLKDGESFGGQVKLSYFSEDKSFSEHVALANRIGDLETLVAFTRRDGQNVNNFANAEHENYSVTDQDTEKNDLLLKLQYQLNPAHRIELLGEITHNESNSDIYHSTYTNYTGDDTTKKTRLGLKHIWNADIGLADTITSKVTWQKKDDNGVTHRSTSSNNQTKDYVYKDNRWDVETQFDKLLTTGSVEHNFIYGISLTAADIENTNIQYDSSTNSSSQIVYTPDAKERKVGVFLQDEMAFLNGDLIVTPGLRYDWFNTNPGDVEGTNYETYKDSAVTGRVGAVYHLNTENSVFSQVSQGFRAPTFSELYYVYAGGCYYGFCYENIPNPDLKSEESISYELGYRHKTDASRSEISVFYSDYDNFIDQTSTNDGSMTSYYYTNIDKATIKGVELSNTLLLDKLVNAPQGMSTELVAAYTEGEDGEGNPLNSVNPWNAVVALNYDAPSTQWGSSLKVNYTAKKSSSNINSEDSAQTELPSATIIDITAYYKPIKDVTLTAGIFNLTDKEYYKWNDVRGSSELDLDKSQPKRNFAITAKYEF

SEQ ID NO: 10212 - protein, 176 aa, Bacteroides intestinalis DSM 17393
MVMKKIACLSAVAACVLAVTAGSAFAGQSTVSGGYAQSDYQGVANKSSGFNLKYRYEWSDSQLGYITSFTHTEKSGFGDEAVYNKAQYNAITGGPAYRINDWASIYGLVGVGHGRFTQNESAFVGDKHSTSDYGFTYGAGLQFNPAENVALDVSYEQSRIRNVDVGTWVAGVGYTF

SEQ ID NO: 10213 - protein, 410 aa, Bacteroides intestinalis DSM 17393
MNRKCLFGLVIFIVTTISLNAQKSEKDTSGNNFKGFRDKMSSNGISFQPRLTLFQQNFVKGTNSNNSVFAGKADLKIFFNGAKIGLKRLTLVTQLEQNFGQSLNGSGGVAIPLNTATTFPGISGANAFDVTSLYFIYQFGQKNTLLFGKINVIDLAASSLYSGGAGITSFWNMNFAAPVSGITPAYIFGTVASIHTKAFKYTFMVYDPVSAVNTSGLENPFSQGITFSAAIEKKVQIGGLPGSHALKASYSTQDGTDLYDLGDIFFPTPGSTANLEDSRYYFSYRFTQQLGKISNSDKGWGLFGQIGVSDGNPNPVDFGALMGIGGNSFFKSRSEDKWGLGIYYYSFSKPVDEFSEANGIPLRNETGIEMFYEFQINKWLSLGGNTQYIVPLVKNNENAIFLGLRSSIAL

SEQ ID NO: 10214 - protein, 856 aa, Bacteroides intestinalis DSM 17393
MWQIKTSLTAVAYSVMMTCTLLHVEDVIARTYSFNSSLLSGGVKGVDLTVFEEGGQLPGIYQTDIILNGSRVDSLEMPFHTEKDENGRPYLKTCLTQEMLARYGVKTEEYPALFRSLGGGSDTSGERGVCADLSAIPQATENYQFAAQQLVLGIPQVALRPLLRGIAPEVLWDDGIPAFLLNWQANAGRSEYRGYIKDVEDYFWSSLEPGINIGSWRIRNLTTWNKSSGQSGKWESLYIRAERGLNSLKSRLTLGENYTPSDIFDSVPFRGGMLSSDESMVPYNQREFAPVVRGIARTQARIEVRQNGYLIQSQTVAPGAFALTDLPVTGSGSDLQVTVRESDGTVQVFTVPFTTPAIALREGYLKYNVMAGQYRSSDDAVEDSTLGQVMGMYGLPWGLTVFGGLQGAEHYQSAALGLGWSLGKLGAVSLDTIHSRGQQKGYNYETGNTWRIRYNKSFELTGTSFTAASYQYSSSGYHTLSDVLETYRDDGRFAYRSTDSRTSRTTVNLSQSLGRWGYLGLNGSRDEYRDRPHQDYIGASYGASWNRMSLSVNWSRNHSTRGYYGSKSRTEDSISIWMSIPLESWLGRSDNNISATAQMQRSTEQNTRYELGLNGRAFDRRLFWEVHEQMVSGSEYNTGTSRLNLRWSGTYGELAGMYSYSSNMRQINAGMSGSMVAHGEGVTFGQRAGDTVTLIAAPGVSGASVGDWPGVRTDFRGYALAGYASPYQENVITLDPTTFPEDAEVPQTDSRVVPTKGAVVRAGFRTRVGGRALVSLTRQDGSSLPFGAIVTLEGKPGETSGSAGVVDDKGRVYLSGLSETGKLKAQWGENSLCHADYRLPEEKGPAGIFLTRTVCM

SEQ ID NO: 10215 - protein, 901 aa, Bacteroides intestinalis DSM 17393
MSMKLDLGKIFFLILFLTLSVMAATAGTVKGTITDRQTKEPLTGATVQVSGTAQGAVADLDGNYTLELKNGTYTLTVRYIGYKDMTINAVEIKGETVLNFDMEPDTQTLGEVQVTAKKNLEGERALQMERQKATLAIENLGSKEMSLKGIGNVEEGVKKITGISIASAGQLIVRGLGDRYSTTTLNGLPIASPNPDNKLVPLDLFPSSTVQNITVSKVYDAAAFADYSGAHINISTKENIPQDFFQLSLNTGGKFNTLGKDRYQMDRSGSLLKTPGVDAAALDMPLMEFDKYVKTHNIFDTSFAASKKSSLPELGGNLGFGKNFGIGNQTLSLLASFSASNGYQNMEDAFYKTLEATGTVQDDFSYDSFAQELKLAALGYLGYTLRRSDRIGYTFFYARNAIDTYQRREGTDAEGHELTGSNNIMHIYTLQNHQLNGIHNFGEGDRWQLTWGGSYSKTGSEEPDRRQVMYVKDNDGSLRLFKLNRQETMRYFGSLDEEEWNANLAMRWKWNDTSHLKLGFNYKDKNRDYSATRFYYNLNKLNPVITDIYNTDGFLNQQNIADGQIVVQRVMQPKDSYRAGNEIYSAYLLTDFYPTEALLVNLGLRYEMSKQWVRYASDGGDWYSRRRNLDKNDLFPALNLKYAVNPTNSIRFSASRTVTRPSFIEMAPFLYQESYGSAQIRGNEELQNGYNYNFDLRYERFGKDGDMLSVTGYFKYLDSPIERIQDLQGGATLHSFKNADNGMAAGVELEMRKRLVKDLRLGTNISYMYTNVKLPQSGAYTNKERSLQGASPILANADLTYSPRFGEDRQLNLALLYNLQGSRIHAVGVSGLGDVTQQTLHTLNFSAGYSLNKHFNLKLQVNDLLNRDVIFKQDVPTTGQEMEVERYHKGTNFEVGISYNL

SEQ ID NO: 10216 - protein, 322 aa, Bacteroides intestinalis DSM 17393
MRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 10217 - protein, 847 aa, Bacteroides intestinalis DSM 17393
MHDNQCDRLIINTKTANNAVLSAAKKTSAVVSTRKNSLSKLLLMASAVPLSSMALAAEQSSTQADSQTELMSAVSPNKPNSEPHITLDAITVKAPHPAEFKTDKLQNQKYTRPLVEVPQTVTVLGDRLIEEQKAGSLIDALRNTPGITMQMGENANSTEGDAISMRGFSGNSLFLVDGVRQVGAVNRDTFNVESIEVTKGLAGAEIGRGATGGAINIITKKPKSYEDYKTEVSIDTEGKTRAVADLNRPLNDDFNGRLNLMFEKGDAVKRDEVDVKQYGIAPSITWNNGGATRVTASAEMLRSRNTPETGIPSIGMDGYFYGRTDYTVDDFDFSEFDYSRVNASTPEEVVAELNAANAARNAAPKVNDKNYYGMSSDFEDIDSDVYSVFVEHDFDDDIHLTNTTRYSKTTMDRRSSAPYIPFNTPINIRRGTNKLEVYDKLVDLNVDKNDPSTWRISAIRQGVDRENTTLANMTNINILDFKTGALSHDISTGVEFIKEEQKNNGLTYSSLANNFPSLYQPNPSEPQEPTVSNGVKTNGETKTVAAYLFDTIALNEQWDVMLGGRVDKYKTDFVTRRPDGNSSKLKDDGTLYSYKSALVFKPTKQSSIYASYGRTETPPGSENFTFGTTGRDAANPNANPIFDPQKTKSWEIGSKWNVLNERLLLGLAYYHTTHEDELAELDENRNYVQFGERQIKGLEFSAQGEITPDWRVNLGIQTMDTDIKKGSVSGPGVVGASSRWSPELTGTLWTSYDYNDKLTLGGGVRYVDEQKREADPNVDLSQVSMPVIPDYWAVDLFASYRFNDAFSADLNINNVFDKDYLESVNIMGLRANKGEPLNAMLTLKYQF

SEQ ID NO: 10218 - protein, 354 aa, Bacteroides intestinalis DSM 17393
MKHKHWLAAGGMAALGMSAWAQSSVEMFGIVDVHINSARSGATRLSRLEDGGSAASRIGFRGSEDLGGGLRAQFMLEAGVAPDTGLGTIPGPGLAFTRQAWVGLNSGWGAVEMGRMYTPMFGALFRADPLGMNALFSSLNLVSATDAQAGLRPFAARANNLVRYRTPAGQPWLADLAYSFGEVASPNSSNGRLYGATLGWNQKPWFLAYSFQKSVEGSAAAPVAAPATSQYQALSASWEALDGLRLTGNYVINRVDRAGTPKAKLAQLGADWSVDSRSKLLVSVARREVGGTDRAQNTWTLGYDYALSKRTVLYARWLQLGNAANASAAIANVPVAANSGDGVRSLALGVRHNF

SEQ ID NO: 10219 - protein, 973 aa, Bacteroides intestinalis DSM 17393
MQAQDVAIKPNVKVIMKSDTEILDEVMVIAYGTTKKESFTGSAEVIKSEKLKERPVANVTKALDGMVAGVQTTSGSGQPGSGSSVVVRGYGSINSSQSPLYVVDGVPYDGNISAINPNDIETMTVLKDASAGALYGSRGANGVIMITTKKGNSGKVKVNLKANWGVSSRAIPRYETMDEAGYLETIFQSYKNNQIINGGVSPELAGAAALEAMRSGSTAMLGQNEQYNPFNYSITELIDPVTGKVRSDAKLRYSEDWMDEALKSSPLRQEYVASFSGGSDKTKYMFSLGYLDEEGLLKTTKFNRYNGRLNIDSEVTNWLKAGMSANYSRNESNTAVENSSGSSNVWYSAQLMAPIFPVFEKDANGATIYDNLGNAVFDYGKNRPAGANSEWNTIATLYDDMYSTQSDNLSGRVYAELGDLKNTFLQGLKFSVNYGFDLINSAGATYYNPYNGNSVAVKGTIQKATARTFSYTFNQLLTYDRKFGNHHFEALVGHEFYKYRYDYLSATKTGFPFGGLYELDAATTITGASSYQNNYAVQSVLSRLNYDFADKYYLSASFRTDGSSRFYKDNRWGKFWSVGGNWRISHESFMSDITWINNLSLKASYGVQGNDAILSGTKQNFYAWQSFYDLGYANSSMSGAAVTSLENKELKWEKNANLNIGIEAKLFDRVSATIEWYQRKTTDMLMSFPMASSLGFDGYNKNVGSMRNTGIDLTLGVDIFKDTPFTWNLTLLGSTIKNKVLQLADKPEIISGSYIIREGETLYSFYTATAAGVDPATGEQLYWAWDTDENGVKGKKYITNDMAKATACKEIQGSRIPDLYGSINNTFKYKGFDLSILCTYSIGGKVLDGIYNNLLYGNYVGQAKSKMLERAWRNPGDITDLPRIEIGKSYIITDNSLIDASYFAIKNIALGYSLPSKWMKSIGFDSARLTATADNVVLFNRLKGMDPQYNFTGGTDFGYVPVRTISFGIDITF

SEQ ID NO: 10220 - protein, 984 aa, Bacteroides intestinalis DSM 17393
MQTQEVAIKPNLKVVLRSDAQQIDEVVVTAMGIKRSEKALGYAATSVGGEKIAESRTSDVMSSLAGKIAGVQISSTSSDPGASNSVIIRGVSSLSGTNQPLYVVDGVPLNNSTVYSTDGLNSGYDFGNGANAINPDDVANMTILKGAAATALYGSRAANGVVMITTKSGRKEKGVGIEYNGGVQWSTVLRLPEFQNEFGMGWNGNHTELENGSWGPRFDGSMQLWGNVYNNSQKLKPYVAMPDNIKDFFDAGFRYSNSLSFNGATDKSDYYVSFSQISDDGMIPTDADSYDKYTFSARGSHKAGALTFSSSLNYAYQKNNFATTGQGLSMLNSLYQTPRDISIIGLEDQNDPFNTPGYYYTPYGVMNPYYILNNYLNEYESERFYGKFQLDYEFLKYFKFTYRMGLDTTTGQSDKGKPNLYALYYEGTPNGEGQGSSSPFSGETGQYSEQITRRREINQDIMVNFNMPVNDFNINALVGFNGNERKVSYQYSEVNDLTIPTWFNLKNSGKTPIVEQHMELRRLMGVFGQFEGSWKNMLYLTVTARNDWSSTLPKENRSFFYPGITGSFIFSELLNDNLQDVITFGKIRASWGKTGNDADVYMVNPVYAQSSNRIPFGSLTFPLGGVNAYSAGNVLGSNTLSPEMTTESEVGLNMAFFKNRLSFDVSYYNRNTDKQIFSLAMDPASGYTAQNMNLGKIRNRGIELLISGTPIRTKDFSWELTWNFTKNWSKVISLPEELGGITTIYGLNGGTSMYAITGMPVGVFKAQVAERDPQGRIVVNSSTGLPVEASEFGICGDMNNKYQMGVSTNLKYKGISLGIDFDIRQGGVMYSRTKDINYFTGNAIQTAYNDRNPLIVPNSVNKIVNGENVTYVENTTPITSSNIYKYWGDGGSDMGSCFLVDKSYVKLRSVVLGWDLPKRWLAKTPFQAVKVSAYGNNLFVWTPSSNTFIDPEMTSFGNDLEGNYGEYTANPSSRRFGFNLMVKF

SEQ ID NO: 10221 - protein, 453 aa, Bacteroides intestinalis DSM 17393
MKTDWKTAMLAVGMLVGSTTFAVAQQPGYYNAGKVSYVGEQVTVSDCGCATDTACDSCGGCDSCNSCGCQSSCCGIDWFPCCGHGDQWSLFGENDCGVTIGGWVSGGFYANAGGVRSNTGNEPVAFRGISNTPTVDQVWIYAEKLADAETYCFDLGYRADFVWGADGPDTQSFGHGDRDAWDNGWDTAKDLGSGTDLYGSAIPQLYGTAAWGDWEVKVGHFYTTIGYEVVTAPDNFFYSHAYTMNYGEPFTHTGAMATYSGIENLTLNGGWVAAWDTGFDFYEAGSMFLGGASATLSDKATLTWQCVGGSFGKNGGDSYMNSFVFDYDLGCGWNYVFQHDLGVQYNLFDGAGAPADNAYWYGINQYLFKEINECWKVGTRVEWFDDEDGSRVGNGAGSYYALSVGANWTPNANLIVRPELRWDKFDNNTGATPFYDGAKDNGFFGGMDVILLY

SEQ ID NO: 10222 - protein, 219 aa, Bacteroides intestinalis DSM 17393
MQAQCVHGGRPRSTASSSPMKKNLLALAALCVLTSGAAHAQAADGQGPWMVRARAVHLDSANKDSTGLGLSINNKTIPEVDISYFFDKNIAAELVLTVPQKQDVRSSALGAQIGTLKHLPPSLMVQYHFDAPGFRPYVGAGINYTRFSSVRLPAGVSIDKSSWGGALQVGVDIPLTKNLSLNFDIKKVYIRTDVAANGAKLGTLKIDPVLAGVGLGWRF

SEQ ID NO: 10223 - protein, 1038 aa, Bacteroides intestinalis DSM 17393
MKRKLMLLLACLFVGIGLVTAQTQKVTGVVISEEDGQPVVGASVLVKGTTLGTITDVDGNFNLSNVPSSAKTLQISYIGMQTQEVVIKPTLKVVLKSDSQNLDEVVVTAMGIKRSEKSLGYAVSSVKGDEITKARESNVLNSLSGKIAGLQIAQSSGTVGGSSSIQIRGASSIGTVSSPLFIIDGLPIDNGSYNPDRTNGIVDVGNRAGDINSDDIESINVLKGAAATALYGARAKDGAIVITTKKGKKNSPVFVTVNSSTRFENVLKLPDFQNEYAQGSYGVYNVKMLNGWGPKISSVQDQQFTDYKGDKVTLKANPDNVKDFYETGMSYINNVSVAGGGEKADFRLSFTSTNQTGVVPGSDYNKYAFSVNAGMNFTKNFTGRISAQYIRSDSEGRPAQGANDSNLLIPLINGLPRTIDIHDIQKNWVDENGKQITLDPEGKSNNPYWIINKNKFTNNLDRMIGNITLTYKPIEGLTITNNAGTDFYTEGRRKVYAKGTVGALNGKFQTWNLYKRIINNDLMVSYEKTFANDYHFKVMMGHNLYQEEWKNENVQAQNLVVDGLYTYTNAKSTTPVNYYEKKRLVGLYGDISLGYKDMLFVNVTGRNDWSSTLPINNRSYFYPSISGSFIFTELMENKDILNFGKVRLSYANVGSDEDPYNLAFKYTPASTYFLQYLGNVNTFPHMGLVGFTGPRVLPNENLKPQNQSSFEVGADLRFFGGKIRLDMTYYSNITKNQIVSIDVPLSTGYFANNINAGKIANKGVEVTLGLTPVETRDFKWDLDATFASNKQTVEELAEGLDEYTLTSGLSGLQIKAAKGDSFGLYGTGWKRDDQGNYVINSKTGLRETVNNVRLGDVYPDFTMGINNTFTYKGVTLSFLIDIRHGGSLYSETVANLRSSGLAAETIAHREDASFIEPGVILQDDGTYRPNDVPVKSMQDYWQHISNSSNNEGNIYNASFVKLREVQLSYSFPRKWFKSFFVKSLDLGFEARNLWIIKDHVPHIDPEANFFGPSQIGGGVEFNSIPSTRSFGFNVRLTL

SEQ ID NO: 10224 - protein, 783 aa, Bacteroides intestinalis DSM 17393
MNKKAYLRPLALAVLTALASQAALAEETQLQTVTITGAGDKLGVGLLQQQEGARARSDVSKAALEKQSPTSNIYQGINMLPGVNASSQDNTGMFGGALTIRGFNSDQIGVTINGVPVNDSGSYNVYPQEFVDLENLCQGSVTQGSSDTDAPHMGASGGNMSFVTCDPEKERRVRFAQTLGSNSLQRTYVRGDTGLFADGKARAFASYSHSETDKWKGAGGMKRDHVDTGIRYDFSGGYINASVLYNRQIGNAFGTPTLQQLQQTGYGYDYSTSFVPGHLPPKNGTAQKETGPTPAYYQLQQNPFENVIAKVDAVLKLGPDTRVKIQPYFWYGYGGATSQQTQSESAFLNKSAHTDTAARDLNGDGDTLDTIVVNGSSITRTRRPGITVTMEQSLGNHLLQAGVWYERAQHIQTGPESLTNADGSPQDPWMRSGLITRPDGSLYQYRDWETVSTATQLFAIGTFNFLDDRLGINAGLRTPQIKREFTNHANEGCGASSKTCAAAYDYTISKTYRETLPSFGMRYYLTPKQQVFFNITKNYRAVPNYAYSSSNGNVQVVNGQVVLNNDVVPETSVNTDLGYRWQGDIVTLSGSLFNVDFSNRQANSYDPVTLKSVNINAGGVHTWGGEIELGTVPVKGWSAYASFTSNHSAIQSNLNWKDASGSNTVLQTQGNDFPMTPRWMAALSLQYSPGAWYVRTDVKHTGKQFATLVNDEVVPEYTTVDLDAGYRFGNIGMLKNPTIKLNVSNMFNTSYRIPTSSKVNAADTVRYNLGAPRSAAVTMQVDL

SEQ ID NO: 10225 - protein, 942 aa, Bacteroides intestinalis DSM 17393
MKKKDVARTVLASALAVALTACGGGGGGIARQSTPAAPPPTSPPPPPPTSPPPPVTPTTPEPAIDAHLVLTNARAAQALGFTGAGYRIGVIDTGINANHPALQGRVSDSFIYVDPRTNNTAVGDVVGHGTVVAELAAGRAVGQWPGGIAPGAGLLSARIISDRAPVDDGSGNGNEIDGPLGLGPVHADLISAGVRIMNNSWGGLYWNDPTVTNQIAQEYRPFILSNNGLVVFASGNESRSQPSDTAALPSQPGPNGTLPAADLERGWLVVGAVDTANPTQLASYSNACGVAMRYCLVAPGTSLFIDPDATAGNIRYFYGSGTSFAAPLVSGAAALVWQAFPYFNNDLVRQTLLGTATDLGAAGVDPVFGYGLLNVGKAVLGPARFDWGTVDVNVTTLRSTWANDISGTGGLTKRGTGTLVLSSTANTFAGDTQVLAGTLQTASLQSARVSIANGASLVGAGRIGGQVDNAGTLQVNGATASITGNYTQASNGRLAVNVGDRLNVAGTATIAGDLQLLGRRDYVVNNTTYPVLQATSGLQGTFDTLSSGPAVTFLTATRSYDANTAYISLQRMDVTAVAASLGAIGTASMDSAMRVEQAFQKVDAQQFQGNGALGGDFIRAAAALQQSPTAKAAADSLRSLSGRAHAASAAMTFDTIDLGRRALASHFDGLSQQPRLLGSWQRALGGPGEGGATTSGFATSGWMMGNDLRLASGAVTGFAFGETRSSSLGDLDGARGRDRQVQAQLYWGTMLGAAYTLGQMGFGNVNRQIERSLQLGEDRSSAFSDYSGSYLSSNLETGYRWGGAQASLTPYMGLDYVRLRSDGFRESGGDGFGLRANASTSSRTQALAGVRSAYRWRGIQLGGYAEWQQALSSDGLMLDASFVGVDAWAPLRGMQPARSGGLFGITAAAPLGQQSQLRFGYDQRVGERGDDRALSLRYSADF

SEQ ID NO: 10226 - protein, 675 aa, Bacteroides intestinalis DSM 17393
MLCLALTASLAAPPEATDGEDPGAASSASETGEVDGEAGAEGRRSRRARGRQEARDEVDPEVREIEVSTGTRTSRDAATTPVATTVVSREDIVNSGAETLDEVLEQQGAGVQTSPGIGGVGATLRGFNPEQVLITIDGQRVTGRIGGAVDLSRLTVENIERIEIVQGAGSVLQGSDAVGGVINIITRKPDEGVQAEAHGAYGSRNTIDATGRVAGGMRRWQASLTGGLHRSEGWDASPEDEATTGDGFQAWNVGAGVHVQPLSALRIDLTGSYLRRNSEGVDVTNGGAILDRRNLTETTDATLATTWIDGDSQLQTTLHTNIFRDQFRQDQRGDDALDQYQPTWDQVLQVGAQYDQLVGKHVLTTGVDLQFEWLRTDRLEVELGGSGPDNDRAQRSRAALFVQDEWVPSTAPRITVLPALRLDFDSQFGVYPTGRLALLVAPLDELSFRVSYGRGYRAPSFRELYLAFANAGVGYRVQGNPSLRPEQAWTLNVGVSYLPTKNLTFTASVFDNQLRDLMTVDLVAEGGANQLQVFSYVNVGTATLRGVEGTADVRFAKYFGVEGSYQFLHARQHGSDQPLPNRPAHQTTFGFRFFHGRWGTRASVRGRIQGERAFSVTEDSAEFADPFATIDVRVSQRFLRYVTAFVGAENLLDAGDAVVNRIAPRSFYAGINVRY

SEQ ID NO: 10227 - protein, 1049 aa, Bacteroides intestinalis DSM 17393
MKKKEHKSKSLLWRFFLVLFAFSMSLNLYAQEITTTGTVVDQNGEPLIGVTVSVMKGNNGTITDIDGNFSIQCNKGATLKFSYIGYKDATQVAMGTKMNIVLTEDAQALDEVVVIGYGTVKKRDLTGAISTVNAKTIEERQPTDIFQALQGEVSGLQISNNSGAPGDTGTMLIRGASTMGSGVTPLYIVDGVAVDNISTINPADIESMEILKDAASAAIYGSRSAAGVIIISTKRGKEGAPARISVKYNHSMKKLGHKIDQANAFERYLKERAGNAGTSLWKTSNDSLHPNFMADNDYQDLITRMAHSNQVDINISGAKNKMSYYTSIGYLNEQGIVLNSYLNRITSRTNVDFAVSDRFKLMSRFNVAYTDKNNINTGGVINQALRRPPQMALYFPDGSYVYNNGGQFNPIADAYERVNKSVSYSVSLYQGAEFQLMKGLIWSANVQGELKVNRNDQLIRGDLVSSGISSGSNDAKIPRKLSAETYINFARDFKDHSVGAMFGTSVEDWRDETFHLEGSDYVSESILTSNAQQVKDLTKTKTTYESHAMASFFGRVNYSYKGKYIFTSNLRYDGSSRFVGNRWGLFPSASIAWRASDEFFFDWAKPVLTDAKFRLSWGTNGNERVGNYESINQYNIGSYYNGVIGVTQTDKLANLDLSWESTEQTNIGLDVTLLDGRVSLVAEYYIKKTKDLLADEVIPSELGVSSMRVNMGNIENKGIELTINATPIQLRDFSWQTTLTYTKNKNKVLKLSEGKSFVEDGKYLIEEGSPLGQWFGQKALGIYATDEANAYIKNSDGSFGDRLIPVYQRDPNNYNNYIYGSNGKPIFSHYETKGGQKYTGDVGQMTTAGSVSKGGDIIWDDLDHDGVIGDSDRRILGNGMPTWYMGWTNYLNYKNFSLSFSFYGSFGNKIYNKQRRDLLQNSSSNMTPLARDCYRLWKYQGQITEVYSSAKATTGVNNARELSSFFLEDGDYIRLTNARLAYRVDRNFTKRFHISDLQLYVYGNNLLTWTKYKGFDPSSISNSNVLRPGIDNGRYPTAREIGFGLNVNF

SEQ ID NO: 10228 - protein, 937 aa, Bacteroides intestinalis DSM 17393
MKQMFFWKFVILSSLTQLARVSYLSGAEIILPLSGIHTGEDPELFTMLTTSPSGTSYTLRGEFTLKDFSGNSIHKSGGAFRNLEGNLTFIGTTPLATLNFTNLQLGAQGAGVFSKSLLTFENLKALNVENNQSAGGIITSSQDMFFTKNVHLLFHNNISCGAGGAILLAGTHPNRMVFREQRGMISFIKNHAKVVENITNSGNGGAISSEVAGSSILFDGNQEILFQENHAQSGGGIHNAQGTVEFSKNRNTITFIENKASESGGAIYASLCNINKQAAPVVFYKNSARHLGGAVYSQQMILKNNDESILFSQNFAEGGGAIASTSCNLTASHPITFSENTSGNLGGGAIYLSGPKPKLYLHAQNADIVFVGNLAHIVTKHVSTTNNNAITIKGAPELIRLIANENHSIIFYDPVLATAQSTNPININSIDNIFHCGSVIFSGEKIEINRQDKSNMTSICNQPVYLNNGTLSITSGAILAVQEFQQLGGVLNLSPGSMLTSYNSTGQDMIISNLSFGLDAARSHLPAEICATGNSEIKLSGSPQIHDPDNIFYDNHNLASQPYRMEIIFKSDKNINTEEFVPEEIAVHQNTHGYQGVWKFHWSGEESKKRKVLRALWIPTGTFILNPEKEGHLVPSSVWTTFAGMRSSNDAILDNYLNNNTLLPIKHMCIFGGVVSSVMEQTSDNPNNFSSTQAGHNLGMKLPLSSNTVVCATFTQLHGSSSQDNIPGKSHSHMLLGTVAAFKNWRALSLRSSISYAEESHVMKHQFSKKDITRGSWKNQGFRSTVGLSYAYPKGIRCLKITPFVDLEYTVVNQNPFIETGYDPRYFASSRLSNLALPTGVSLELRCFGAKYSLFTQFSMAYIKDLHRENPETTASLILNQHSWKVAGVFMGQEAMNLKFRATLKYRLATAYLGISTIQREGNNLSGDAFGGLSLSF

SEQ ID NO: 10229 - protein, 304 aa, Bacteroides intestinalis DSM 17393
MRKGTFVLLATKIHNTKNYPRLFFTLKPSFPFSCTAYLAMTWRWIGTRLKKSGLPAMLLMLLLLSAINQAQAGHFVNFQSIDTSLYMQFENRVDPRKTISPILEAFGDYSIGDMYVYSIWQNSLQSDYQGDKSTYYYKFVPRVSLSKVTGNDISFGPVKDILFAQWVAKTKGIDYDYFPGISIDWQASWISWLRTIFYFENNAKGSWNDQRIHIDYGIPFNNRLGDFRVVGTFDYTLGLHGQPETIDFKPELHYDLGKRLGNQPGHLWTGIVLNPIKNKYKIRDTPYYRTDQFSYGVFIRYSFF

SEQ ID NO: 10230 - protein, 616 aa, Bacteroides intestinalis DSM 17393
MNKKITIIGLGSLLTLPLATGTAGAAPQFDPMLEEVVVTASRTAQSVDESLAAVTVITRQDIEKGQYRSVAEALQGIPGLQFSRRGGLGKTTGINLRGTATNQTLVLVDGLRAGSATLGEASLQHLPLSQIERIEVVRGPRSTLYGSDAVGGVIQIFTRKGGPEREGSLSIGGGSRGTHQARAAIAGPHGDSHYSLAMGHLGTRGIDAQANDVPTPGGWGTTPDEPDRDGYRESSVSMRLGHNFSPGNAVEIHGMHARGTTEFDGTPDEADFRQQSAGINLQLRPADIWDITIRGGQTRDEIENYLAGGFYSRFDTKRDQLSLQNDLLLGDRQLLTIGIDYLNDQINSSDAYDRDRRYTTGLFAQHRIDLDRHSLQLGLRHEDNQQFGSHNTYDVAYGLQLPRNFRLTASYGTAFRAPTFNDLYSPWGGNRDLDPEDSTTYEIALQQHYGQGHWRLGVFRTNINDMITWADTGGGIWLPSNIGRARIDGLELESGHRLGQHWDIGLTLTLLDPQDRDSGKQLTRRSQKIATIDLDGNFGRWRAGMSLRANGHSYEDQDNDHRLSGYAVVDLRAEYDISDSMLLQGRIENLLDKDYEEVATYNMPGFGAFATLTYKF

SEQ ID NO: 10231 - protein, 720 aa, Bacteroides intestinalis DSM 17393
MKRTLLLTALSSHILTGLALAQETDTPRVEAPIIVTAPGPARSSDELIGNATALDRADIIGRLSGTLGDTLSGEPGVSSTFFGQGASRPVLRGLGAERVQVLTNGIGVIDVSAASPDHQVAADGIDADKIEILRGPAALAYGGQAIGGVVNVIDGLIVETLPERAVSGEAYGAYNGVNDGTELGGRAAFTAGPLVFSLSASKREFGDYDIPGLAESRQLRHREELEHEAEEAAEGEDHEHEEEALVEGSLPNSFLDTETFGGGISWVGERAFAGFAVRQQTSKYGLPGHSHAHGEEEHDHEDGEDHEDEEHDHDHAHEEEGAPFIDLKQTRYDFRAGINLDGPVLKAVTGTLSYSDYEHSEVEGDEASSVFKSDGVEGRVELDHALAGFEGAVGLQFLDKSLDASGGEAFLTPTDTTSWAVFLYETRDWDSGFGIEGGLRVEQLEHDNAVAGKAEFDLYSASAGVHQHFGDGWFGGAQVAYTERGPNESELFAFGPHLATEQFEVGDANLDKERGLNLEGTLRWRGDKASFGANVFHTSFSDFIYLAPGSIEEDGELVTEEDGLPVFAFSQEDATLYGGEIYGEYYINQGPLGADWKFRSGIDYVRGELDGGENLPFIPPLRVTAGADADWQRVMVGASVEWADNQRRVGEGQLGTGDYTLVNLKTALKLSEYGIGREGTQFFVEVRNIADEEARLATSVLRDTVPLPGRNLRAGLRYTF

SEQ ID NO: 10232 - protein, 1048 aa, Bacteroides intestinalis DSM 17393
MKQVNLRIYQTILTLLVGLFLSAGAYAQQISVRGIVKDQMGEPVIGANVLVKGTSNGVITDIDGKFALSAAKNDILIISFVGFMSQEIPVTGKDLMVTLKEDTGLLDEVVVLGYGANARKQDLSAAVGVLSNTDDLTVRPVSSTESLLQGQLAGVTVQSNGGDPTSTPSIVIRGQGSQNGDNVLWVVDGVPGAPIASMSDIESIVVLKDAASAAIYGAQSGAGGVILVTTKKAKAGIPTLSYEGTYGIRQATNLPEPLNAEEELEMRKRSYANANVTLPDGWNIEKNPWIGTTRTNWMDEIFRTAFYQRHNIALNVGTDNYSSRLSFSFDNDEGVLINTYNKNYAIRYNGKFDLNKWVSISEDLVWKNTENRSKDTNDAYTGPVLSAIYMPASATVYNPLDGTWGGTTTEDPEYIAKYGSNFAGAHGDAVNPVRLLRAENRFNRTSDVWSTTSLQIANIIQGLKFTSRFTYNLKTNNYKNFRPIQDEPGKPNNSNSLDVTNYRTDAWKTENTLTYDNSFGNHTVGALFSTTADHYNVRGLKVNGKNFADESPYLQYLAYAGTTSATDYLTGPDANVSLVARLAYSYDDRYFVTASWRRDYAGRLPKENNFGDFPAATLAWKISNERFFKKSDFIGMLKLRASWGRVGNLGSIDYNYKSLLLGTSYWQEQAQYGVINNATWNNFVYNSSAMNRNLTWETSEQWDLGLDVELFKNRLALSFDYFDKRTFNLIQKQTMNWPSSIGLDPLLINQGEIRNRGIEIQANWNDRVNKDFSYFVSGNFSYLKNWVSDIGVKNADGSPGVWTDSDSKFRNIPYTRQTAEGEPLNSYYLIKTDGIFQSDAEAAAYVDKNGKRIQPNAVAGDLKFIDYNNDGKIDDKDRQYCGSATPKTTYSFSFGATYKKFSFSAMFQGVGGAQAFYAAKSVILSDADGNFNRVKDILNAWSPTNTSSNIPRLSMNDPNSNFSTASDWYLESASYLRLKNLTLSYDLTDVLQKWSHLRERNSRMSVYFSGENLFTITDYSGMDPECGGWDAMKYPVSRVFSFGVKLTY

SEQ ID NO: 10233 - protein, 1109 aa, Bacteroides intestinalis DSM 17393
MKNILYQESIVEIKHLFRMMRNTLLALFVFAGTAFATESYSQTMKVTVVADNVSTGKVISEIEKQTDYLFVYNVNEVNLKRNVKVNAQNKSVAEVLNKVFEGTDIYYAMEGKNIMLMSKAKDGEAAQQANKITGIVKDATGEPIIGANVMVKGQSIGTITDIDGRFVLDAPKDAVLQITYIGYVSLEVKASGNKELNVVLKEDTETLDEVVVVGYGVQKKVNLTGSVSSVTSESLDSRPITQTSQALAGLSSGIMVTQSSGRPGGDQASLKVRGVGTFSSAGSDPLVLIDGLSGSMNDVDPNNIESISVLKDAASAAIYGTRAANGVILIETKRGKKGKTQVSYNGYIGWQSATQLPDFLDSWDYAAMRNEADENDGLSATYSPEEIQKFRNGTDPDNYPNVNHLKDLVTSGSGFQTGHNVTLSSGGEKLAYLFSIGYLHQDGIVAENSYSKYNFQLNIDNQILSNLHLKANLSGYSSTIDEPYTGDGDMSRMIGLAVREYAAIPGRKSDGTYGYQDLFCPEGWLDSDSFRKDSNKNFTGGMELTWEPLKGLSFSGKVGYNYSNYYNKRYASTLVFDENKTFSPNSLNVSNGNTTLTTLQFLSRYSKSIKEHHFDILLGVSQEEYKQNWGDGYRKDFPNDLLHELDAGSTNGQTASGSGTEWGLRSFFGRINYSLMDKYLLELNARYDGTSRFPTDGRWGLFPSVSLGWRISEENFIKETLHWVDNMKLRVSWGKLGNQNIGNYPYQNVLSLGINYPFGNTMSSGAAVTTLANHDITWETTSVFDLGFDFTILGGKLDFVFDYFDKRTSDILYNVSASNILGMTPSEVNAASVKNTGVEFNLRYNTQIGDLKLHLAPNFSYFKNRVASLANGKQQDIDKGLFVGESLDAIYGYVADGLFVNQEDIDKYPKQPYNAEPGFVRYKDISGPNGVPDGQVDATYDRKVLGSTIPKFSYGLTVSAEYKNFDFSLLLQGLGGFKKKMGNYQAYAFYNNGNIQRWQMENRWTEENPDRNAEYIKLTALNEGAGTIMTSSYWLRNGTFLRAKNLQIGYTLPTHLTKKVNIEKARVYFSGQNLFCISDFYKGWDPELSQDQSFYPITAVYSLGINLKF

SEQ ID NO: 10234 - protein, 1056 aa, Bacteroides intestinalis DSM 17393
MRHYVQLVIAAFAATITVYGQIATTTSLVGTVSDSSGKAIAGAKITAIDTATRDNYSALTNQDGNYRIDFVRVGEYDVSAEYPGFARFKHSGSVVNINQVVRNDFTLSPGSVQESITVEAAAAMIKTDDATISETITSKQISDLPLNGRNALMLATTTPGVLPGTKGTQGVPPGQDFIGAGTREIQNSMSLDGISIMNNLITTSPTQPMVETVQEVEVQTGTYSAQYGAYLGVHLNMVTKGGSNALHGNLVEFIRNDAFDARGYFLPATSNKTALRQNQYGFEVDGPVVLPKLYDGRNKTFFMGSWERLRNQRQSLSANNTVITEQMFAGNFSQTPTIVKDPSNNGTPFPGNIVPTNRLSPIALALQQYYVKPSNPNAITQNFTTIFPAKLTSDQTVDRADQNIGDRVRLFFRYQRQNQKIANGSAVPYNAAEIPSITDNYTAGYTHTLKPNLINDFRIGRQAINTDSVNYFYVNGIADAGTKLGIAGFDADSKSKNPGTPEFNVSGFTGWGNSGTNWFQLDHTWQASEQISWTLRNHSIMAGLEFRKLYTSRSAANSPRGVFSFNGQFTGYAPADFMLGLVQNLVTPTVQYQGDVATWRDGFFVLDNWQASRKLTLNYGIRYELQTVPYSVAGFARELNATQTAPVPDTVPAPGFRFHDPNHKNFAPRLGLAYRLNEKTVIRIGAGIYYNPNQTNSFTFLTTNPPFGNSTTCTSLPTTPTLSLSNPIGAGCNTAVSQNWITDNWHLPPATMNQWSFGIQRQLGKSSGLDVQYLGSHSYHLDRSFYNNTPYFPGPGAINPRRPNQLFGQIRTISNDLISNYDHLAISFHQRLFRGFQFDGSYTWSHALDVTSDSNNGGTPMNPYDWRRDYGNAPFDIRHRLVATYIYSLPGFKTANGFIRTALGGWQINGITTMQSGTPFSLSINTDAANTSSQGTQRPDLLKTPVYNCGAGHLLGCIDKSAFAVPGNIAQGIFAYGNSGRNILRGPHLFDTDMSLFKTFAIQERLRFTFRVEAFNIWNNPEFSNPNANIESATFGNITSTSVGSRVMQLGGKLSF

SEQ ID NO: 10235 - protein, 992 aa, Bacteroides intestinalis DSM 17393
MANRSALLRKHDPSIFYSHGMKKMSTKPLFKLKPITLAISTIFLPFTEAVADTESPSSNTEAVLELEAIQVQAKHEISRHDNEVTGLGKVVKSSEDIDKELILNIRDLTRYDPGISVVEQGRGATSGYAMRGVDRNRVAMLVDGLGQAQSYSTLKSDANGGAINEIEYENIKSIELSKGSSSAEYGSGALGGAVGFRTKEADDVIKEGQNWGLDSKTAYSSKNSQFIQSVAGAFRVGGFDSLAIFTHRKGKETRVHPAAEEIQHTYQPLEGYFNRYEVDQNSNGTPVRANAYYILADECSNLSDPSCRHAKAKTNRVGAPENNPNWTPEEQAQAAKMPYPTRTASAKDYTGPDRISPNPMDYQSHSFFWKGGYRLSPNHYVGGVLEHTKQRYDIRDMTQRAYYTKEDICHSGSSCQTLDKNETDKGNFGITLTDNPLDGLVYDAGNQARGVRYGRGKFFDERHTKNRSGIFYRYENPDKNSWADSLTLSIDRQDLKLSSRIHWTYCTDYPHVARCRASLDKPWSNYRTEKNDYQERLNLGQFNWEKTFNLGFTTHKVNIAAGFGTHRSTLQHGDLYAEYVTLPPYEEIKAYDDKGAFKTDTTPEDKLQYGNGSYDKPRVYRRKNTPELKTVNGCNETAGDNRDCSPRVITGRQYYLALRNHIAFGEWADLGLGVRYDNHTFRSNDPWTKGGNYHNWSWNAGVSLKPTRHFVVSYRVSSGFRVPAFYELYGVRTGASGKDNPLTQKEFLSRKPLKSEKAFNQEIGLAVQGDFGVIETSFFQNNYKNLLARADKHVEGLGYVTDFYNTQDVKLNGINILGRIYWEGISDRLPEGLYSTLAYNRINIKARKLHDNFTNVSEPTLEAVQPGRIIASIGYDDPEGRWGLNLSGTYSQAKQRDEVVGEKVFGKGGSIKRTINSKRTRAWYIYDLTAYYTWKEKFTLRAGIYNLTNRKYSTWESVRQSAANAVNQDLGTRSARFAAPGRNFTVSMEMKF

SEQ ID NO: 10236 - protein, 186 aa, Bacteroides intestinalis DSM 17393
MKVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPATFQMTYIPGTYNNGNVYFAWMRFQF

SEQ ID NO: 10237 - protein, 256 aa, Bacteroides intestinalis DSM 17393
MEGHVKGIQIGADLWPADEDSSHKLGVYVGFLDSNANVSGKTIYTSNAQLGSYQLNTYATGLYWRYTATQGWYTNTTLQLARYSGQVESNNSTRKPDIHGRGQILAFEAGYPRVLNEALTLVPRISVSWQKVKLDDYRYDDLNVNNDLDNQLTASAGARLYWNTMTISGVQWSPFLDAELNNQLTARDRNNVSVGSTGYQDSLLTSYNGSAAKISGGVTVKLNDYTNYYIKVDYQNGLSERSEKTWQGTTGVSLYW

SEQ ID NO: 10238 - protein, 690 aa, Bacteroides intestinalis DSM 17393
MILFAKHRPRVRLFSLRLQLYGLTVRDALFWNLKRNSRFSVIRPPSTDTPVCSNIHQLNYTGLDMNKKVFFAVMVGLLCSRGVFAEDALPSYTTDEVVVSATKTLNSISDAGGSSVTVITAEDIANSGKETVAEVIKGVPGIDIASNGGIGSTTSIFMRGADSKNVLLLIDGVPTNDPSEMSRAASIANLTVDNIERIEVVRGPLSSLYGASASAGVINIITKRGGVESSVYGGVEGGSFGTNKFYGGATGMKGLFDYAVNVSRYRTDGFSTVDERNRCINPGNAEYEDDSYENTTWSGNFGLKLSSVASLRTVLRYTDAALDYDAFNADSSVNSSDTKSFNGRVALTLDTKPLFSTFSYDFNSIDRDYTEGTTVNRYHGYLYDLGWQGDIAATANNTVTVGLNYQNESLDNNAWGTAMDKSVDTKSAFLQEQWHIGEFDLVGAVRFEDHETFGNKTTWRVAPSYVLGDTKLKFSYGTGYTAPSLYQLYSPASAWGPSGNDQLKPETSRGWDAGFEQKVVDNLKFGATYFRTDYDDRIDFVSGSGYVQVPGKTKTSGVESFVEWNPLEQLFLAGNYTYTYTRNPLGEELARRPKNKAGLTASWKATDKVKLNTSMQWVGSRIDSGAKDENCITTNKLESYFLANLSASFQVHENVELYGRIDNLFDEYYEEAWSYATPGRSAYAGMKLTF

SEQ ID NO: 10239 - protein, 238 aa, Bacteroides intestinalis DSM 17393
MIKCFALPSALALLFSGAAFADTVAAPETKKTADAGDAGYYATGRVIGAFDNAVNMELTSPRVASRVGGPETGSNVTGSLGLGYQFGNGWRAEGEYVFKRTNNFTSYWAPFDANANEFHVSAQRLMLNGYKDFDLGRGFSVYGTLGIGVAIVSADGWQTNDTRRFASKTQTNLAYSAGAGVSYAINKRFSIDLGYRYVDMGNIETGFNTFANRINARDEQLKSKLSSNEVFIGLRGRF

SEQ ID NO: 10240 - protein, 807 aa, Bacteroides intestinalis DSM 17393
MKKYIFFVVGAVCLLLSSTVYAEDLKSTDANIVGHVIEKSTREHLPYMTVSLKGTTIGTMTDATGHYFLKNLPEGEFTLSVSAVGYKSQERKVVLKRGKTLEENFELEEDMVALDGVVVTANRNETARRLAPTLVKVVTPKLFEQTNSHTLSQGLAFQPGVRVETDCQNCGYSQVRINGLDGKYTQILIDSRPIFSSLAGVYGLEQIPANMIERVEVVRGGGSALFGSSAIAGTVNIITKEPIRNSGSFSHTISNFDGSGSFDNNTTLNLSLVSSDSKMGAYVYGQSRHRSAWDSNGDGFSELPKLKNQTVGLNAYYRTSAYSKLSLEYHHMEEFRRGGSGFSLPPHIAEDAGLNGTGAPGLVEQLKHSINTGGLKFTAFSKNQKHTFSTYASAQHIVRNSYYSAYGMTTDFTGVLGAQYIYHFDKCLFMPADLTGGIEFNHDNLHDKATDVQKYRDAALAEDPTATGDRLQQLIEKYTPAPLNQVVNIASVYAQNEWKNEQWSFLIGGRVDKNSIMDKAVFSPRANIRYNPTQDVNIRFSYAEGFRAPQAFDEDLHISNVGGELVSIVRAKGLKEERSRSFNASVDWYHYFGDFQANLLVEGFYTKLSDPFVLTPPVKDPDGSAYLIQTRINGSGAKVYGGTLEGKVAYKDKVQLQAGLTLQRSIYDSPEEWSADEEHLSEKERYSDKILRTPDVYGYFTATYMPVKAFSIALNGNYTGRMYVPHLLSEVNGEADVLVKSPDFFELGTKIAYDFDFQGFCLQLNAGVQNIFNSYQKDFDKGASRDSGYIYGPGAPRSYFAGVKLSF

SEQ ID NO: 10241 - protein, 237 aa, Wolbachia pipientis
  misc_feature (163)..(163): Xaa can be any naturally occurring amino acid
MHYKKFFSAAALATLLSLSNSAFSDPVGPISDEETSYYVRLQYNGGILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQXSKFGFAGQVKAGVSYDVTPEVKLYAGARYFGSYGANFDGKKTDPKNSTGQAADAGAYKVLYSTVGAEAGVAFNF

SEQ ID NO: 10242 - protein, 974 aa, Wolbachia pipientis
MIIRIPELGLAIRRVLAMTATTALAAPALAQQAPEATTLDRIEITGSRIRQVDLETAQPVLTISRADIERQGFNSVADILQNLTATGSPALSRASPLSAGEASGGSYVDMRGLGPQRTLVLVNGKRLGMTTSGYQDISSIPAAAVERIEVLKDGASAIYGSDAMAGVVNIITRRNVEGVTASVYHGQYSEGDGARTQYDVVAGWSNERASISIAAEHVEEKGVWAKDRGFSAYTYTDGHPADGWTTVGQWGRITGFKGPGCSNSRGCSYSLDRGSQPGGPDSFHLSDNTPFTGDVSNSNEQMHLQTPIKRDSIFVDARMDLNEQVRFNTQLAYNRRTTTRQIAGYPFQSAVAGITPMSADSWFNPFGSHHGHESPSDVHWNRRTWEIPRVSVSELTTWQGVAAFEGSFAFGGRDFDWEAGYQYNRSELIQRATGNLHKQRVADATGPSFYNPATGKVECGTPEAPIAGCKPWNPLVPYGQDDPYGLTGNPELQDWLFPEELTRGRTTTRNLFASLSGSLATLPAGELGFAVGAESRREDGRFIPDALAQTGATTNLAAGPTGGGYRVDEAYLELSVPVLRDLAGARELSLSAATRYSDYTTFGGTLNSKFGFTWKPIDQLLVRGTWAQGFRAPTISNLYGGGSETFTTGFRDPCDTVYGAAASSPEVRARCAADIANADSYRQLGQGNEPITGSSGQTPLPFTNGSNPDLQPETSTSRTLGLVWSPSFAQGLNIALDWWKIRIDNTIVADHPNDILRDCYELGIAERCGSFTRDPELGIVNKLNYGSRNSGFRQAEGYDLEVGHKIETSWGTLSADWKTTYVVAAEERTTNEADVPPIPSNGIATNDGIGFRVRSNASLGWERGDFGLTWSLRYFSAVKERCLGLADYPNECSHTDQRAPWFSGTRDYNRRGSVTFHDVQARYNLPWDATVSVGANNVFGRQGPVMYSQPSANFSYYGGFDIGRFIYMKYQQRF

SEQ ID NO: 10243 - protein, 723 aa, Orientia tsutsugamushi
MRQSLSHPQISMSKRQISGRRFPVLALSLCSIAGVASFPAPAAEFDDELPAVEVRSRRHPNDPRVESVSTATRTASDPRDVPQTIDSVPVEETLSYGGRTLADALAGVPGVSNTSDTRFDAFRIRGFSAAGDLLLDGMRDDAQYVRSLGNIERVEVLKGPAAALYGRGSGGGVINRITKQPLPENFGHVSAATGSYGRLGASVDLNRMLSSAWSVRFNAGREHAGSFRDHVDGTRQYVAPSIKWRDARRSWLLQFEYDAYRRAPDRGMPAPVAAVDAAGKPFAFSLPSAPRATFFGAAGRDTIRDENMNWRSVFTHALDSDWELRHTLGVLNLRSTFDNTYVTQSYVAKPRDYRRVQRARYLQDMTHLNVQTGVELGGKVATGPALHHLLFGIEYGWQKRTPTLWQADAAPIPVTGPDRFALVGSTPRPYAMNRHRVSDYAIFAQDRVDLGRAWKLLGGLRGERFDVDSTNALNGLHARRTTAAWSPRLGVVWSPVGAHSLYASYSKNFAPVGGDLIGITPDARGNANDLGPQYTRQYEIGVKSDWRDGALSTTLALFQLDLYNRRIADPVRPGFFDLTGLERNRGLELGVAGRLAGNWFVRGGIGWQHARVVDAEPKYAGKRSAGVSASNGSLFVSHAPLRGFFAELGVVYEGARYADRDNLLELPAYVRWDGKAGYRTRDFEVTLAAVNLTDRDYYANATGLAQIMPGTPRTFTLTAAYKF

SEQ ID NO: 10244 - protein, 1461 aa, Orientia tsutsugamushi
MKNSRKISLIFFTTLFTISNITIIQTADNDPSASSSSSGGFTGSGASQSNNTTESSNDNQGDTGSGATSNPSNPSNPSNPIEGASGTTPATGASDATGVTETTGGSATGSEVTDGKKSKKSPFKKLKGFGSTLSLSGHTKSEEPSEGATGGKESSTSTLKRLRKQLGSTMSLSSTTPGEPKAPIVLSDSTNKQVEVKQNKGSGVQKVVVKQPEVGFEKMDGKGNSIEISVEENAKVTIKGEDCYRIKLANLNLTDSELIVNNTLYSNSELKTTSPITSSMSMPNLSDTDVSSSSTSSRRSSSIIHSAGQSPFDLSFFSSTAHGGKTESTDRASFTGIGSFVVQSPTILSSDLNICGNINVTKPFQLLTVPPVMLKTLTVERSKLVPQKSGVLNLQSDLTANIEVKGATVVASGSSTKISFNKFGTPNNPIPVKVDGVLKLQAELQSSGLKTVDMYASITPKKQSASEVHFLNSASSTSLTTYHVHGFIGTPDFVTGKILVDGETVLNVTGNLYTQKLKLNSSNKVSRGDSDTHGCIVLNGEMYSRSVEPSVSNYGKLIIHGNPSTKYDPDHYKSIFYGDIGTGRSKIHRIEFAEHSNNPNGIRPYTNWFISYDKSMNKSSIFCSDIIFSHPEDTINVLGNTVIEGNIGTKGHSGGKIIVRNNGTLTHNGGDIGNTKISNPNSLQALCLCENASFVSMPGSNSIPYTCNIKEITADQNSYIELNSNADWNANIIPTGPGAKLTMSQGSYSGNIGTKDKPMLNVTLLPKSKRQSLIEVDGSVHTKQFSISDKSSARGEMALLGDYTVTAQTSDGSGNINVGNASINLGINTLALFGDNIIILGHKSNKGSSTNPKKFDKKPVTVFSIGYTTNSDGTVKTQGKLKLSKHYDPSNKIVLNVVHQGDSRDLSKHGPQTIIQPVDIADTGNLDVSGLIYVCDGKCKWQPVPGSDGQLAFAGLVDKKKKDKGDDGASSSSGSSSIAPSARVSPEVSDGEEGGKDEDIQASAASHLHSKDSAHSKQSQDKDHTEDPENPEDTTEAAIEELARRLDDPILSRRAAEQPQPDPAEQAQPVVAQPLAAGAGMQRQQQQQQQQQQQQQQQQQQQQQHISSGVQPQQHLSSPYSDDQEQSSEQAVALQPILQRTASDAPLKGGVNITVAAISSIVESRASNNKSVSDIVSSGSNINKQSWNIWADGFFSNVNQQDHKHIQGYKTDISGISIGADKHLKNNAIIGAAISYAKFDTKHTDSRIEKINSNVYLLSLYGQYSFQSTTFIRGMINVAKFSDDSKNSSLTLWQGHSYHGSLTAGHYFYPLKNNKKLSLVPTVGIRHSYFNTSGNKSVDNSSNKTIGDRSHKALEGIIGISLEQLVVNNANNNLNVLSTVYGYVHHNLYDCQDGAQLPNINSTFNPDVITSREQCLHKTFYQLGVKLAIKRNIMDIGIACDVYLAEKYISHTGIIYAKASF

SEQ ID NO: 10245 - protein, 279 aa, Orientia tsutsugamushi
MKNNINNNECYFKLDSTVDGDLLAANLKTFDTQAQGISSTETFSVQGNATFKDQVSATGLTSGTTYNLNAQNFTSSQISIDFKNNRLSNCALPKEDCDPVPANYVRSPEYFFCSKPLIGDFDFNSGESYLPLTGSEYTLYQSRNVNSIFRFIGWKQSTRELTVGGNTAIQFLAAGTYIVSFTVGKRWGWNNGWGGAIYINNGLGQVQCESTIYSGGGYATIGTLGTSIYRASVDVAPNPNDPNASDRYRAGIFYLSNGGSSAGIGNYSFSLLYYPDDRG

SEQ ID NO: 10246 - protein, 760 aa, Orientia tsutsugamushi
MYLMIKINKKVALVKVSLIFSALFFIGNAQSIFNVNAQPNSTKQNQLNNKINQIDARKSQLLLQQQNLEQDRDKIYNSIRDKIYNGINLEDIKSYSDVCRKLLLHPSDQVTVYLDEHDQYDTHNLRPRSNMLYRHINETANFINNMLGLIDIDIVPNYTNRSATLAEMKDYEKQLSDKVNRFGNRIHGGVNNAKQRYRAVTIEIDELNQNQELRQFHTALRDVQAKIQALSLASLNDLSTEARNLHLDIANQLVAIDQSIQACERGSNSMLNLDQQYEQWLDNLYSTSEEIVLILQTHVQAGAQAIPQDELNQMHKQMQDIKKLMPKFKQDLSMLATQLRNISNLIATFDHRAEIKPDENGPVQPGLSDNIREIINDFPQALQQYKNNLENNLKSINHKIANIDQLVSYLNQQLDTLQQQQLLGDQIAPTKANASFEKQQLLYQAQNNAMLANAISFTADTAVNATTSILSKIATVQNQSPKIISSGSNIYNSNGWSIDGNVFCGKTKKTEHKEIKGYNTDISGAFITVNKYLNKKVVIGVTGLYSNLDITYDQNVILNKTNCKVYSLSLNGRYYPRQDIFMQSIVGLIKYDGTTRYYATVQPSSNINGKGWYGDFMLAVNVYPLKNNSKLTCSPIVGIAYTNSSHAFETTIEDIDYNILTGRAGITIKYVIDNINNNMSIVPEFHAFIHHLLSVKSKQLEYANSSNISDIDEQIPKSFGQLGVAVTIWHGKVGVGVSYNAYLANEYISHIGSVNMKASF

SEQ ID NO: 10247 - protein, 315 aa, Burkholderia multivorans
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 10248 - protein, 387 aa, Burkholderia multivorans
MEQINSNKKHSNRRKYFSLLAVVLFIAFSGAYAYWSMELEDMISTDDAYVTGNADPISAQVSGSVTVVNHKDTNYVRQGDILVSLDKTDATIALNKAKNNLANIVRQTNKLYLQDKQYSAEVASARIQYQQSLEDYNRRVPLAKQGVISKETLEHTKDTLISSKAALNAAIQAYKANKALVMNTPLNRQPQVVEAADATKEAWLALKRTDIKSPVTGYIAQRSVQVGETVSPGQSLMAVVPARQMWVNANFKETQLTDVRIGQSVNIISDLYGENVVFHGRVTGINMGTGNAFSLLPAQNATGNWIKIVQRVPVEVSLDPKELMEHPLRIGLSMTATIDTKNEDIAEMPELASTVTSMPAYTSKALVIDTSPIEKEISNIISHNGQL

SEQ ID NO: 10249 - protein, 892 aa, Burkholderia multivorans
MITNQRRWSAQFFAAALIPALAGASLLGNVAQAKPVETSSEYSKDIFARALPTAGSVGIEAAKKLLEKTSNAAADLQYRPPLWDWTAPATVPSVTAQATPPAPPAAPPEPAADTPDQDDDAAAGDILDEVSVTATRRLTRARDTTATTYTINREDFQKQGATTVTDALLLVPGFVGQPSLGGIRNSGANFLRGFDDQRFQVLKDGLPLQRSSNNRTDVSRFQVADLERIEVVTGGATLRYGSGAVGGVINLITETPKGPPKLTLSYEAGSYGFSRYLAKYGGGDDTFSYNLVFTSTVAFNNYPFSYTLPNSAQFYPQGTIVPNPNFASDPENQPETVDLFGYLQPEVGPPIKVQGVADVAFNASDTYSGKLTFKPDPSNRLTFRVSQQNSRNAQNGPGTYSFSSCFGGPSTLPNGTLNLDRFLPLDANGNEVACSPQRFLVNTRSNLLILGGSPFTYTRSLSGVPLAPGQAYPTAEGAIGTIDFFAVTSQSQTEVALQWDYDITPTTSLNSYIYYFKFSGNGSVPPQFGVNTDILGGAPSLSIPPLSQPFFEGQLFAIESVLNHRFSPGGNIQFGVNVREDRSYQQKAGGSTFFDRAFTRSSVFAIADISFSDQFKANLGARFTYSNQYGTVGTPAVGLRYTPANFISFRTNYSYVFNSPSLSDLFVGSPQGPFFQNPNLRPEAGVTWDAGIDLTPAPNVGIRATYFNTYLDGVISTVVFPNPDFISFIATPGFNPLLQQQRNLASRYASGLEVDARWQVNPEVSLRAVWTNQDARPYGLSDDPTQSTFPFFYGFQDPFIPFNNVVVSATYANKGLTATLLGRYDGGKRRFASTEFVANWFTLDLNVEVPISSFFILTGSVFNITDSQYESIDGIPAPGTTFRVGGRFEIGG

SEQ ID NO: 10250 - protein, 452 aa, Burkholderia multivorans
MTVSFSGRVAAVVGGVLVQSVALASMGNIGTTYGVLPSDIASAQALSLFNDQVSATYYNPAALAKDPRGELTTGLMHAEHELRAKSLGGADAPIRNGDVLQDSPSQQILLGMKTDLTSLTQYNHPIYFGLMLGVEKYGEEMLAFDSSTSQQGQYFEYGRQPLFLNLGGATQLWRGIDVGATARITLHAAADLSATTDLAGNTQYEELDVSAKPSIRPIFGINMDWGETFCGEGDDCWFNGLETAFSYRGYSNTQTEVNANAVIPGVIPNPGLMLNINTLDSYQPNILAGGVQYQAGRWRTGVTIEWQEWSALEEEFENDTIKDQAVSGQPGQLTFQDVIIPRIGTEFRLNENFSFTGGVAYSESPLESNASVDVNYLDTDKWIIGLGVTAKYKKTRFLAFPVRFDLAYQHQILEDRTFDIYDTQSAVYPQPSEQVEASGDVNVISGSITLKF

SEQ ID NO: 10251 - protein, 736 aa, Burkholderia multivorans
MCRRFVGGLVLVLALIPGVAPAQPAVVEGQVRDAQGAPVPYANVQIDGAAVGTAAGEDGRFRFETTRTGSVVLRASAVGYPPVEQSLRLRAGDTSTVRLTLRAESIELGEAVVTGETFSTGSPSEATLGSTEAVTTPGAAGDLFRALQSFPGVAAPGDGAGLFVRGGDVTETKTLLDQATVYHPYRYESPAGGSFGAVRPFLVGGTTFATGGFSAQYGNALSGVLAMESKDRPEESSRYVNLGLAAASVSLDQPLVGDEFGLRLSGNRSFTGVLFRVNGQRGDYATVPQGMDGTLGLTWDYGPTGQLKLLAFARRNRIGVETTEGTYTGVYRDRTTNQLYNLQWTAQAKGWTVESSASWNAYTSQKTLGALDLSPADRAAKLRVDATRGGGDWTVRTGGTVERRHYRFDGTVPTQPDVVAPDAPTRSVDESVRATRAGGYVEVESSLLSSVVARAGLRTDVHSRAGRPVVDPRVGLAWSFAPNTQLRAAWGLYHQFPELSTYGEHVGKNTLGAQRAQHVVLGLRHEREHLLLRAEAYHKPYRDLVVRTGSSRYANDGTGVARGIDLFAKYGSFLGTRVNGWASYSLLRSHRTQPRDRGTDVKLDDGPAPYDLTHQITAVGKVRVIDQFRVGGTYSYVTGRPFTPVVGTERLESGALLPVDGPVGGERLPAYHRLDLQVSYFWPFNRQQNVVVYAALNNVLDRANAVDVTYSPDYSTRRYRRTDFRRSVYFGLTLTL

SEQ ID NO: 10252 - protein, 275 aa, Burkholderia multivorans
MRHILLGAVALTALCSSAVAADLPVYTKAPVVVAPVFNWSGFYVGGFVGGAVADGNANSTEPRGAAPAAPFAPVFYNATAFDNNYSLSNTFIGGGTIGLNYQPSASNWLFGVEGEVGYLKLSRSVVDINPVPAGAPGADSIDRTRIGDLYGVFAARLGYAFDRVLFYAKGGAAFVGKEASFTDKCAVAPCSVNTLNTDYSGTQLTWAAGGGLEYAINDSWSVKGEYLYLATKETYTYSANASNNQPYTVSHTDPGVHTGKIGLNYRWGGPAVGRY

SEQ ID NO: 10253 - protein, 748 aa, Burkholderia multivorans
MKSRSDESKLGKFTTLCSVLAAGPAFAADGAPPPAPADAEGHLAPIEIKGRAEHSYKADFSASAKFTAPLVDTPKSVTVIPQELIQTSGASTLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFADHAAFRLNLMSHNNDVAGRDAVNNERWGVAPSIAFGLGTPTRVTASYYHLSTDDLPDGGIPYFYTTTNKPANVDTIYPAPVDRHNFYGLIDRDFRKTTSDISTLRIEHDITPALTVRNTTRYTESTQDYIWTQPDDSQGNVINGKVWRRNNNRNSSINSIANQTELFGEFRTGPFKHSFTTGIELSREWGKRDTYTVATGTGAICNNGIGAPSGYNCTSLWSPNPADPWAGSISRNNDYAHARTTTKSIYGFDTIELTPRWQLNAGVRVDDYSTRFTDTKANGGKTYTRDDTLFNWQLGAVFKPAQNGSIYASYATSSTPAGMLLGEGSETQSLTPGRGGVGSNADQLSPEKNRSIEVGTKWNVLNDKLSLTAALFQIDTTNARVTLPNNQYAMVGNKRVQGLELGVAGQLTKQWQVFGGYTYMKSELRDNGKDTANNGHRFPNTPKHSFTMWTNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 10254 - protein, 732 aa, Burkholderia multivorans
MHSLFNGARGYTLALPLVVLCSVPEAAPAQTPPTDPLPTIVVEESRVRPPARRRAPRVEPATVPAQVTPDAAASPNVASAGVPSQALLTAQQALAQINRTPGGVAIVPAAAYRNSSVASTIKDVLDYVPGVFVQPKWGDDTRLSIRGSGLSRNFHLRGVQLYMDGIPINTADGYGDFQEIDPTAYKYVEVFKGGNALRFGANSLGGAINFVTPSGRDLWPNGVSLDLGAFGYRRLQANAGGANGPWDGYLTASTQSAEGFRDHSDGHATRVSGNVGYQVSPDMETRFYLNANEVRQRIPGTVTRTVALNSPQTAAANNIALDQQRNIDTLRLANVTTIRLDHTKLEFGAFGVDRHLKHPIFQWLDYRYAEYGGFARATDDRDIGGFRNRLIVGVNLHNGRIDNKQYVNVAGSKGALASSAIDRSKNLAAYVEDSFYVLPSVAVIAGTQFLHATRNRQDRFLSDGNNSGATEFNLWSPKAGLLWDIDPTWQAYANLSRSAEVPSFGESASGAGIPTIPFTSIRPQRATTYEIGTRMNRPDYKWEVTGYRAEIRDELMCLYSAFGNCNVTNADRTVHQGLEIGGAAAIFHGLFDRSTAPDKIWLQLAYTLNDFRFDNDALFGNNLLPGAPRHFVRAELLYKHANGFYIGPNLEWVPQAYFVDSANTLKTEPYAIVGLKAGIDNGGPISAYIEARNIANKSYIASASIIDRATANSPLFEPGTGRAVYAGVKYRW

SEQ ID NO: 10255 - protein, 694 aa, Burkholderia multivorans
MRDLPRLPLRPLSSLSLMLFAAVAHAQTDAPGASGTPANASAPLAPIFVTANPLGDTELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIQGVTGALDARYGGANSVRAGAAQVEGGNGRFAFHVDAFDRETSKLRIPGYARSSQQRAIDGPDTPQPEGNVPNSDGRVHGGAVGASYTWADGFAGLSYSGYESNYGSVAESDVRLRMRQERLALASEVRNLSGPFTTLKFDFAYTDYRHKEIDNGETATTFRNRGYEARIEARHRKIGPFEGAIGVQFGQNTFSALGDEMLVPSTRTNSVALFGLEEWQVVPALKLSLGGRFEHVKVDPDPAGVEKFAGAQPRDFNAGSLSAGALFTLTPVWSIAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGIELDGKWRAFSRRGHTVDLELTADYTHARNVDTGQPLPRIAPLRATLAADYGYGPFGARAQVTHAWSQHRVPDDDFSTDGYTSLGVMLTYKFRVGPTHWLAYLRGDNLTNQEIRYSTSVVRGFAPQGGRSVMAGLRTTF

SEQ ID NO: 10256 - protein, 1833 aa, Burkholderia multivorans
MTLYGEGAFPSITDLAAHAQVSRATAYRYFPTQSALITAVVAESLGPILAWHPQDDDALKRIQQLLTLAYPQMERHEGALRAALQLSLQQWAHATPGEKFVRGNRKRLLALAVEPLQGKLPPDSLQRVIHAFSLIYGSEASSYIENGKAGDPASWRSSEFNAEWGLGAIHADQAYAAGYTGKGIKLGIFDQPVYAKHPEFAGENKVINLVTEGIREYTDPYIPVKKGDTFRYDGTPSVDSDGTLGSHGTHVGGIAAGSRDGGAMHGVAFNAQIISAENGDPGPEDGIVLGNDGAVYQAGWEALVASGARIINNSWGIGITEKFDEGGYDPAYPHFTVNDAQKQFDQIKQILGTKPGGAYQGAIDAARSGVVTIFAAGNDGNLNNPDAMAGLAYFVPEIAPNWLSVASLQDPTNTGDYSISTFSSRCGYTASFCVSAPGTRVYSSVIEGTSVENLTTGYAKYSGTSMAAPHVAGSVAVLMERFPYLSGAQVAEVLKTTATDMGAPGIDALYGWGMINLGKAINGPGMLVTAEDIPAEFRIPDPTGVAYGPTQFVVDLPGVGAVLDKGKPTERVCSDVLCGLDVWSNDISGHGGLTKQGIGTLVLTGNNTYSGPTLVNQGRLAINGSVTSDVSVQSGGIVGGSGTLFAEAGYSVRGEWLNLEPFVNLAYVNFENNGIAESGGAAALRGDKQHTDATVSTLGLRADTAWQVTPGTTVALRSELGWQHQYGGLARGTGLRFNGGNAPFVVDSVPVSRDGMVLKAGAEVAVNENASLSLGYGGLLSQHHQDNSVNAGFTWRYAQAAPHEVNGQPGDPASWRSAEFNANWGLGAIHADEAYAAGYTGKGQKVGIFDTPVNRHPEFAGDGKLINVVTEGYRAYTDPHRPGINAGDRFYFDGTFHFYSGSQGMLSNHGVHVAGISAANRDGVGMHGVAFDSQVISVDNDNDGPAYGEFLGLDGAVTNAGWQAMIKSGVRVINNSWGVSIPDFLSDGGRDPNALHFELKDAQEQFDQVKPLLGSLAGAGYQGAIDAARKNILVLFAAGNDGNYNQPDVISGLAYFVPDIAPNWLSVASVAQDAASANSVPYSISTFSSRCGYTASFCVSSPGTRVYSSVIEGTSVENLTTGYAKYSGTSMAAPHVDGSVAVLMERIPYLSGAQVAQVLKISGTDMGAPGIDALYAWGMINLGKAINGPGMFYTVEDIPAEFRIPDPTGVAYGPTQFVVNIPGLGAEVDAGTLHARKCDDISCELDVYSNNISGHGGLTKQGIGTLVLTGNNTYSGPTLVNQGRLAINGSVTSAVSVQSGGIVGGSGTVGSLTARRGGTVAPGNSIGTLNVAGNVSFEPGSRYAVEVGPNGQSDRIQSSGSATIGGGEVAVTLENSANLLTQSEVRSLLGQQYTILSAQQGVSGQFDAVVPNYLFLGTGLSYQPAGVTLSVGRNGTSFASVAQTPNERAVAAAADALAAGNPVYESLLNSGTAGEARQAFRQLSGQIHADIASALVNDSRYLREALNGRLRQAEGLASSSAIKADEDGAWAQLLGAWDHASGDANATGYQASTYGVLVGLDSAAAADWRLGVATGYTRTSLHGGYGSKADSDNYHLAAYGDKQFGALALRGGAGYTWHRIDTKRSVNYGMQSDRDTAKYSARTEQLFAEAGYSVRGEWLNLEPFVNLAYVNFENNGIAESGGAAALRGDKQHTDATVSTLGLRADTAWQVTPGTTVALRSELGWQHQYGGLARGTGLRFNGGNAPFVVDSVPVSRDGMVLKAGAEVAVNENASLSLGYGGLLSQHHQDNSVTPASPGASDVQRSLQRPRSRHAGSVFICGGGGRTYDGAASGQ

SEQ ID NO: 10257 - protein, 397 aa, Burkholderia multivorans
MNKQLIAAPLLLSLAGIASAQSSVTLYGIVDAGVTYRSNERVGSPGAYTGHSEVGLTTGNLSGSRWGIKGSEDLGGGMRALFVLENGFDVTNGTSGQGGRQFGRQAFVGIGSIRYGTVTLGRQYTSLNDFVSPVAPSSFIGGFGAHPGDIDDLDQTARVDSSIKYTSANYAGFTFGALYGFGSQPGSMKQRNTWSVGAAYAAGPLRVGVGYERSDNSKTGATDPTAGKWQSTDDGLFNSSINEGYASAQSQQVIATGATYNFGPAVVGVNYSNIQYRSGAQSLFSGHATFNVAGVFTRWNVQPQTQLFAGYSYTRGSDVDGIDDRAQYHNVTLGAVYDLSKRTSVYLLGAYQRASGTTLDALGRPVAATAAVSDKANGHSSDSRSQAIVSLGLRQKF

SEQ ID NO: 10258 - protein, 490 aa, Burkholderia multivorans
MKKQKTIGTASKMLLAWGLPALAGVSLTGVAHADDAAPAPLTVAQAAPSAGASTTVAQATTPNAVINAEATQAVTPPDEPSAQSKSKGFIADSHLDFLFRNYSDVLDSKGGPHRHAWVQGAMANFESGFTTGLIGIGFDASLYAALKLDGGQGAGSMVHIAKGGGGGNQLAWAYPGIYDIKARISNTVVKYGLQAVDNPFMEQHDNRALPPTFLGATIVSNEFKNVMLEAGSFTKTDARGHTTLTNLTTQYGGTRINRLTYVGGTWDYSPNGEVALYANQADDVWRQYYASVKHSIGSTQTIKWTGFGNVYSTHDTGDALQGKIDNNAYSLSLAAQHGPHELLLGFQQVLGDQFFDYLNETNGIFLTNSMDVDYNAPHEKSLQLRYTFYGKEAGLPGFKAMVWGVTGWGADGSAGAANDPSKSSIYWSNGAPVQGRHHEFGFIPSYTFQSGKLKDTKVTFIAMWHNGSMHSSDATNREYRLVVNVPLHAF

SEQ ID NO: 10259 - protein, 379 aa, Burkholderia multivorans
MKHTKALLAAGACALAATNAHAQSSVTLYGIIDTGVEFVSHANAAGDHVVRMPAVTGELPSRWGLRGTEDLGGGYQAVFVLESGFNVRGGDLGQGGRLFGRQAFVGLKGGFGTVAFGRQYTMTYLALQGADIIGPDIYGLGSFDAYVPNGRADNAVTYIGTYRGVTLGAAYSFGRDGAGTGNSPGQGTCAGQVPGHAVECRNWSAMLKYDSAYFGAAASYEEQRGGTGAAANFFDGVAPVPFTSSAGKDARVHVSAYAQAAGARIGAGWIGRRVSTGSPAAAGAHSDLFFVGASYAVKPDFIVDGEGYRIVNSAHDTRATMATLRATYLLTKRTSVYAQSSYLWNSAHARYAVSGGGPGTTPGEGMGQLGAMVGVKHMF

SEQ ID NO: 10260 - protein, 362 aa, Burkholderia multivorans
MKILPRTFLIAGCGASLVSLAHAQSSSVTMWGQVDSGVTYISNKRGGASWGTASGIGAPTRWGLRGNEALGGGYRAVFALESGFNVNTGMLIKSNTLFDRQAYVGLDGPFGTITFGRQADLMDDVAIRYSNAFWNRSLYAFHAGNLDSLTNGYQIENAVKYRSPEWYGIRVGALYGFTGSDATGHSAGAYATYDRGPLSVGVTYMTTQRRVLDLYNYFGWTRFLDQTLSAQKTFQSNEVNNLGIGLTYRITEPWHVNVLYTRTDIKGARTATHMQNIDVGTLYQFTAAEAVTLDYTYSRLDGMHWNTLEAGNLYALSKRTQLQATLTWQLASGNGATAATYPNGPSSGRSQLLAHVGMTHSF

SEQ ID NO: 10261 - protein, 1123 aa, Burkholderia multivorans
MKESMCSRWHLRLIVLLILFFPLTLSAAQGRVTVKGQSITLRQAIKIIESSSNFKFFFNPSDLDALPGKNLDCEGEISDVLKEVFAGSGISYVIMGDDIILKLEKKAASTQQKKVEIVGGVVDARSGESVVGATVRVKDVNSGVITDMDGKFTIKATPGDVLVISYIGYETKEVKVVNGKVLLVELVEDAKQLEEVVVTAYGSGQKKASMVGSVQAIRPAELQVPSASLSNSFAGRLAGVIAVQRTGQPGADGSDFYIRGISTMNGATNPLIILDGVEISSGDLDNLDPEIIDGFSILKDATATAMYGTRGANGVMIITTKSGRNIDKPIINFRVEGQITSPTSKPKFVDGATYMDLFNESLLNGGSTESPYSAEEIAGTRAGLNPYAYPNVNWYDELFKDQAFNQNFNVNIRGGGKRVDYFSSVTVNHETGMIKNRSKDFFSYNNNINVMRYSFQNNINAYLGKDSRLSLRLNVQLRKTKQPNISMNDLFAGAINTSPVEAPIYFPDDGVTTHIKWGVNDRLKPGQQQNPVAQLASGYQDNFRSTVVAALEFEQKLNFITEGLRFKALASFKNWSSTTNSASAGWNKYHLQDFSVDDNGVYSFVTRLQNESGGEVSTDLKPGVANSGDRRFYFQAIMDYNRTFGKHDVNAMFIYNQDELVTQLFSGDLIAALPKRKQGVAARLSYAYDGKYLAEVNMGYNGSENFAKGHRWGFFPSIAVGYNISEEAFFEPLKNVFSNMKIRASWGLVGNDNIGGARFVYMPTINLTGTGYTTGLDGDITYKGPVYSRYGNPEVTWEVGKKVNVGLDLQLFNSLNLTMDYFHETRTDIFQERGTIPQYLGTAGTKVFGNLAAMKNQGFDFAADFNKKIGKDWFISFKGTFTYAHNEITKYDESPKYAFQSKVGQSANIPSIMISDGLFKDPDDVKNSNQQIGGNLSAGDIKYVNISKLYGYDDDIVDISDWVWAKNPTVPEIVYGFGPSIRWKNLDFSFFFQGVAKVSLVMSDFHPFGDNSLRNVLTWIADDRWSPDNQNINATYPRLTRDTSVNNTQRSDYWLRNAAFIKLKNAEIGYTYKNMRFYVSGMNLATFSPFKHWDPEQGGGNGLKYPTQRVFNFGFQMTINNNR

SEQ ID NO: 10262 - protein, 967 aa, Burkholderia multivorans
MQTAEVAIAPNIRVILKTDSKALDEVVVVAYGTQSARTVTASVSTVRADALKDVPSVSFDQMLQGRASGVSITTPSAGVGQAPIVRVRGVNSITSGTSPLYVVDGVPIESGNLSYLANANALADINPADIVSMDVLKDAAAAALYGSRAANGVILITTKQGQSGKVKVSYDGFVGFSNATDFYEMMNAQEYVDFKNLAVKNRYGTDELSLTTGYVSPYGNKAFNMMKDANGNYVDTDWKDAAFQNGLSQSHSVAVSGGSDKVRYYLSGNYTTQEGIVKGDKYDRLGVKANINVQATDWLKVGMNTNVTTGTTSYVDAARRGSNFAVGGFPRLALINAPNLPMYNEDGTPYYLAQGLGYGGNTVFSTFSNPAAILSLGNGLSSDVTRFIGVFYAEATPLKGLSLKTQYGVDYARIEEQRFWSPLHGDGVNSKGLANAYNTKNNRWTWTNTATYNFSLGQNNFNLLAGTEASERNNSRWTAQRKDLQDDKFVVFQGPFGSATAGGSLSNNTMVSYFGRINYDYASKYIVSLNYRRDGYSALSEKNRWGNFGGVSAAWRVSEEGFFKPLRNVVDDLKIKGSYGVVGNTDIYDYASKSFYSSYNYGINGTYGLAQIADPNLKWESSEKYSIGFNARLLDRISVDFDYYYTKSSDLILDVPQSPSKGIPGNIITTNAGKMKNSGIELTVSADVIRNSQFTWETSFNITTNKNKVISLADGVENILKGDNGGLEITNITVPGKSIGRLYLYPTAGVDPKSGRRVFITPEGDRTLLMFEKGGWFYEDGTEYAGEFEPVDCGNTLPTWYGGWTNNFKYKGFDLSLFFQFSGGNKIYNGTKASVSDMRYWNNSKDVYKKYWTPERTHAEYPMPIYGDNYSNGSALPISDLVERGDYLRLKNVSLGYTFNTKNWSKAVGISALRLYVQAQNLFVITGYSGMDPETLTNVESATLSGGTDKNTLPQARTYTIGVNLTF

SEQ ID NO: 10263 - protein, 707 aa, Methylacidiphilum infernorum
MKGTKRFEQSRQHLLKAGDAMIRKPLAVAMVGVLAGMTSVWAQAESKKEPVQLETIEVVASGQGSLTVPTLVEAQHEMRKIPGGANIIDSESYANGRGSTLQDALGYSPGVFVQSRFGAEEARLSIRGSGIQRFFHLRGIKILQDGSRVNLADGGADFQVIEPLAARYIEVYRGANALQYGSTTLGGAINFVTPTGYDAERFRARGEAGSFGYNRLMLSSGGVHGSLDYFASVSRYSQDGFRDWSEQENWRMFSNAGYRITPDLETRFYLTYTKTNSQLPGELTKAELKDNPKQANFFNSNIARYKRDFDLIRVANRTVMKLGEAQQLEFSAFYAHKKVWHPIYVVMEQPSHDYGLGLRYINEMPIAGWRNRFVAGFEPSWGKVMDNQFVNINGEAGPRIHKYDQDVSSYTVYGENQFYLLPELALVVGAQYTNMTLKQKDLHTGDPRQKKNYERFTPKAGLIYDLNPEIQFFTNVSTSFEPPSFSELASWQATPVLASAQRALTFEVGSRGRFGIAEWDVAFYRSHVRNELLARVDPVSRFPIGMVNADKTVHQGVELGLDMELAKMLYLRQMYTFSDFKFDGDPLFGNNQLAGIPRHFYKAELLYRHPAGYYAGPNVEWSPEKYYVDHANTLSVDTYALLGFKLGKRNKTGFSWFVEGRNLTNQKYAATVSVTDIAGVGAFGGANSALFFPGDGRSFFAGLEYRM

SEQ ID NO: 10264 - protein, 420 aa, Methylacidiphilum infernorum
MNLLPELAALGARIDNLESRVAFLEDHQFSTTTKLNGEVIFAYANAFSDDYAFDSTFEDRSLRQQDALERGRRVGREGVFVDRVRLNFDASFSGKDRLRVRVESNNTPNFTSATGSAMSRLGFDSGTDNDTFVTDLYYRFSPFRNFTAWVGTTNMGLEDVFNPGNPYLEPSGTGALSRFVRRNPLVFRGPDGNGVGARYKFSDFISVTALYLADENDARSPLPGQGVFNGDFSAGVQAVITPFDRFNINLTYLHSYFSEGSVNLSGSTGSRITQDPSTAFLGLGTIPSAWNRDSVGAQIDWQALDWLHFTLWGGYAYAEAKNPNYDSNGDIWTWNAIVNFVDILKEGAVLSFSGGMPPRITGVNNGPDDEDTSIIVEAQYQYPISDNILITPGFYVILDPNHFERNDDIWVGVLRTTFKF

SEQ ID NO: 10265 - protein, 833 aa, Methylacidiphilum infernorum
MTIQKLSSVRSGATICILRWRLGTVTPTRILSICLTALPLSIIPRSAMAQTATDSSVVQDVVVTAPSLSEVQATARQSTAGASSIVTQQRLEANQITNLVQAQRFQPSLQFKALNIQNLTYNIRGFGNASYSQLLGVFGGVPIYLDGVYLPRPGASTMDIVGLNGVEVLKGPQSTSGGWDSTGGVVLMTTAAPTFTPEQKLEFSYGSYNFARLRASISGPIGGSDKAAFSVGYLNVDREGYIPDVHDFSHRFNSWHDKSVRAQVLLQPDNDLSVRMIFDFSRATQQCCINLFNSAVTNYVNGAPVANNFYTRAARFNYTPTPNQLATYESDISGYVSEAVMGYGASAEVTYNFNGYTFSSLSAFRGYDYYPDWRTSQVIDIATNYHTNGSPRVKSIQEELKIATPKGQAAEATAGLFYYYEGLRTWGNRQYGTQAGSWFGNPAFLGQVDDLALNGLTTMSFAHNFTNQIAPFIQSVWHATPELDITTGLRYSYTEREGSTWGVTKGADLSGLTGVQQNAAVNMRQALGGPAYSLTNPFFSYGTTTHQGLVSGLASAAYHFAPDLLGYALYSHGGRPGGPNISTQFLPTGAPLTIKPETLDNYEIGLKSSFFDQRVIANVAAFVMVNRNYITSIAALTSLGTTTNYLANANAARARGVEVDIRAKPTEDLNFIFAGVYNDARFTDFKNGPCPFEQTNQQTAANPYCDMTGKPLSLVSRWTFTVGGEYSHTFDETIETLGKPVTTFIGADFSYQSKFYSNPDDSLYSVINGYGLLNLHAGLRANDDSWNFTGWVHNALNKHYFTTLSAALYPGAGIVGGSVGDPIMAGLTLAGKF

SEQ ID NO: 10266 - protein, 441 aa, Methylacidiphilum infernorum
MMKYFNKTILAVAVTLASSQAIAAGFQLNSQSATGLGRAFAGDAVIADNASVLSRNPAAMALFDEKSLSVGAAYADLDVNISDVSTPLGNYGSAEGVAESKLIPNFYYIQPINDKWAFGVAGFSNFGTGTDLTSLANSNPTMDNGTVVPAPAPVDLLGNTEIVTMNFNASLSYRFNEHFSVGAGVDIIYGEGNLSREGNLPFDDNGSMVPVSLVDVEADGIAFGGILGAVYEFNADHRLGMSYRFSPEFKATGDVNMTQPGVGTIAFDEINIPMPDIFQVAGFHQLTEKFALHYTAQLTTWGDFHEITVTDGQLANGTAAGDAVLKQYAWEDSWLFSVGGTYTINENWKVRAGYMHDQGVVGDVSSLSIPDSDRNWYTAGVSYNLSTQSTIDMGIAFVRGEDVHVTENSSVIASIPGLNGDVTAYTRSDAIYYSVQYSYQF

SEQ ID NO: 10267 - protein, 676 aa, Methylacidiphilum infernorum
MVEKRELRCRLLGALLMLCATLPAGAQTPADWKEQSYAYSADRTPLSTVLQDFADGHSVDLHLGNVEDTEVTAKIRAENASAFLDRLALEHHFQWFVYNNTLYVSPQDEQSSERLEISPDAAPDIKQALSGIGLLDPRFGWGELPDDGVVLVTGPPQYLELVKRFSEQREKKEDRRKVMTFPLRYASVADRTIHYRDQTVVIPGVATMLNELMNGKRAAPASASGIDSTPGGPDTNSMMQNTQTLLSRLSSRNKTSNRAGGRDNEIEDVSGRISADVRNNALLIRDDDKRHDEYSQLIAKIDVPQNLVEIDAVILDIDRTALNRLEANWQATLGGVTGGSSLMSGSGTLFVSDFKRFFADIQALEGEGTASIVANPSVLTLENQPAVIDFSQTAYITATGERVADIQPVTAGTSLQVTPRAVGNEGHSSIQLMIDIEDGHVQTNGDGQATGVKRGTVSTQALISENRALVLGGFHVEESADRDRRIPLLGDIPWLGQLFSSKRHEISQRQRLFILTPRLIGDQTDPTRYVTADNRQQLSDAMGRVERRHSSVNQHDVVENALRDLAEGQSPAGFQPQTSGTRLSEVCRSTPALLFESTRGQWYSSSTNGVQLSVGVVRNTSSKPLRFDEANCASKRTLAVAVWPHSALAPGESAEVYLAMDPSRVLHASRESLLNR

SEQ ID NO: 10268 - protein, 687 aa, Methylacidiphilum infernorum
MLTWAQAAPGASAQLPEVTVRADVSRELGTGYNPPNAVSATKTEAPLRDIPQTVNVVTADVMRDQHATSMQDALKNVPGVSFSHGDGQRDQVSIRGFSAIADQFVDGIRDDALYFRDMSNVDRVEVIKGPAAVLYGRGSSGGLINRVTKKPGIDVTDFALSYGMWADRRAEADVGRVFGDGAAAFRVTGAVEKANSYRSQQFLDRSAIAPSLELRIAPETTVLFQADYLEDRRVTDFGIPAYKGRPVDVPASRYYGAANARDADYSQSRVFSGTATVNHRFNENWSIRNATRYYHYSLDRNNTLTNTVNEAARTLTMNHGNVRREEHGWFNQTDLTQKATFLGMKHEILYGMEIGQQNKDQVNNTKPVVGANGLPIAFDLFNPVLVALPRQAPGTPGTSNLGVFNTLAFYTQDMITFSEQWKALLGVRYDNFQQETQTRIAGQRNLSRTDTAWSPRAGLVWQPSKSQSYYVSWSKSFQPSGEAFALAANNADLAPETTNNTEVGAKYDWLNGKASTTISVFRLERSNIKIANATNTALLPIGEQRTDGIEISGAAELGGGWRMLAGYAYLDATVTKSTAALQGKRATITPRHSGNAWLTKDLGHGFGVGAGLNLVGARYADPLNTVTLPGYVTADAMAWYRRGAFEAQLNLYNLFDKGYIVSAHGTSPNLNMPGAPRSVMATLRYRM

SEQ ID NO: 10269 - protein, 832 aa, Methylacidiphilum infernorum
MGEFLRGLFFYSMFIDLKLINFLPLYENNPKENKMKKPVFLLSLLALSTSMAVHGNSFWKADLHENLTNVTKRVGVDGFTVNKEGQPWPGIGPNGEAGGTVTLPYSRIPAMTITDDNKMVVMFDLRWKTASDQNRIDPGAAISEDGGHSWKRITAWNFNDSKISLRRAMDPTLLYNSIDGSLYVMHGTWAAGTNNWYQDRLSYFNQNIWAATIYKSTDGGLSWQKNTEFSNTVNRDVFMKVQKGAGNPTIGFLGGVGTGIVMKDGTLVFPIQTAHRAGIATTIMYSKDNGKTWDMPAINDALAPNQSSLENMVFEIDNKLVMTGREDNRQKTRWAYYTEDLGKTWHVYEPVNGFSATTAAPSQGSSIYVTLPSGKRVLLVSKPNGNGDDRYARGNLALWMLDAKDPNHKYQVAIIRPGSGNRAGAGYSSLAYKEGNLFIAFEDDGDITVKNLSEHMQAIEEKATEWGLTDEIATEVEKINSLEHLNKGQKETLSAKMRRANDNAVAESNVLNREMHELKDEATSLEQKSVAMRKALPSKLKQFKRDLGEVRDLTQLTNETYLNYLGIQGLMAMLNGSFLALNTPLDFSKYIKRGEKLNSYDTDILYSTYNKVFVEYDSVIKNSQHRPTIALGLNTRLTDQTQSGVFYEHENKKQKVDAFGVRAQYTKGDNVLAAFLRYRTVKHDDVIDRNHNVDLYINYAKNVNIDPHLTLSPFVGAYTSLSSRTLLDEDVAVNKRLVMAGDLGLDIRYRLADISVSIRPNIAFIKDGFTLSQANYQDNQYKIKSTNMVYALNVGVEKQFTPHLALGSRMKLQKYGSQASEVSLGVNLSYHW

SEQ ID NO: 10270 - protein, 720 aa, Methylacidiphilum infernorum
MKTLLHYWPMLLSGTALAAGDPAGIDTSGTTPPKARETIVVKGQRVEQKLSDISGSITVITEEDLERQIATELTDVFKNEPGVSVTGSAGRPQNISIRGIGGNRVLIIKDGVRVSDGFGADDLNDKVGRFSFDLDDVKQIEVAKGAGSALHGSDAIGGTVVITTKQPEDYLQGQDAYLSSKVLHDGSSDKQKLSATGAARWGESAHLLRLSGWQGHETANYDQSRIPADLDGLSASTSSSLTLNEQHLLRLELDYFEDNAKRDQGPREIPQPDGKWQVRQYRENGTQRSQGGKLSWEAQDLGHPLADRFTWNLHGNYAKNTANKRSLLQNDELSGYPRYRSERELATFTEQLIGSELDIRRDLVTGPIEHKLSYGIELARTRHERPVEKLMLEAGIPQPTQSAPFSSARTDRAGIWLGDVATLGQWQFTPTLRMDQQWLSPQDGRGESNHSWHISPSLATSYRFNEQWRSWLSYANGFSAPSYDKVYGNIPHYFALPPFEIIANPNLKEETSHSFEWGVSGEGDEWSIKPALFYNRYYNFVDWRQVGFRLSDGVMLRQYRNVAKSETWGAEIAASYWLTQQWELATKLGWVDGKTSQGESPRNLTPLEGNTRLSYQANDWSLGLQADYAAAMSRVPSCGNSLTQQQGECLKTAGWLSFALTADWQITDALKANLKLDNLLDTRYTRYQDVAGLEAGTDAGLYTQTGRSLSASLRYTFVGL

SEQ ID NO: 10271 - protein, 191 aa, Methylacidiphilum infernorum
MKQPFKLSIAVAVTLSTTVLAMAEADDSFASTKVYLGGKTIDADAWSAQDGHGSIGLLTDFNTGFHGVRVAFDLFGSGSEDETNSLVKGTYTAEAQLGVRKVIELQSRFKPYIGGGVNLAYATQTNDDGSGKTEQEDTATGFWLNGGVDFLITDRFTAGLDLRYATAEVALFDETVELNALSTGVSLGYRW

SEQ ID NO: 10272 - protein, 635 aa, Methylacidiphilum infernorum
MLFRTPASLLAATALLLPAAATGQEGQAPVMLDPVVLSGGLSPVAESAYGRAYSILTAEDLRQRGFVTVQDALRDLPGLAVTSTGETLTMVRIRGGEANHVLVLIDGVEANSPGNGDYVFSGLLTEDVERIEVLRGPQSTIYGANAAAGVIAITTRRASVPGLSYGGGIEIGGLGTRAASAHLRAMGERGQISFSAATRRTDGEDASRTPGGDTEFNNRETLTLGGSYDIAEAVTAGFTLRRTWQEYGYDRAIDPVDSPDDHVIDTPHTADRNETYGSLWIEAEALGGRLLNRFAVSGSNQATDHFNDGVPDYDDASRLRDFRYTGTWALDGGNARNSAQKLNFAVQKKREIYESSYAPGGRYERDTKSLALEYQGQFDNGIGIQAGLRRDFNDDFRNATTWNIAGAWQLPDRDLRLRAAAGKAIVNPTMFELYGYAPGSYSGNPDLTPETSRSYEIGADWSFAAGRAALGATLFTSKVEDMIVGAGTTSQNIAGTSTRKGFEADLHYEATDWLRLGATYTYTDARTEDDDPIPRQPRHQLGLRATGDFAGGRGSATADLRYVAGNYDEEWFRSWTPPTTELPDFVTVNLAAQYDLTENLRLTGRVVNLFDRDYSEAWGYYGQGRTFYAGLTAQW

SEQ ID NO: 10273 - protein, 749 aa, Methylacidiphilum infernorum
MPFHGLNLTFIIIRGFSMSFTTHTQDEQRQPAAVPTLLAACIAMALMPSTSFAATTTEETIVVDSASQADTSSDEEQDYNVKTTTAGTKMQMAQRDIPQSVSIISQQRMADQQLQTLGDVMDSTLGISRSQSDSDRNLYYSRGFLIDNYMVDGIPTYFESRWNLGDALSDTALFERVEVVRGANGLMTGTGNPSASINMIRKHATSREFKGNVSAEYGSWNKQRYVTDLQSPLTEDGNVRARIVAGYQNNDSWLDRYNSEKTFFSGIIDADLGSTTSLSAGYEYQRIDVNSPTWGGLPRWNTDGSTNKYDRSRSTAPDWAYNDKEFNKVFVTLKQRFADTWQATLNATHSEIKFDSKMMYLDAYVNKDTGMLVGPYANYGPEYGYIGGTGWNSGKRKVDAVDLFADGGYDLFGRQHNLMVGGSYSKQNNRYMNTWANVFPDELGNFYNYDGNFPETNWGQQTVAQDDTTHMKSLYAATRISLADPLHLIIGARYTNWSIDTLTYRMEKNHTTPYAGLVYDIDDNWSAYASYTSIFQPQNYRDSSGKYLAPITGNNYEVGLKSDWMNSRLTTTLSVFRIEQDNVAQSTGRPISGSNGDTAYKAVDGTVSKGVEFEINGAITDNWQMTFGATRFIAEDNEGNAVNPNLPRTTVKLFTSYRLPVMPELTVGGGVNWQNRVHGSDTVTPYGTWRAEQGSYALVDLFTRYQVTKNFAVQGNINNLLDKTYDTNIDGSIVYGEPRNVSITASYQF

SEQ ID NO: 10274 - protein, 285 aa, Methylacidiphilum infernorum
MKAPGLPADQQFFADLFSGLVLNPQLLGRVWFASQPASLPVGSLCIDFPRLDIVLRGEYGNLLEAKQQRLVEGEMLFIPARAANLPVNNKPVMLLSLVFAPTWLGLSFYDSRTTSLLHPARQIQLPSLQRGEGEAMLTALTHLSRSPLEQNIIQPLVLSLLHLCRSVVNMPPGNSQPRGDFLYHSICNWVQDNYAQPLTRESVAQFFNITPNHLSKLFAQHGTMRFIEYVRWVRMAKARMILQKYHLSIHEVAQRCGFPDSDYFCRVFRRQFGLTPGEYSARFQG

SEQ ID NO: 10275 - protein, 404 aa, Methylacidiphilum infernorum
MFFQTGTSIVSDMESPKTSAVNAKLSGLESPAGLNFLTMKRNTAMKKSLIALTLAALPVAAMADVTLYGTIKAGVEVSRVKDAGTYKAQGGKSKTATQIADFGSKIGFKGQEDLGNGMKAIWQLEQKASIAGTNSGWGNRQSFIGLKGGFGTVRAGNLNTVLKDSGDNVNAWESGSNTEDVLGLGTIGRVESREISVRYDSPVFAGFSGSVQYVPRDNANDVDKYKHTKSSRESYHAGLKYENAGFFGQYAGSFAKYADLNTDAERVAVNTANAHPVKDYQVHRVVAGYDANDLYVSVAGQYEAAKNNEVGSTKGKKHEQTQVAATAAYRFGNVTPRVSYAHGFKAKVNGVKDANYQYDQVIVGADYDFSKRTSALVSAGWLKQGKGAGKVEQTASMVGLRHKF

SEQ ID NO: 10276 - protein, 753 aa, Methylacidiphilum infernorum
MDWTMTRRTPLATALVALFAVPAAPAALAQQAPATPAPAPASASETAPATLREITVQGSAIRDDFSPAGSQLSKLPAELRDVPQSVTIVNRAVMDSQGATSLADALRNVPGITIGGAEGGQIGTNINLNGFSARTDMYLDGFRDRGQYYRDTFALDQVEVIMGPSSMLFGRGSTGGVVNQVTKKPQMKAATEVTGSVTTNGLVRATADVNTPTGDTSAFRISAMAQDGKPSTRDEMTVQDFGIAPSWRFGIGTSTEITLSALLQHNEDMPDYGFPAINGHPVNVNRNTYYGFNNDRTRQDIASLSAGVTHKFSPNLRLRNQTSFNYVSTDARETAPNAVGSIDASGKFTALTTTNLPLSQLYVRQQSHDRNIRDYSIFNQTELTADFNTGPVKHTLLTGLELGHDGYNNQNYYRNGSCGSTPLNANGATTGYVACTPVVDPVYQDSPSNVASSVGNLQGGSANTVAVYANDSIEFSKQWKAVAGLRYDRYIASISNSINSSNTSGSTVLPYANQTVNFTSVRLGGIWQPTEQQSYYVSYGTSFNPSLEQLVGTVGQQSLDPEKNKSYELGGKWDLRNGDLQVNSAIFRITKDNARSQIDATTYALTGKIQVDGFRLGMTGRITQKWQVFAGYTYLDGVIENGVAAGTQGKVPLNTPKHTATAWTSYAILPNWEIGGGAFYMSQRYANNTNTVQVGGYVRWDGMIAYHQPKYDVRLNLFNIFDKKYYDALIQSDGGRSVPGTGRTAMLSFTYRM

SEQ ID NO: 10277 - protein, 804 aa, Methylacidiphilum infernorum
MSASIPFPSNKVSSPVATLRPLVTAVASAILLLAPVVVTPYAQAAEPAASSATRSYSIPAGPLAGVLNRFAGESGIFLSADGSLTSGERSVGVQGSFTVQQALDKILAGTGLEAVVQANGSYVLRKLPAISEATLPVVRVAGNAVTEDPLGPVSGYVARRSMTATKTDTPLLEVPQSISVIGREEMDARGVQDLMEAIRYTPGVAVNMWGIESRGMEWLMLRGFSPYSNISYRDGLYQADFGDLFPLTEPYGLERVEILRGPASVAYGQGDAGGIVNRVSKRPNGKSIREIEMQYGSFDRKQLAFDLGDRVNDEVSYRLVGSALDSNNEQKYSNGYKMANQRYYLAPSLRWQPSAATSLTLLSEFMKNKADDNLGYVNAANGSLTSVKGGDPGYSKINQDQASVGYQFQHHFSDTWEFRQNFRYSNTSVDKHILRLGVLQADNRTYPRTARAIDGEVNQTALDTQLLGKLKAGTTEHTVLLGVDWNQIRGDERSYIGAAPSLDILNPVYNLPIAEPQTFLGNYSQTTRRIGVYVQDQIKLNQHWIVTVGGRQDDVKVTTNDRLNSKQSAQSDSVFSGRAGLTYLVGNGWAPYISYAESFLPTGGLDLDGNPFKPSKGKQVEAGIKFQPENSRTLYTAAVFDIRKTNVVTYDNITFDARQIGKQRSRGLELEAKTELMRGLNATASYTVLDMKVVESADRTEVDKTPIQVPKQTASVWLDYMMGNGLGFGGGVRYIGERWNDAINTSKEPGVTLVDAAIHLDQGPWRFALNAANLFDKKYYASRAFNGYYLGQERNINLTARYRF

SEQ ID NO: 10278 - protein, 837 aa, Methylacidiphilum infernorum
MRDQIWRNLFFALVIGNGVLLQDIAVAQPPADAAEAPATSVKEWRAQLDTSLAEITQVDVAETATGLTVTLQTSEGPLDSPSIRTAGNDWIAEIPNAVLANGQSLTQETPAPDLAKITITQTTATQVTITITGIEAAPEVALATQSQGFTLAITPVLAEAETEVIVTASRTQEGYTVPNATTATRTDTPLRDIPQSIQVVPKEVIEDQQVIRLDDALRNVSGVVQNSADPRGQRFQIRGFDSASVIRNGFPQTFGFTGNSAFQDLTNVEQIEVLKGPAAILFGVSEPGGVINLVTKKPLSEPFVDLEVKAGNRNLISPSIDLSGPLTEDGSILYRLNASYRREDSDRNFDTPIERFFVAPVLQFKLGERTDFTVELEYIDDTRPGDFGLVAIGNRVADIPFETNLGELDDRLEAESIRAGYQFEHRFSDQWKIRNAFNYKTYDSRFASFFRLGFDEASGTLFRAFIDLDQPSTTYEMQTTLTGEFETGPIGHKLLIGLDLNRRDAVGNIGRGDFGAAAPFNIFNPVYGVIPRPNPENDPIFFDGDTRAERLGVFLQDQITLLDNLKLLAGIRYDTVRQTSTNRPSFFNPTSSTTEQTDDAFTPRLGLIYQPIEEISLYGSFSRSFNPNSATTVAGGILDPERGEQFEIGARGELLDGRLVTSLALFTISKTNVATSDPNNPLFSVNSGSQRNRGLEFDIAGELLPGWNLIANYAYIDSEITAANDPTQGNRIFNVPEHNFNLWTNYEIQTGSLRGLGFGIGFNFVSDRFGDNANSFILEDYFLTNAAISFKRDGWKAAINFRNIFDVDYIQGGEGSRTNEIYPGDGFTVIGSVSVEL

SEQ ID NO: 10279 - protein, 798 aa, Methylacidiphilum infernorum
MAQDNAQADTQDAAETKKDYEKIVVTGTSRARLVAETPQSTTSMGAQEVAKLSMSSQADVLRYVPGIKVEGGGGEVATNLQVRGLPSSGQFQFTPLLYDGSPTLSAFGLNSSAYDVYYRNDLGIERVEFVRGGVSNLFGQGSVAGVINYLSKKGTELSESTVQLELSDNNRKRIDFATSGPLNEKGMYYAMSGFYRYDEGPIDTGLPTEGYQLRGNIHKEFDDGSGYFTIYGQAIDDEVQFFLPLPLDSQSRERVAGNDGREVESTQTFYASGLSYDTADGRYRTPIEEGVATRGGSISMEFSKDLGNDYSVLARAKYASYDHQFNLFLDGDGIINVPETQSEYLANRGLDDLGAAEFTYAGTDVVLPEGDLLFANRILDRDRPATDFSSELNVVKYLDVGDFSHSITVGTFFSSAEAEDNNVITRYLGEFNNQARLVDLTITDADDNSVIVSQNGVTGPGISFSDTTISARRTAFYIADQMQNDDWIIDVGLRWEEIDGTITREGSETVVVNDDPILYEDLQVNVTGNGVLTHGKVDNSELAYSIAALYKMADNFNVYANYSRGFFFPELRGVAFNPNGEPGSYESEIVKQAEIGAKFFFNDFIGTMALFKTDLEDRRSVDFVNDENGVAVEVPVFQSTEAYGVELVGSYNITDDLIFDANFTYTDHEFTEYDSDPSVIGNELRRKPKIMFNSSLRYTLDDWDISFYHNYHGKNYTNDANSVELDDFHVFRLDTGYTWEFGQGERLRASIAVWNLFDSDGITEGSPRLGNSQTAGESYFVGRPILPRRVSLRLRYDF

SEQ ID NO: 10280 - protein, 995 aa, Methylacidiphilum infernorum
MNKIIPSVSLSLFLLFNIHPIFAQSDYLEAQKTILDQRNQLFNELKTHVIPPYPEPHSQAALWDKEASQHVTLLTKKRKKSAEKDQQSTPEYIFNIYREYLFNQKGFNYNDFKKIEAYNRLDNLFQLASFAYDPIKNKNRSMDFILKDHYLRGRPNQVLNEKGEYIPNYTNITGSSYPSGHTWSGFKQAAIFATLYPEKGAQFFDRAMGYGESRVIVGAHFPTDTIASRAANYYLLAHLLKNDKTANTFIGLAKDVRQEINSQCAANTAKCKPPIGLLPSFDENTGYYNKQSEHPSPTVTADQIPASAAYLLRSRFAYLNKEQWREIIAGTAYPRHSLAGWSVKQNQPDSYWGLINLSKAYKGPTHFAEDWVVNQRVTQDDVANVGITDIWSNGIDGKGRLIKQGEGSLTLAGINRFAGLEIQQGRVVLTQENHLTGPVNINGGKLEVKHILHAPVNVTNGALALSHSIKNTVTLNQGARFIASGSVDDLVINSGAILTPGDNTRDPTRHLKVNNTAIFQPGSEFYVSIQKDVIQEFDALHAGGTVTINGGKVNEFFAEESEPFNERIPNQDEIQGRFRTQYEIIRAPNIQGKFDGIEPNYLFIGTTLNYGADPRSPTMQRVTLNVGRSGLTFDAFAKTPNQTAIAHALEDLPLNNTLYKRLILSQTTAGVNDLLRTLSPQIHIDTLASQLNNHRQYHGTLLQQTRASENIVKERGDNRGNVWVNVPYHWDRTQSDGNASGFTNSNYGVFLGADKHFFNDDFIFGMSSGFTKNSVSGGVGHSHSNNYYLAAYGSLQLAPITLRAGLGHTWHTIKTDRTVASSIYSDHNTADYKGKTNHLFMEAAYPWKSAFINAEPFVNFAFTNAESHGFREKGKKASLVTGRQSLDATTTTLGLRLDNQWKVGKSSSIDVHGELGWQHQYDKQEREMAFRFTQRDLLAPPLNYHGVNAPQDGVTIKLGSNIQITDNTKLSVDYSQFTTKGYLENNLDAKFLVSF

SEQ ID NO: 10281 - protein, 1081 aa, Methylacidiphilum infernorum
MKVKSYVLLLAFLFLSATTSFAQEKTVTGTVTTAADGLPLPGASVIVKGTSKGQQTDFDGKYTIQVNQGDVLVISYVGMQATEVAVGAANTYDVALKDDSTLDEVVVVGYGTTTKKAYAGTAKVVKAENIENKNFSNVSQSLAGEAAGVTVINTNGQPGSTSTVRIRGFGSVNGNRAPLYVVDGVPYSGSLNAINPSDIKSTTILKDATATAIYGSRGANGVILITTKGGSASESYIEVDVRTGINTQLIDRYDVITDPEEFIGYVWEANVNREILNGNADPIGTVNNTLFTTLINPVYNMWNVANGAELIDPATAQVRPGVTRKYTPKNYQEESFNPAYRTEVNLRMGGGNEDVKYFISGGYLDDSGYIINSGFRRYSTRLNVNAKVKPWLKLSTNLGYTYSETRSNGQTAGAENLFEFADKMPPIYGVFLRDDNQVLVADPIFGGFQYDYGSISAINNGFAPRARAASDGLNPIASALYDFNGTDRHEVNASFNATINVAKGLTFESTFGAQYSNNIFKTASNQFYGPAQPSGGTLFQRNTETLTMNFLQLLRYRTDFGRHSLEILAAHESNDFDQSIFTGSKSKAVVPGVYELSNYIVDASPSTGINQGRTLESYFGQVNYDFDDKYYLTGSIRRDGSSRFANDKYGTFGSIGAAWILSNEDFLSDSNLFTYLKLKGSYGVTGDENGVGFYTGIDTFSATNLGGSIAIAPLTFANPELTWETAKQYQVGVEFGLGNWLDGSVDYFIKDTENLIFNRRNPPSTGVAVITVNDGVLRNFGLEFDLTGHIIQKDDFTLDLSVNGSLYDNEITTMPIEPSTGLPKILDQSVTPYAYTKGGSIYDFYIREYAGVDPADGFPMWYQYYDDVNGDGQFDSGDTAIASLTTYLNTNPNSNVERQITKTYANATQKFVGKSGIPDVSGAFRLSARYKNWSLSTQFTYSIGGYAFDNQYRELIHDNNGGISATNRHVDIRDRWRQPGDITSVPRIADRVITNVSSTSTRFLVKRDYFALNNILLGYTLSSKFLDKTGLDLVNLYVSGDNLFVKSSRTGFNPSTSQSGNSGRGFYAPLSTFTMGVKLKF

SEQ ID NO: 10282 - protein, 986 aa, Methylacidiphilum infernorum
MVVSFIGMASQEVSIKQNVSIILKSDTKVLGEVMVVAYGTAKKESFTGSASVINNKKLELRPISNVTKGLEGQTTGLLTTSGSGQPGEAAKIVIRGYGSINASQDPLYVVDGIPFSGDMSSINPADIESMTVLKDASAGALYGARGANGVIMITTKQGKEGKTKVSWRSTAGWSSRSLKAYDMVDQKEFVQLTYEGLRNGYIFDNGYNWEAAGRQASADLGGVLGGEQYNPFKNYTWGTIIDPATGRVQGDATSAWNESWMDAIQRDNAFRHEHQLSVNGGTEKTKYMFSLGYLNEDGILINTGFQRYNARANINTEVNKWMKTGLNVSLSNSTQNFSDYEGSSNSNVWYSAQFMAPIYPVYIKGEDGKDVLDADGNRQLDYGDGSVQRPQYSDFNPVGGLVDDKADIKTDVAGLRTFLAFGSDSEDAGWAKGIKLTLNFGLDYRNKSQKSYMNMHHGNQAAAGGLLMKYNRRTQSYTFNQLLTWGRSFNFHNIDLLVGHEFYAYKYEFLSAGKTNLVDGILELRPGTNLYNADSYSEDYRVESFFGRFNYNFNEKYYFSASIRTDGSSRFQKDNRWGTFWSVGANWRISQEKFMQNLTWISNLSAKISYGEQGNDNLLRYDSLEGGYVPDYYPWQGLYPLEYPNANQVGGLIGALENKKLSWEKSGNLNVGIEASMFDGRLNVSAEYYNRKTTDMLLGYPKATSSGFSEYNANIGSMRNTGFEFSLGGSLIKTTDFIWNLTWMGSTVTNKVLKLTGESPEIIKGVFSIKEGMPINTYYMAKSAGVDPATGAQLYWVYDKDDNGNITNEYISSDYQKAANSKYYSGSRIPDLYGSINTDFSYKNFDLSILGTYSIGGKVYDSLYAGSMEVMYAGNTWNKHALRRWQQPGDITDVPRIQIGGSYTTSDRFLVDASYFAIKNITLGYTIPKQWLKKAGLESVRIFGSVDNLALFSHLDGMDPQYNFKGETDYSYAPNKTYSVGFEINF

SEQ ID NO: 10283 - protein, 701 aa, Geobacter lovleyi
MKRSRHETPAGRRQRRTRALDREPAARRGFRGRLRRRRRARRHGAEDRTLRRGAARHAPARHQRQGGARAAATPQRQRAGADADRARLGRRQGRLLRRGRRRLRREAVRIARAGRTDSRADPPAGGRRHDAARVRRSRLRVRHARIPLRRNGARAAPPRARDPRNADAAAEQDGVEGAADGQRVRARRRAERRCDRHLHSPAAQASRGQHGRDHHAARARLHPAHEEHAGLTGSFASPEYRFVARNVIDACRRPRLAGFRTPARSGIVARSVFSPIRFLRPGKRREGLHPLRCYASALSLWPARVGIHYVLPTTRFQCGSSEETILKRKTLALSIAAAGLCAGTQAHAQSSVQLYGLMDLSFPTYRTHADANGNHVIGMGNEGEPWFSGSRWGLRGAEDIGGGTKVIFRLESEYVVANGQMEDNGQIFDRDAWVGIEDERFGKLTAGFQNTIARDAAAIYGDPYGSAKLSTEEGGWTNSNNFKQMIFYAASPTGTRYNNGIAWKKLFSNGIFASAGYQFSNSTAFATGSAYQVALGYNGGPFNVSGFYNHVNNGGFTNQTFSVGGNYTFSIVRLNAGYFRYNGDQGSLGQRHDDSWTVSVKVAPPGALDYELGYQQMRVKNAANNADGFTPNANLGAFSLTNGVANGFKETIYGSVFYHLSKRTEVYLAGDYMKLHGGYTVSSTFGAKNQLELTSGIRTRF

SEQ ID NO: 10284 - protein, 665 aa, Geobacter lovleyi
MNRHTLTVVLWMLSGCLFFCPQVYGQSEPDAVPMEEIVVTATRNKEEIRQVPANVSIITAKDIEESGATSIAEVLDRLENIQVRTYSGNPSEALIDLRGFGGDNPHGKTLVLLDGKRLNNPDMKSINWLQTSLSNIERIEVVRGAGSVLYGDSAVAGVINIITKKGEGKPEFSASFIAGSYGLHDEQAGVRGSEGKISYSLNGENQEIQGYRARSKYSSRGAGLNLGYEGNETWNASLALSYNRSDFDLPGSLTKLQYEQDRRQIGNPDDDRENTDFHANLALESHFGDAGSLHIQLLYGSKETEYNMKSWSSYSLVNLDSYGITPRYVLDRNIFNHKNTLTFGLDHYDEKLDKEGFSDREQTSRQSTADLSRKTLGFYVRNELHVQEDLIFTLGYRTERAKIQGKEIRTNGTLVFDEEKTHEGEAFESALTWLIGEKSKVFVKYATVFRYPFLDEQASYYGYGSDAFLTDLEMETGKTYEVGANFFLLRNLSLDLTLYRIDMENEIATNASGNQINLDKTRREGIELGASYLWEKVAKVYGQLSYRNSEFRSGPNFGKDVPLVPEILGSAGVILYLPYGLELNPEVKYIGKNYQGGDDSNVLEKVDDYTVYNLFLYYRPTIKNLKLSAFAGVENLTDEKHALIYWGGYYPLPGITVKGGISLKF

SEQ ID NO: 10285 - protein, 507 aa, Geobacter lovleyi
MKFAHFNGPGAQARPFRDSAPRAALTRHSRLPSVRRAALCTAFAWASLTAGVAMAEANPDAAPEAPEADLKIQATQANQWTGFWNRQQMLGDIGGLRPWLGKYGVTFTLTETSEVLANLRGGLAKGADYDGLTTATVQLDTQKAFGLPGGLFNVSALQIHGANLSANKLGTLNTASGIEADDTTRLWELWYQQSFLNKRIDVKIGQQSIDQEFITSQYSALFVNTMFGWPALPSYDMPSGGPAYPLSDLGVRVRGQITPSLTALAGVYDGDPLGNNPNNKSGTNFNLHNGTLFIGELQYAINQPADGEMVGAGGGGLPGTYKLGVWYNNGSFADQRYDNTGLSLANPATSGVAQNHRGDYSIYAVADQMIWRPDPDEPRSIGVFARVMGAPGDRNLVSLAANVGVVMKAPFQGRDNDSVGLALTYIKVGNHVNGLDADTRAFTNGPYGVRTSETALEATYQYQVNPWWQVQADAQYTFNAGAGQNPNDPTQPLRNTFVIGVRTNINF

SEQ ID NO: 10286 - protein, 407 aa, Geobacter lovleyi
MRKTFRIAFLAVLAAPAVALASGFEVINVNPRDLALSSSGVAAQEDAAATFQNPAALSKLSGLNLSLAGSMLSLRTKWTGTAAYPGKETTKFAPTPPVAMYVAYGTKLAGRGLGFGLGVGTPGGGQMKWDDQWEGRGRIITVERRMLGFYLNGGYEIAPWLRVGGGAIYYEGIQYLKQGIQPFPDAYAELDTKGGGFAYQLSAEVKPLENLTLGFDYKHKGTMHMKGDAHFQVPPSLVGPTTQDQDVKQDLTFPNRIDTGLAWRVAKPVLVTLQYSWSRFVVYNQDLFEGETTAITVPRDYRNGNVIRGGVEWTALPTLRLRAGMMRDWSGLRTSTLSPTLPDSNTTGYSLGAGWDAGADFGLNAAVFYGDRDKQTSTGTAAFPGSYKTDVWIVALGFTWRTDLGNR

SEQ ID NO: 10287 - protein, 383 aa, Geobacter lovleyi
MKKRTLAILTAALTITSAAQAAEIYNKDSNKLDFYGKIKAMRYLSDADTNASNNADKSYTRIGFKGQTQINDQLTGYGQWEYNFSLSNSEGSSDAQSGNKTRLGFAGLKLKDFGSIDYGRNYGVIYDVEAFTDMMPEFGGTGYTRTDTYMLTRGNGMLTYRNNDFFGLVDGLKFALQYQGKNEGSGSRATNVSNGDGYGASLSYKIIDGLTINGAVSSANRLNANSATSTSSQKLAAYGSGEKAEAWATGLKYDNNGVYLAGTYAETRNTNPLSGASYTFAGNKSPTAISGYVNKVQNTELVAQYQFDSGLRPSLAYVQTKAKDIENGIGDADLVKFVDIGATYYFNKNMSTFVDYKVNLLNKNNKLNLNTDDIVAVGLMYQF

SEQ ID NO: 10288 - protein, 407 aa, Geobacter lovleyi
MRAPLVLHFCAPPFASGFVVMRCTSQPSGTRQTIGLNRVRRGAAAIAMLVALVVAILAATPGYAQTPTPTPTPTPTPTPSPTPIPMPTSTNYDQSVGNSTLNLGSGFLERLGNQASGGFNRAFRTNPGGGGASASTEDPRYRTWFEGYGISVRTDAQGDFVGDKRKTFGGVAGFGARLAPGVNLGFSVDQSHTDIDVPLALQSATLDLTQVGFNGSIDKGPWTWAFAVVHGFGKVRSSRDTGFGVASAGYRAAVDGALTEISYYWTKDQMRVVPKGALEYVRATSAAFQEAGGLDPLNVGSTALSRARVMIGAEVGRYFIFDQKILDLSAYGKFVDNFYQNLGSVQVSLGTQSIVVPGIGESRYGMDAGASASLSLTNTARLYVNYDGKFRNELTSHQGTVGFEYRW

SEQ ID NO: 10289 - protein, 368 aa, Geobacter lovleyi
MTKIFKRIIKMKKTAIALAIAGLAAATAAQAAPQENTFYAGAKAGWASFHDGYTQYAEDGVGSHTKSVTYGVFGGYQIFNRDNLGLAVELGYDDFGRAALRTNGATSAKHTNHGAHLSLKPSYDLGALAPVLSGLDVYGKVGAALVRSDYKVNDGYSYGFNKSDFADHSLKTSLLLGAGLEYALPSLPELAFRLEYQWLNKVGKLENANGTRFDYTPEIHSVTAGVSYRFGQGVAAPVAEEVVSKTFTLNSDVTFAFGKATLKPEASASLDNIYGEIAQVQSPAVSVAGYADRIGKEAANLKLSQRRAETVANYLVSKGVAQNAITATGYGEANPVTGNTCDAVKGRKALIACLAPDRRVEVSVQGTK

SEQ ID NO: 10290 - protein, 362 aa, Geobacter lovleyi
METIEMKKTRQVVVRVAARRVVGTLGVTAIFSAGLVLNSVGAYADSGSQVQLYGLIGTYVGSIKRSDTPQSAVQMGSGGLTTSFWGIRGKEDLGGGVGAIFVLESFFQPANGALGRSTADPFWSRNAYVGFQGDFGQVTFGRQRNPAYTAESLVNPFGSSTVFSPLVLQTFVTNYGGTIIGDTVWNNTVKYTTPDFKGFAATVIYGLGGVAGSPGVGNLGVHLNYQGHGLTAVLSGQRVRYTAAGPVGAQYAYLAGAAYDFKLVTLYGAWAMTSDASTPTGSHTYEAGLSIPLSPADFLLAEWARTKRSGATPAAGSLRNTASVGYNHLLSKRTDLYAVYAYDKLSAHPTGNTFAVGIRHTF

SEQ ID NO: 10291 - protein, 372 aa, Geobacter lovleyi
MKKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSVGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVALGLVYEF

SEQ ID NO: 10292 - protein, 71 aa, Geobacter lovleyi
MTVQDYLLKFRKISSLESLEKLYDHLNYTLTDDQELINMYRAADHRRAELVSGGRLFDLGQVPKSVWHYVQ

SEQ ID NO: 10293 - protein, 1179 aa, Geobacter lovleyi
MQRNSLCRFALFTALAAIAAAPGFSQAFYGSVVGTVTDPSGGALTGAAVTLTNAGTGERRQTLSGSGGDYQFLNLVPGTYRVQVERTGFKRAAHENLEVNISGTVRADISLQLGDVTQTVEVQAAAPLLRTEDANLSQVVSSRAVEDLPVNGRNILNLTALVPGVVPQGTTDGNAITGKNIFAAGNYQIGGGAANQGAVYYDGVPANSALGNLVNMVPSPDAIAEFRVQTNSNNAEFGRYAGGVVNISSRSGSNQYHGSAYEYFRNDVLNATNFFANANNTGKPAFKQNQYGLNGGGPIKKNKIFFFAGWEAFRGREGSPFIGTVPLPEMYNGDFSNFRNASNAIIPIYDPLTQCGTGANGACAAGQTIQRQVFPGNIIPKSRFDPVGYALAAFPLVALPNQPGDAFTHNNNYSALASKGGDNDQVNGRLDYNVSEKLRLFGRFSRWHSTNLPFAPFHNGIYANDPYAPEEFTTTQGVLGGTYLITPTLVLDLRASYIRFPYIRSQSYENISLSKTFGFPQYMDEQLPIIHSGPGTSIPSVGIGGYTTASGLHILSTENDYLLTPNLSWVRGKHTLKFGADWRDMQNGYYQTFDGGTFTFTTALTCQNALNCGASGNGFASMLLGFGSSGTETAFSRPWESLHYQGYYAQDVWQATPRLTVTAGIRWEIPGVWRERYNRLASFNPSELNPALKGKTVNGQPIYGALDFPGDPNHAFNGWRNEHFRLFAPRVGIAYRLNDKTVIRTGGGIYYLPSTTGFSEAPWGLSINQLGNPWLATLDSGVTPYYPLSNPFPNGFTPAPANLPRDQAQLLMVGTSLGNIPLGSVPYPYQSQWNFSVQRQFWGGVAVDAAYAGSRGVHLPRGNQNFDALPTTYLSMGTGLNTQVANPFYGLVKTGTLSQPTVQQGQLLLPYPEYTGVSEGGGYVGNSSYHALQMKVERRFSHGGTVLAAYTFSKLLGDVASRTGWLDSGVGAAPGAQNPYNLRAEKSLAGFDSRQRLALSYAVDLPIGKDQKFLNGGNGAVQKFTSGWSVSGTSTFQLGYPLALTASPNVTGFGYGLRPNVTPGCNPKLDGPAQSRLNGWFNFSCFTVPAAYALGSESATDPVLRGPGINNFNVSLLKKTTVTERLKLEFRGEAYNLFNRVQFGPPNTGITTAANPTTGQIRSQINNPRLLQFALKLLF

SEQ ID NO: 10294 - protein, 1071 aa, Geobacter lovleyi
MNYRKKAMLMAGALLCLNLSIYSQSISLKMSNVSVKKAMTELQTKSGYSFVYIAGDVDTDRTVSINASQLKDAVAQILKGQNVSYEIQGKNIVIKKGSQQQVTSGKRKKVTGTVKDANGEPIIGATVVEKGTTNGTVTDFDGNYTLELSENGMLAVSYIGYKSQEFAASQIKSGLLAVTLKEDTEVMEEVVVVGYGSVKRSDVTGSVSSLDTESLTAASQTNAIDAMQGKISGVNITRNAARPGGSYNIVVRGLSSINNSNTPLWVIDGIPTNSDASDINPADIEKIDVLKDASATAIYGSRGANGVIIVTTKRGKEGKVSINYDGYWGIRKASNLPDMMNMDEYIKFRTEMFQAQGKSTDRSNAEFFTPEEWERIDNGAYTDWVDLILCNGQQYSNTITASGGNADGTFSIGLGQLHEEGTIPNQNFDRYNMHLNINHKFSKVWEAGGNLYFTHSVQNMGSYEALRSAYRLPGVAYPYDEEGNLVYNVYRNDMVNNPLLESGEDGEQRQNKRFRVFGNIYLQLNPIEGLTLRTQFAPQMIYKREGIYMGVDSKESAGKAEGTKADYNQTLFWSYVWDNQVTYDKLFGLHHLNLSLVQSIQMEEWEYSNQSAKSFSYNSLWYNLGASGLSNATKSTTNFEKRTLASFLGRVQYSYNDRYLLTLSGRYDGSSRLSAGNQWAFFPSAALAWRLSEEDFLDNFEQLNNLKLRVSYGTTGNDAVDIYGTQSGISLKNYDFGGISVPAYYKDRLANRDLSWEKTYEINVGIDFGFFNSRINGAIDVYRRDAKDLIMERKLPSTSGWTSIWDNIGHVRNVGVELQLNTVNVQTKDFTWETGFTFSKNHNELVELYGGKKDDISNKWFIGEPIDVNYDYVFDGIWQTDEAEQAAVYGQKPGQVKVRDIDGNKVINADDKQILGQRSPKWIGSITSTFRYKDFDLSVYLYTQQGAQVQDAFMSSFMTFEGNYNQLDVDYWTESNPSNQYPQPGNKGQYYDAMRYVDVSFVRVGSVTLGWNIPKEWTKKIGIKNARLYFTSNNPFTFSSYKGFDPEWATQNTWGTVTGYTTYLLGTKIEF

SEQ ID NO: 10295 - protein, 222 aa, Geobacter lovleyi
MKRNMIIVAALATLLIPSLARAEPPRPGPYVSWFVGVTVPQDRNAHSYDSWGSYNDRVEFDPGIDVGGSAGYDFGYVRLEGELSYKGAEIDSVYDATSDIRYHDLDGSLSAFAVMANCYFDLHNDTPVTPYLGGGIGFATLYLDDTSGVSNGVRWSLYDSDDDTVFAYQIGAGIDISINRYFSLDVGYRYFATDKGKFDEGNAGTRMKFESHNATLGLRFKF

SEQ ID NO: 10296 - protein, 367 aa, Chlorobium limicola
MTKKTMAHTLVKRSLIAGAVLATAGVASAQSNVTIYGRIDTGVEYQDKVATGTGDSSRTSLANGGILPSIWGFRGNEDLGGGLKAVFNLEGDFDGSTGGTRFGGGLQLFGRQANVGLSGDWGTVLLGRQYSPAILADLGTDPRGFKESFSSLLPYALTQNPAGNGVTGNNFLGIFTGNMISYTNAFGPVTLRAGYGLGEVAGGGSEGSTVALGLTYAGPVTVSGSYQQIKGIAAGDAESKRFSLGLAVPFGALTGKVYYAKAETDDATGAKSSDSDYFGVGVDWAWNPQNTMTVAFYHGEDDVFTGKSKDLVISNDYALSKRTTLYAQFVYSDVDTGANPALSIAADRGPIPGEKTKILGVGIKHDF

SEQ ID NO: 10297 - protein, 1070 aa, Chlorobium limicola
MNGVLFPRSPFLKEFIVRRFASVSSRVIVTALFTFSVGVWAQSIGGRIAGTVTDASGGVVSKAAVKIWNEGTGSERVLASDPNGLFVASELPVGYYSVRISAADFNEVERLHVKVDVGGETRVDAALSPKTLEQSLSVTAQAPVLQHDSSTLAEVIDNRQVDALPLNGRDFRRLVFLVPGASPRSPRGSLGSFTVDGQREKSNIFLIDGVDNNDSFRNQASFNQGGPANAQATILPVDALAEVSVQTQGSAEYGRNSGAIVNTVLKSGTNQVHGTAYEFLRHDKLNSRNFFETLLGARKSPFKNSNFGATAGGPIRHDRTFFFVGYEGERGRPNSTLAVSVPSEKDIAAARNANRAADRPENPLGAALLNFFPHENNPGTGGNYVYSVPNLLNSDNFLVKIDHRLTEKLNLSGRYVYGNGNQTFPLNSGQGSELPAYQTVVPTRVQLAGVNLSQVLTERLINETRFSFNRFTQAFSALDSAFDPAGIGLITGATGGLPTIVVSGYESLGAPTNLPRGRVSQAYQLNDALVWTHGRHTLKAGVDYRRPLVRSYNDQFARGRISFNSLADLLAGVPAPSTTSIARGATRRDTYTNNVGGFLQDDWKVTRRLTLNLGLRYEYGGPLSEKYDRISNFIPSQGLVRVGQGLDTLYQRDVNNIAPRFGFAYDLGGSGKTVLRGGYGIYYDSPSQDFFLLQSFTNGSVGTNPVPGLGTFTVNFTGPVPFGPGVNIFGSASTPVPPFTVFGVDPHMRTPYIQSYNFNLQQTIVEGTVLQVGYVGSKGNKLFRVRDINQAMPGAGPIQQRRPFNALYPDFAGIYELEASANSNYDALQIFLRRRLARNLTLFASHVWSHSIDDASNGICSCTAGVSLPQNSFDTRAEKAVSSFDQRQRFTLNFVYDFAVIPRLLNKWPRLLTTGWEMSGIYTIGSGIPITPFWNGAAPSGSGESSNDRPNAVGNPNNGPKLWNAWFNTAAFAPAAPGTFGNAGRNTIIGPRNNIADFSIIKSTRITERARLQFRAEFFNVLNHPNFALPNVTVNSSGFGTITSTPDVANGNPLGDGGPRQVQLALKLVF

SEQ ID NO: 10298 - protein, 366 aa, Chlorobium limicola
MKSYLFLFLAVLAADVHAQSSITLYGVIDDGINYVTNENGHSAWQMASTVMQGERIGFRGVEDLGGGVKAIFTLEDGFDVNSGGLLQGKRLFGRQAFVGLSSDVGTITLGRQYDPTVDYVQPLSNNAFYASYGGHPGDNDNLQDNFRINNAVKFKSATYHGASFEAMYAFSNAAGAFSGNSAWSLGTGYSQGPISAGAGILKLNHPASNTSGAVGSSGEGIGSDYVSFANTFVAGTVNDEIIADGGINYLFSKGSVGVVISHVLYDLSVSRVTFNNYELNASYFFTPALRLAGSYTFTDGRVPVIHESPKYHQLSFALDYFLSKRTDVYVMLAAQKAIGTFADIIDIAPSNSDKQLVARLGMRVKF

SEQ ID NO: 10299 - protein, 958 aa, Chlorobium limicola
MNKKTPFLLTTLTTLTTLASSIAMAQSPTSSSVDPGAEIEEVVVTGSRIKRKDYTSISPLVTLDAEQITLSGITAIEDLVNDAPQLVPLNNRTSNNPGNGTASLNLRGLGSNRTLVTLNGRRLIPADPEGSVDINTIPSQLIKRVEIVTGGASTVYGSDAVAGVVNFILNDDFRGLEVTAQYDSYEEGDGAVADLSAVFGFGNDRGSVTGFLNYQDREEVFAGDRVFTTERLQESFNPADGGALVPAGSGTIPAGSIVFPAAPAPGSGGFPGSVTFNEDGSPRAFVRGQDQYNFQPDNYLQTPLRRDSAAVFGKFEINDQLRAFGELVYSQTSSTSQLAPPPAFVQARVNLDNPLLTPAQRSQFANGAYDPDGDGVAEFIFAKRLVDTGPRIQSRESDTLRAVLGLQGDFASSWEWEASYSMSQVRGEFVSGNAVFADRFAQGLLVDPATGACVDPSNGCVPFNPFGLPINADAVEFLKIGDLISTSDTDEDIVSLILTGDAYELPAGPIGIAAGLEWRELSSKENPDPNFLNANVLGANAQAPIEGATDVAEVFLEALVPLLAGERFADYLGIEAGYRYSDYKFSGVADNWKVGLDWAPTSSLRFRAMAQQAIRAPNIEELFAQPRAQPSVIFDSSTDFCSASADPVGNGLTDLCVAQGIPADQVGIYEATEQFPLLVLEGGGNTALDPETADTFTAGVVLQPEWAEDLSLSLDYYRIEIEDAIGGTSFEGSLGLCADSADPDSQFCNSLVRAPSGDISEYTNPQYNLANISAEGVDLTVNYRFDLGDSLALPGHSASIALQLLFNYAMENTFQATADSVETDCAGFYGGACNFGVPLFQVVPEYRSSTRLTYYSGPLSLALNWRWIGEIANHIDITCEESPEFCYPTVLGDIGSQNYFEFSGRFEFGERAEIYGGVSNIFEEEPPLMGRGATQSNTAPQLYDVFGRRFFLGLRVRL

SEQ ID NO: 10300 - protein, 333 aa, Chlorobium limicola
MKKKILSLLCLVMVWALPSALQAEMKPSVTVYGNLRYSFNYVDDEWSGIERWKGTDNVSRFGIKGSYGNEKGKAFVHLQVGAPSDENKDGHGFTQRFFFGGFECDYGKLTYGRMTNAYKFPGYALDPFYDLSRINSGGVFAGGGASYGLSPATNRFTDNSLQYVTPDLSGFKLLGGIAFDESNDDNELAYLAGGSYTTGGLTLGGVYADNPETKVVYYGIGADGEAIRAYATYKTDGWKVGASYENVSNGMDVSYYYLTGTAMLKEAKTDLSLSLGMVDDGASEGMGITGGVFHHLLDNAQVYAMASYADLESDYAPYVLSVGAIYNFSYTAN

SEQ ID NO: 10301 - protein, 666 aa, Chlorobium limicola
MTSWRYGMFRLNPFVRVGLCLSAISCAWPVLAVDDDGETMVVTASSVEQNLKDAPASISVITQEDLQRKPVQNLKDVLKDVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDSTIQEHRDRGDTYNGQFFTSGPLIDGVLGMKVYGSLAKREKDDPQSSTTARTGETPRIEGFTSRDGNVEFAWTPNQNHDFTAGYGFDRQDRDSDSLDKNRLERQNYSVSHNGRWEYGTSELKFYGEKLENKNPGNSSPITSESNTVDGKYTLPLTAINQFVTFGGEWRHDKLNDAVNLTGGTSSKTSASQYALFIEDEWRIFEPLSLTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDINAAPGYQNFVGFTADGVPVFRYYNVNKARIQGVETELKIPFNDQWKLSLNYTYNDGRDVSNGENKPLSDLPFHTANGTLDWKPLALEDWSFYVSGNYTGQKRADSATAKTPGGYTIWNTGAAWQVTKDVKLRAGVLNLTDKDLSRDDYSYNEDGRRYFMAVDYRF

SEQ ID NO: 10302 - protein, 2417 aa, Chlorobium limicola
MAFKKARLISRFISKGSFKLSKISKKIFTLNQILKCEKPLKCHKKTKSIKKLSNRNKSFLKASILLIGALGGLSHLRANECRYWSWSSWGYQDNIESGPNSPTHNSYCLFSSTQGSGTYYLNTLTTYSAGGASFTQKFNGGTLNVGGNIRFGGTGINGGDVGYITGTYDAQTINFNSSHLTTGNSYADGGGATLNFNAANNITINQASFDNSDAGAQKSYMNFKGSNIKVSGSSFKDDTDGGFSFSGNSNNSTISFNQTNFNQGTYNFSNSANLSFTNSAFNQGTYNFNSAQSVFENSSFNQGTYNFNSAQSVFENSAFNQGTYNFNGNASFDNDIFNQGTYNFNTSKVSFSGANTLNSSSPFASLKGSVSFGSDAVFNLNQTLNSNQTYDILTTNGTIQYGVYQSYLWDLINYKGDKAISHVEVGNNTYDVTFDINGQDETLQETFNKQSIITQFLGDDLQQQAQKTYQQDLSNSQSALNNAASDSKVANNDTGYTQSKNATVAKDAQGLENTNQKIQQDEQALEKDLAQIKQLANSTTGFNQQAFNQAQSTEQQDEQTLQNEENTFNIEQESLDKAIANAKHTSPTPSPTPTPTKHTAQNTPPNKVSPTPTPPTQNLPTTNVWNGVYWLQNQTYSKQGVYYIDPNLSGQSGQSANTLSTYTANLFGRSFGVNIQNGTLIIGNNTESVNDNGLIWIGHGGFGYITGTFSAANIYLTNNFKTGEGVSNSDGGGANITFKASDNITMDGLNYNDAETVTKMIQTGASQHSYAAFDALNNISVTNSSFSDMTWGKFSFSAKNISFSNASFSGFTNPGGSSVISANASNSLSFINSRLNGGAVYNLWANSLIFNNTQAVFNVLHSRGTSNFNATTQLLGNTNFTLSSQSLLNFNGDTTLQNNANITLGNKSQAAFKNSLTLDNDSNLSLDNQSVLNANGASAFNNQASLNIYNGSQATFKSLFFNGGTLSLNASSKLNASSASFSNNTTINLDDSVLSASNTSSLNANINFQGASQADFGGNTTINTASFNFDSASSLSFNNLTANGALNFNGYTPSLTKALMSVSGQFVLGNNGDINLSDINIFDNITKSVTYNILNAQKGITGISGANGYEKILFYGMKIQNATYSGNNNIQTWSFINPLNSSQIIQESIKNGDLTIEILNNPNSASNTIFNIAPELYNYQASKQNPTGYSYDYSDNQAGTYYLTSNIKGLFTPKGSQTPQTPGTYSPFNQPLNSLNIYNKGFSSENLKTLLGILSQNSATLKEMIESNQLDNITNINEVLQLLDKIKITQTQKQALLETINHLTDNINQTFNNGNLIIGATQDNVTNSTSSIWFGGNGYSSPCALDSATCSSFRNTYLGQLLGSTSPYLGYINADFKAKSIYITGTIGSGNAFESGGSADVTFQSTNNLVLNKANIEAQATDNIFNLLGQEGIDKIFNQGNLANVLSQMAMEKIKQAGGLGNFIENALSPLSKELPASLQDETLGQLIGQNNLDDLLNNSGVMNAIQNIISKKLSIFGNFVTPSIIENYLAKQSLKSMLDDKGLLNFIGGYIDASELSSILSVILKDITNPPTSLQKDIGVVANDLLNEFLGQDVIKKLESQELVNNIINNIISQGGLSGVYNQGLGSVLPPSLQNALKENDLGALLSPRGLHDFWQKGYFNFLSNGYVFVNNSSFSNATGGSLNFVANKSIIFDGDNTIDFSKYQGALIFASNDVSNINITTLNATNGLSLNAGLNNVSVQKGEICVNLANCPTTKNSSSTNSSVTPTNESLSVHANSFTFLGVIASNGAIDLSQVKNNSVIGTLNLNENATLQANNLTIANAFNNASNSTANINGDFTLNQQATLSTNASGLNVMGNFNSYGDLVFNLSHSVSHAIINAQGSATIMANNNNPLIQFNTSSKETGTYTLINSAKAIYYGYNDQITGGSSLDNYLKLYALIDINGKHMVMTDNGLTYNGQAVNIKDGGLVVGFKDSQNQYIYTSILYNKVKIAVSNDPINNLQAPTLKQYIAQIQGVQSVDSIDQVGGNQAINWLNKIFETKGSPLFAPYYLESHSTKDLTTIAGDIANTLEVIANPNFKNDATNILQINTYTQQMSRLAKLSDTSTFASADFHERLEALKNKRFADAIPNAMDVILKYSQRNRVKNNVWATGVGGASFINGGTGTLYGINVGYDRFIKGVIVGGYAAYGYSGFHGNITQSGSSNVNMGVYSRAFIKRSELTMSLNETWGYNKTFINSYDPLLSIINQSYRYDTWTTNAKINYGYDFMFKDKSVIFKPQVGLAYYYIGLSGLRGIMDDPIYNQFRANADPNKKSVLTINFALESRHYFNKNSYYFVIADVGRDLFINSMGDKMVRFIGNNTLSYRDGGRYNTFASIITGGEIRLFKTFYVNAGIGARFGLDYKDINITGNIGMRYAF

SEQ ID NO: 10303 - protein, 696 aa, Chlorobium limicola
MYIHHGRSSLCAALIAVAATNTASALDLEELIITARHDTRTIDVSEALSISPDAAELLRDAPGANVATNGPITGIPQYRGLFGPRISVSLDGSLLAPAGPNWMDPPLSYAVTAQLEALEVYRGIAPVSVAQESVGGAIDARTRRMAFSADDQIRTEGRLVGSAQSVNTGYQIDADLQAANDQHRVKVAAMLQDGDDAEFPGGTILPSRYERQRYDLGYGFRWGDHNIQLDYGYNDTGSSGTPALPMDIDYFEGDLYKLAYRFEPKQGAQLSASIYASELDHGMSNYALRPSPVSPESWRRNIADTRNSGFKLEASLADDTGGWRAGIDGFDENHNSNIDNPNNPMFFVVNFNGAERSLVGGYLEREQNISEHIRVELGVRANRVRSNAGEVNGTPAMMMPPAQALRDAFNAADRDQTDNNVDLVAKLNYAVNDALSLYMGLAQKQRAPSYQERYLWLPLEATGGLADGQLYIGDINLDSEEAHNLEFGLDFAGDRITMHPRVFYYRINDYIQGTALEGTHPATMMVRMMNNMNGTNRADPLQFSNVDAALYGFDMDWAWRLSERMELSGLVNYVRGERKDIDDNLYRIAPPNASLRLSYAGDNWSTMLETVGYSAQNNVSATNRELESSGYAIVNLRGTWQVSPSLQLAIGIDNVFDREYAPHLSGYNRVRNPDIATGERLPAMGTNLFGRMVYTF

SEQ ID NO: 10304 - protein, 349 aa, Chlorobium limicola
MKKSLMALAVLAASGAAMAQSSVTLFGVLDATYAYGSGSLSNKSQLTNSGIGGSRLGFRGTEDMGGGLSASFWIEAGVNNDDGTGTATDTNNQANSSGGGGLAFNRRSTVSLGGGFGEVRLGRDYTPQFTNLTAFDPFGTNGVGSNQMLVSSVGGPTRVRASNSIGYILPGNLGGFYGQAMYYLGENSSNSANKKDGNGLGLRAGYKNGPIDAALAFSQTKYLTGDIKTVNLGGQYDLGMVKLMAQYSQDKATKRGTGKGMLAGGTVPMGPGEIDFSYSTYKLDVAGPVDPRTNLLAVGYTYNLSKRTALYTTFARASNKGGATIALAGATTAANTNSNGYNFGLRHSF

SEQ ID NO: 10305 - protein, 346 aa, Chlorobium limicola
MVMTRFMKLFLSFAVVSCHYGLAQELQVSYTTELQSDFKQGSNWVNLLRLDFTHSLGKHTTLQAATISTARTRTESLADDFQTFSNIEEENHPLAFATLGVQQQFGHSSLFFGIRNLNEDYFTSPVTSLFTNSSCGIFPTLSADYQIANYPVASVGLHYELQFTRWSLQASVYNGKGYYRFSGKENVFRFCPQSDGILSITSLNYQQHGSNYHVGFALHSGMYMDYEEGTPEKTKKERRKIIWGYAEQRLAPGLHALLQGSFQSGTSRGCKSYAGTGLTWQCGKTEGGLFTDYARFSPSYEWASEFTWKIPFSGNGFIQPTLHFIQQAGARYLIGLLRFSYVLPTT

SEQ ID NO: 10306 - protein, 171 aa, Chlorobium limicola
MKTKLSLLALALCSTSVLADSWIYAGGQIGQSDIDGENDTTYGVHVGTGILPLIGIEVGYFNHGKVDLSFGGNKGDADFTSFYLAAKPSIDFGPLHVYAKGGINAFNVDYNGGLSSVSKDDGVSYMYGVGAEYFLLDNISVGASYQSFGVDINGDSDNLSSFTGNVTFHFL

SEQ ID NO: 10307 - protein, 1487 aa, Chlorobium limicola
MATTSYSEDYTITQETKKESKEILKHEKEDSGKVGTFAKSGNVIVFKENGFLINNGVLKGSIKADGEDTKNEKSKKGEIIVTAQGNGVSGVGYSPYSNKNDINKKIDSVSNNGYISGEANLTGGNAEAFGSIEEVYSAANGISGLALSDFGEGGIVDGPGGATRSGRRKSASLLSTNILASKTAEKNLENKVGEIKKTDPKDFYGKNNKFTLGDITNSETISGKAILKTKEGYIRKDSEAFGGKLAISHQWRTINATSTGNGISNLSYITTVDKYTYSEDKVNGSYIKNIKNSGIISGNVEATTGSGATQTTIRASVTGNGISSAAYSNNFVKSLTEATIDKIQNRGTISGRLKAEVGNNTARGFHEYSNAIITGSANGVSVYSRSSNGQMKNSRAVIGELNNSGSISGNLYAKAGSGYGEVRADVKSSGNGVAIYTESSTKKETKIGNIDNKGMITGKAVIYGGKDKKAMENKTLRDKIFHVPLTNNIAGYSLPDEDVEDDKKAVAEMKKYEKEMANELENKIAKYQKQIENKEKDILAKTPKKPEISETDKKDRDDTFKKYLRDEIKEQQNLIWSGINDTVVAEAKKRKAELEKLGSNATDDEKIKFLEEYKKVLEKRLEESGDPTWKNQEKKNRIAKINDILNKNKVKDIPDSPEILALKKEKAELEKELAKVMDEKKKSDHLAANIHTETGVVASGNGISINDGKEDGVVLGSLKNSGVISGETEIHHGNSQRKYSRIAHKNSGAGIAVGGNVEGKIENTGIISGTEFALLAKGKRNDAYGIDKENVTYESGFKGGVDNYGILAGRIIIGGYQSAHTGSHGEWGKIEEEYGYFETIYKDKKHYNNKGIFLVLDRNGEVRKVIGEDKETIHNGRTVKNVLDINGTYEGDISNKIINGVGKDGVVVAKENQNKNIENSIINGFKNAIKVKKNGLVKISNSTINANGFGKSYAILGDEGANEVEITNKSIINGKIDLGAGDDRLTLSGNYRLNREVDLGAGNNTLAFGKKENGIRSTSSYSTFGASSTNTSVFNGTVNNANKVEVNENTAFSSNSRINGVNELNLANGKTLDYYFVDKENQAFAELAKSNRNLKVNGSGKVNLVPIGSKVQIGYEKDLLGFSFGNNLLKPNSNGGTTPPNNGRVTSPNNNPRNNTPGNRGGFFIDPRLTPFDRYSKGAFDAYIADYKSTGIDFLKDYKSTQEVFKNYLYNLTNNNPVGYLKDSAIDTVLAYHKTNTNSNFAKKGQTTVSGETFNIRNKYYENNKVVSNGASAEISYGTSDNTNIGLNIGGGQSKVKTSNENIKSEVLVLGVNAEYKVKNFSWKNEISYGRIKPKKYSALDTYSLYSQLGYNIPLSETWSLTPKVSVFLSKVKQKEMTVNNIKVAKDDDTFVETTVGTELNKKFMFGNNGINFGLGVDYSMVKDLDDSKAHFVGGSTEFDLRNYDRKNRATAEIKFGYEHISGITATFRIRKNKDITSSGFGLGYKF

SEQ ID NO: 10308 - protein, 630 aa, Chlorobium phaeobacteroides
MIIKNTMTIKKYTLLTALSVTAFSGWAQGNNTTDNNNEMVVTANRFPQPKSSVLAPVDVVTRADIDRWQSTNINDVLRRLPGINIAQYGGPRQLSSLFIRGTNSSHVLVLVDGVRLNQAGISGSSDLSQIPISLVQRIEYIRGPRSAVYGSDAIGGVVNIITERETLGSTLTAGLGSNGYQNYNGSTQQKLGDDTTITLAGNYDYSKGYDVVAKGNTGMASQPDRDGYLGKMLWLGANHKFNEQFSGFVRGYGFDNRSDYDSYYYPGSPLVDTRSLSSRTYDTGINFSNGGYASQLIGSYSRTQDYNYDPSYGRYDQSATLDDISQYNLQWTNTYQLGLGNVGGGLDWQKQTTEPGTNYLSNGYEQRNTGVYGTVQQFVGPVTLEGAIRGDDNSQFGWHTTWQSSAGWEFVDGYRLIGSYGTAFKAPNLGQIYSSTYGNRDLKPEESTQWEAAITGITGPLDWRLSAYRNDIDQMIATRGVYPNSRYYNVEKATIKGVEWTGSFETGPLSHQVTLEYLDPRNADTHEILARRAKQQVKYQLDWQMADLDWSVTYQYIGQRYDSVFDPITYAASPVKLAGISLWDLAVSYPVTSHLTVRGRIANLFDKDYEMVYGYQTPGREYYFTGSYNF

SEQ ID NO: 10309 - protein, 449 aa, Chlorobium phaeobacteroides
MKKILVGVALIGSAVSAQAADLAVKAPYLKAPIAAVYDWTGFYIGANVGVGLGRDLQTHAVPAGGVASHLSPQGVIGGGQIGYNWQSNTTFLGPLLIGVEADIQGSGMTDGHTTLSSPLGAANYNQKLDWFTTVRGRVGLVRGPVVGYFTGGFAAANVKTTVTQIGGIVPFAFSETRTGWTIGSGVEAAIGGNWTGKIEYLYLDLGNRNDVFGTQALRTEYRESIFRVGLNYRIGGNGMYITPPPANWAGLYLGGNFGGATARNRTTSSVIFSENFNLSPDGFVGGGQIGYNWQASNWVFGAEADFQGSTQKDDRAAVLSSLLLYNQKLPWFGTARARLGYTVGSTLFYATGGYAYGNVKTNVVTAFSNETFNRSRSGYAVGAGVETPFQLFGLLGPNWTSKTEYLYVDLGSTTDSFLGGAAVSTSKVTNHMLRTGINYHFNQPVVAKY

SEQ ID NO: 10310 - protein, 417 aa, Chlorobium phaeobacteroides
MLFGLTCGAALPALADTDSNVFTRSTLTGDWGGLRHQFDEDGIKFTGDYTGETAYNADGGLHRSARYSQNIKLGAQFDLSKLYGVDNAGKIQLTINDRRGNSASEDLVGNRLPIQENYGGLYTRLTELSYERSLFTPALNVKLGYMAMGNDLGGLDSGILCNFMNAGFCGHPLNMSGGSGWTNYPNAHLGVRVKYDLSPAWQLRVAAFNVDPESNGNSSRAWHLGPKHTTGTVVPIELVYKQAGKLPGEYKLGYYYDSSDVKRIGSDKEVSGRGGHYVLIDQAVWASDVSEGRSLHAFGQYSAASEAASPFSKWYGTGLVLYKPFEGRPRDTVALGYGRAVPNPRSRDVLQDTAMANGAAFPNLDSAEQLIELGYGYQATPWLTLRPNVQYIIEPGAFSGQDIDNALVFGLQVKAAL

SEQ ID NO: 10311 - protein, 633 aa, Chlorobium phaeobacteroides
MKKKILLSIFISSILVAQSIELKPLSITSTAITTDELKSTDAVEIYTAEDIQKAHVQNIYEFLNQQSSATATPSFGNSFMQKLDFRGYGIGDGYQNILITINGKKINNIDMTPQLLSAISPASIQRLEIIKSSGIVKGGDGANAGAINIITKKDSAKEITVYSGTQGTADGSFYLGHSEERFSISSSGEAQRGDGSRYINSAQDKDESSLKTASLNISYNPIDTLELRAGASFARTDITYGSFLTLDEYNDDTKQAGGTNWGAANQKYDTDALNLGFSYNLSDKISLNIDGAKEKKKSVYNSISQTDYEYDSLNSSLNYIDTLFSFTLGYDIFDGNLVNTKSDLRKISNALYFINEIYLGSSTIKMGARYEDISFKSKSGEDQDDTLYGVELGYNYTFDREKSLFANYSHAYQSSSLDRLFDWSSGAFTGYVKPSESDNFTVGFNYLTPMNRLKISLYYISLEDEIYYYADPTYQSSRNTNIDKSYKYGLDIYDKWLIDEALSVVLNYNYVQAVIDKESENGDDYSGNKLPGVSNHNIKATLAYSLNKNTSLALTQTYRSKTYAINDFNNNFAQKQDAYKSSDISISYTKERLELFAKISNLFNQKNGLWVEDNAIYPMNFTTTAIAGFKLKI

SEQ ID NO: 10312 - protein, 1340 aa, Chlorobium phaeobacteroides
MNNTCVLSLINYIKLLYIIKFLNRYRLVKYINNINNNSKYLTKINIKSIPCILILLFSIVCIKVTITFAMDKNSDMNDKEASTPNISNFLKGLVPKKLHCYLDDEQTELDINVTAIKESQKTKNPSQKSIIINCTIIHPQLREPLIFGSYTQVNQSELELLKTLVQQPITIRQLAQLGLSGAESSNKLQTAAQLTSPLGSKRKYAPVSSTETLTTRTSSSIETSSIPQSTQSASSSIITTSNLEEPVVRPKIPSTKQGKNKAPLDKPQTLVTASKRSVFSLNLQLLENLGLQKIKAIYEEGQSTLHILLQTIKDLHREGQADKELTEKYRSMLEQQVELAKFIKEKEEEEEQQQIKQVMKRHENVQDLLEMLKKNISCSTSTPEQINFDLLSLPVDQLSQLDLTTLKNIFEPVESKRRTLEDQIRQQIKEGKQVDPTLQQKYQYLVTLQTDVLMATKNFSEEKLSQLPPTSGLAYRLQEVKAITQLLKEKIPPSPKSEDGNNIQFIILEKKDDRRSETSKTTVRINQQGIQTTNTKEKTKKKNLIATLDKSSSLLETDIEPPHSSEQQSSSSSNSTKKKKKEKKTSPVKTHTFSANIPSEEVITTTSISSEQTTVQMPLEAKTLVATGDKQQPSSSSHHKQKKKQTQTSTLSSNQSLLSIHANSPSPSIESTSQQSNAMPLKTKEAIENECTPDIPRKKKEKKKHLKHTPKNPSSSIPTCCEEEKTSTSNEDSTIPYPTLNRPEFEELKIPDTPKKKPKKKKKPGLGTLVGDSLLSEGRTTSTSDTTPIQPPSGFINQDHKDKKEALKNCPLSPPDEFSDDDNTKEDSGPMYIPGVFCGNNLDLESPRPKKPHTYLPNIIGDVTSITTETLETLDIYNSPLGEGEEDNEDPQKNVGENEEIQVAVRESEQSQAQQQQQPQCTNNTGTSPLGQNTPQHPIVAQTPAQPTPLPGNGRRARRQQTRQTQLLTKKHPSTNSLIAELLPEGQFSSLQSLQFALSDTSEFISETLKSLALKAHFSSKHLSTTTHKKLQLCLNNRKTSGSLNKSTIENTNIIEALQPTKSYTVFTSINKYTTNLENKLRSAQAGIMLNFSPTTNIGLAYNFNKKEYKEYSGTQLNSSNGSVKSKSTTDGLAAIFTLNPEKKGITGTMIGFYSWGKVTNSRRVTHGEKHIVTKGSPDITLTGGLIHLGYNIPAIKTLILTPYIGCLVSNVRWSPYTEEQSPVVCKISENRENLLEKSIGLKTKWELTEYSQLQTWIVGSSGLKQTNSLSSNSMITPLFKYTISAPSYKKKYTKAEGGLSYEVQLSPTLTLDIDGILSFEKRKKIEKKQHISFHFNYYY

SEQ ID NO: 10313 - protein, 187 aa, Chlorobium phaeobacteroides
MKKVLSLITVMFFLLLPALSWSASVRPGAYVSGFIGVSVPRDASVNSSQFASDGSMLNATDEVEFDPGINIGGTGGYDFGFLRLEGELSFKYSEINRITDTADGFRFGNPDGNIGVFAMMGNAFFDLHNPGPVTPYVGGGVGFATLHLSDTFGTDVTTSGPERIFLYPEDDDMVFAYQAGAGVGIAL

SEQ ID NO: 10314 - protein, 206 aa, Chlorobium phaeobacteroides
MKKSFMSMMVALFVLLVSSSFAQAAANPYVSLSAGLGLMSNTDVEENGTEYEDVLEYSAGYVVNAAVGLDADMFRLEGAVGYQVNDVDKFDGMELPDGIDAEVSILSFMANGYVDFESEASSITPYVMAGLGVGIVDLEVEGELDGADSETVFAWQLGAGVGIQATENVVVDLGYRYFATGDIADEDDVDVSLGSHNLMAGVRFGF

SEQ ID NO: 10315 - protein, 382 aa, Chlorobium phaeobacteroides
MKQAYLTALISALMASQAVAIEIYKDDTNKVNIGGWIDVRAIDTQDVSEIANGASRINFAFERQLKNDWHAFAKLEWGVDPVGTGRVIYNGDESFGSSQDDFIYNRLGYAGLSHADYGSLTMGKQWGAWYDVVCYTNLAFFTDGNASGTYTYNKFDGAVNGTGRGDKIVQYRNRLGDVSFAAQVQLKSEKITLDKANDPLEVSRLDYSNTAGLGVTYQVNDQWLMTLGGNYGQVEGNRFDGTSFDETDYIYGFGFAYGWWDVAGFYAAANFNWNQFHDTDNLNRMIPESKGVESIIAYQYDNGIRFILTYNLLEASAEYAKAYQGDVFKRQSMVAGVHYLFDTSTVVFAEFSKNLGDFNGQRAAAMELSEDDALLIGLRYSL

SEQ ID NO: 10316 - protein, 237 aa, Chlorobium phaeobacteroides
MKKALSLIMVFLVAVAFSATGYSADKYISGNIGMSWMNNSDIEDAAGIIDILDAEVEMDYGSGLTGTGALGCDYGDYRLEGEVGYQSGDIDGITFDFTNVAEAHGEDIDVFGADLDGDVSVLTLMVNGYYDIDLGGIELSPFVGVGVAKVTISDLKYDGDLIEDAEHPEDLINDLNLDLNETTLAYQAGVVIGIPVADNVMVDARYRYFATTDLTTLALLNTNVDSHSAMLGLRFGL

SEQ ID NO: 10317 - protein, 808 aa, Chlorobium phaeobacteroides
MPVASRPFRKRALAVAVRGSLFGAVLVAGVGQLLPAVAQPLDAVAIRTYQIAPGPLGRVLSSFALACGVALSFEPALTDGLHSPGLSGAYSARDGIAQLLAGSGLELVELSNGSYQLIRQPSSGDSLTLAATTIEANGIRHETLPEAYAGGQVARGGRLGMLGNKDVMDTPFSVTSYTAKTLADLQTVTVADALERDPSVRSTGQTGGIVDSFFIRGFPVGEGNLGELAFDGVYGVAPNYRVFTEYAERVEVLKGPGALMYGISPNSGVGGVINIVPKRALAEDLTRVTASYSSDTQVGGHLDISRRFGDQRQWGVRFNGSLAQGDTAIDDQQRALDIGAIALDYQGERLRLNLDFISQKERWDAASRPFTVAPGFGVPSAASGRTNLPQDWGWSNTREQSALLGGEYDISDSLTVFAHAGGGRADVARMSDQVPKILNAAGDTSNTPGYYKFNVDRSTADVGLRALFETGAVNHTVTAMATRYQDELSRGINFGKEIVSNIYHPVDVPKQYIAAPKVSRVSESELTGVALTDTLSVLDDRVQLTLGVRRQEIESRNYTAGVFTTRYNDSAITPVVGVVVKPWENVALYYNYVEGLSKGDIAPDTATNGGDAFAPYKTKQHELGVKYEHNTFMTTVSVFQIEKPSGELGADRRFSVEAQQRNRGIELSMFGEVAPGTRLLGGVTVLDGKLTDSATPANKGNEAVGVPDVQANLWAEWDTPWAEGVTLTGGAIYTDSQYIDQANTQALDAWTRFDVGARYATRIDGRPTTFRATVQNVFDREYWSGVASYGAISPGYPRALQLSATVDF

SEQ ID NO: 10318 - protein, 1132 aa, Chlorobium phaeobacteroides
MDTHWRRSARMKGRATIQKRVPGSSKHGRRTGRDRAIAPLVTKKQRSIDNCSTSDIFPGHFHLQPTLEGSGMHLNRVLRETGVVVAAGLLYGSAAFAQSSTIIGTVIDAQSRQPAADVVVTATSPNLQGEQTVVTDAQGNYRIPQLPPGDYTLRFEKEQFKPYARSAIQLRLNRTIRVNVELLPEALGEVVEIVGAPPTIDVGSTTMGVNVDQEFIKRIAVARPGGKGGATRSFESLAELAPGAQNDNYGVSINGSTSPENGYVVDGLSTNDPAFGVNASPLSIEFVQDVNIITGGYMPEFGRSTGGVINAVTRSGSNEFHGSVFANWTPGTLEGTRKQIREEGTVITGQNQLQNLGDFGATLGGPILKDKLWFFAGFAPSFTRYQHTRTLNALRVDDEGNTIKDETDFTVADAIPGSARKYYADSRTIQYMGKLTYLINQDHNVSFALNGTPTSTGGLGKLSVNPQSGGLPGVLATRPGDFGLTETKANTTSLALKYAGAFADKKVLVDANLGWFHQTASTLPGDGSNLGDRTGLAGYSRMVYTTPRALTLFEALPEGQEGACGSTPEEQLLRCPVTGYGVGGPGFMSDQTLDRYQANAKATYLLNALGTHVFKAGVDVELLSFDQVKAYGGGVFFQEGSNYGVAGQGPAVHDARRYGYQTGPDSAVTQFTQVAKTTSTTVGGFLQDSWSIANRVTLNLGVRYDVQALYGGNGDLSLLLGNQWSPRIGAIVDPFANGRAKVFVNFARYYEQVPLNLMDRAFPGENRISARRSLAEPGQGTATSCDPSSFESQQATCNTDSNLLAIPESSRNVNRFYTGGTVGGTPVDPDIKAQSSDEIVVGAEYEVLANTRLGASYTHKDMNSVIEDMSRDDGNTYFLGNPGSGFAGEFPTPVRNYDNVTVYLNRTFADGWLAQANYTWSRLYGNYPGLFRPETGQLDPNILSDFDLIELLENRTGLLPFDRTHQIKVFGAKEFNISNALSASVGVSYRGSSGTPINYWGSHWAYLQDESFVLPRGAGGRTPWINTIDSNIGVNYRVSKDSVVSFTLDVFNLFNFQGVNTVDQTYTLRDIKPIPGGTPADLENLPGRVEFQDQAPRDEPFGSVDGDVNKNFKNPLSYQAPRQVRFGIRYTF

SEQ ID NO: 10319 - protein, 921 aa, Chlorobium phaeobacteroides
MNIVTSKIGSKILRIIQNNKKLGLLSALVVLDAALLSVNSRSSEGLIGQSASLPNYHETEQQIAACPKNIAKNLAKKSSPGSKPTVGASFPSQPVSVKAAPAKPQTPVAQTRHFKKSHQIFSPNFTQSPQQVNKPEERRRPLESRYLQGAVKQAAAAKEKKALEQEVSKQEEEASKLWEEKQSYARRAVNAINFSVRKQIEEQQKTISNPGNDQTLPRKKDPQTSGEPVIQTVQDCSQDQEEEKKVLERLNKRSLTCQDLKEVEYTVNFEDISILELLQFVSKISGTNFVFDSNDLQFNVTIVSHDPTSVDDLATILLQVLKMHDLKVVEQGNNVLIYRNPKLSKLSTVVTDGSAKDTCEAVVVTRVFRLYSVSPSAAVGIIQPLLSHDAIISASESTRHIIVSDIAGNIEKVRELLQALDSPGTAIDMSEYDVQFANPAALVSYCQDVLGAMAEEEAFQIFIQPGTNKIFVISSPRLTAKTIQLLESLDIPEMAHTLDDVTSPAAALGSSGAANPKSLRFFMYKLKYQNGAAIAQAIQDIGYNLYVTTAMDEDFINTLNSIQWLPVNNSIVVIGNQANVDKVVSLLNGLDLPPKQVYIEVLILETSLEKSWDFGVQWAALGDEQGKVAYASGLLSNTGLTDPLRNQSLPVAPNPGNISLPTPGQLAGISDMMYGSSAFGLGIIGNVLSHNGKSYLTLGGLLSALDQDGDTTVVLNPRIMAQDTQQASFFVGQTIPFQTTSTVIQETGSVTQNIEYEDIGVNLVVTSTIAPNNVVTLQIEQTISELHSAQGVLTPVTDKTFAATRLQVPDGCFLVMSGHIRDKLTKIVSGVPLLSSLPLIKGLFSRSIDQRQKRNIMIFIKPKVISSFEEGTALSNTEGYRYNWESERGSLEVAPRHAPECQHIPKVQAESDFKMLEIEAE

SEQ ID NO: 10320 - protein, 393 aa, Amoebophilus asiaticus
MKRILILPFLAVLLSGPAFAQGLGGPSSVQADLQPGDGLTDPQFRSDFPVNIAPGYFRWKESLAQKGFSFNFDYLALGQTSNSDQGEGEASGGIFRFYGTWKATEFGSLTFKLEDRHAYGDIAPQNFGFDGGALSITGTAFNDSGTLLTNFFWTQRADDGAWTFQIGQIDTTDFVDVYGLVSPYTAFQNLAFNTNPTINAPNAGLGIAAGAKLGSNFYATGAIADANADPSSPDFDVFSEGELFKSVEIGYTSGFDRVYFDNIHLTLWHADDADDGSRREDYGAAFSAAWFLENKWMPFFRAGTSKGRAALYDKSVSAGLGYYARNTDLAGVGLNWAEADGISGDQKTIEAFYRFSISPNLQITPSVQYIKDPLLSSGQSSVTLFGLRARIVF

SEQ ID NO: 10321 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDLTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDESSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNCGARMTF

SEQ ID NO: 10322 - protein, 1784 aa, Chlamydia trachomatis
MKFMSATAVFAAALSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQVLKNSAGQHGGGAYVTQTMSVTNTTSESITTPPLVGEVIFSENTAKGHGGGICTNKLSLSNLKTVTLTRNSAKESGGAIFTDPTSIPITDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESGEQLQDSTQSNEENALPNSNIDQSNENTDKSSDSYTEEITDESVSSSSESGSSTPQDGGAASSGAPSGDQSISANACLAKSYAASTDSSPVSNSSGSEEPVTSSSDSDVTASSDNPDSSSSGDSAGNSEEPTEPEAGSTTETPTLIGGGAIYGETVKIENFSGQGIFSGNKAIDNTTEGSSSKSDVLGGAVYAKTLFNLDSGSSRRTVTFSGNTVSSQSTTGRVAGGAIYSPTVTIATPVVFSKNSATNNANNATDTQRKDTFGGAIGATSTVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMSMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLKTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYLGPLWTLYGSYTIEADAHTLAHMMNYGARMTF

SEQ ID NO: 10323 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGDQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTVDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPSWTLYGSYTIEADAHTLAHMMNCGARMTF

SEQ ID NO: 10324 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGDQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNTTDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPLWTLYGSYTIEADAHTLAHMMNCGARMTF

SEQ ID NO: 10325 - protein, 1770 aa, Chlamydia trachomatis
MKFMSATAVFAAALSSVTEASSIQDQIKNTDCNVSKVGYSTSQAFTDMMLADNTEYRAADSVSFYDFSTSSRLPRKHLSSSSEASPTTEGVSSSSSGETDEKTEEELDNGGIIYAREKLTISESQDSLSNQSIELHDNSIFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLAECVDSLSEDTLDSTPETEQTESNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLIGEVIFSENTAKGHGGGICTNKLSLSNLKTVTLTKNSAKESGGAIFTDLASIPITDTPESSTPSSSSPASTPEVVASAKINRFFASTAKPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATEDPNSNTEGSSANTNLEGSQGDTADTGTGDVNNESQDTSDTGNAESEEQLQDSTQSNEENTLPNSNIDQSNENTDESSDSHTEEITDESVSSSSESGSSTPQDGGAASSGAPSGDQSISANACLAKSYAASTDSSPVSNSSGSEEPVTSSSDSDVTASSDNPDSSSSGDSAGDSEEPTEPEAGSTTETLTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPGTQNTETVKLESGSYYFEKNKALKRATIYAPVVSIKAYTATFNQNRSLEEGSAIYFTKEASIESLGSVLFTGNLVTLTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTGGSGGTPSTDSESNQNSDDTEEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISVLWKFDSYRQWAYVPRDNHFYANSILGSQMLMVTVKQGLLNDKMNLARFEEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNKGEWEDLGWLTALRVSSVLRTPAQGDTKRITVYGELEYSSIRQKQFTETEYDPRYFDNCTYRNLAIPMGLAFEGELSGNDILMYNRFSVAYMLSIYRNSPTCKYQVLSSGEGGEIICGVPTRNSARGEYSTQLYLGPLWTLYGSYTIEADAHTLAHMMNCGARMTF

SEQ ID NO: 10326 - protein, 232 aa, Xanthomonas campestris
YDVNAPYVALTFDSGKFSVDGSLRYDMGDARGSYNGTAIAQNLDVNGDGVIQTVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYQGFTLNGGLTWTDAEISRDQITPENTGNVPRRQADVVWQLTPSYRGDSYQ

SEQ ID NO: 10327 - protein, 232 aa, Xanthomonas campestris
YDVNAPYVALTFDSGKLSVDGSLRYDMGDARGSYSGTAIAQNLDVNGDGVIQPVEQRVATVDTANARPVDYDWNYLSYSLGSNYLINDDLGAFARVSRGARANADRLLFGVIRDDGSVSSDEGVNVVRQTEAGLKWRRDGLSLFATAFSARTQEQNFEVTSQRFFNRSYKAHGVELEASYRYEGFTVNGGLTWTDAEISRDQITPENTGNVPRRQADVVWQLTPSYRGDGYQ

SEQ ID NO: 10328 - protein, 232 aa, Xanthomonas campestris
YDVNAPYVALTFDSGKLSIDGSLRYDMGDARGNYSGTAIAQNLDVNGDGVIQPVEQRVATVDTANARPVDYDWNYLSYSLGGNYLINDDLGAFARVSRGARANADRLLFGVIRDDGSVTSDEAVNVVRQTEAGLKWRRDGLSLFATAFAARTQEQNFEVTSQRFFNRSYKAHGIELEASYRYEGFTVNGGVTWTDAEIARDQITPENTGNVPRRQADFVWQLTPSYRGDGYQ

SEQ ID NO: 10329 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITRDANITETNYFVVQIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 10330 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSIATIDVSVPANFSKSGYTFAFSKNLITSFDGAVGYSLGGARVELEASYRRFATLADGQYAKSGAESLAAITREANIAETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 10331 - protein, 3322 aa, Vibrio alginolyticus
MNKTYNIIWNAARGMYIVTSELARSGSRAIVSVSASCAVTLLAMDAAPAVAEETRVSIPSQTTTYTLSGATPFVVETGNTVATDTATSAAIVGDNSNDWDLLIESGAVVGSSLTDSQAMNLDSSTGATSVHNQGTITGSNEDGAIMLQNGGSVINDARIENSATYEHDPEDIPQEYAGVYMLNGGSYVSSESGVLEGVSGVIVQSGEAHITNGGMISSDGSWRSYGVEFRDGTYGTIVNTGTIITTASDGSNKIEDAAIYVHTLNDMAVSGSVSVDNSGLMQSDFITVALYHGSHFEVVNRVGGVITAGNSSLVGIKSTAMELKVGVDNLVTNDGTISAYGTANTYGIHYGESTSGGVITNTGSITTTGGGAGDASVYVHGNGDGTVVNNSGTMSSTVYGVYLDSARSKGHTLNNQAGSAISANTAVAINGNGNTISNQGKMTGVSDGLLISGNNNIVTTSGGEISGKNGIRVSKGSGNQITAKSGSKITTTSTGISIAGGNNQITTESGSAIVAKDNGILINSGANNVTNGGSITATGSNMSYGIQYNSGASGTITNTGTITTTGKGAGDASVYAHGGAVTINNSGTMDSSVFGVYVTTGHTLNNLAGGSISANTAVQFHGNNNKLANAGAILGDTNGVTINGSGNTLTSQGKITGGINAILINSGSKNNTLTLNTGTEISGSITDDNNSASANNNLILDGEGTLGSSISGLNSVTSSGDWTLSGATMNLSGTTNSALWVKSGTLILNGAMTAKGATVDSGTTLQIGNGGTLGAFNGDIVDNGTLTFNRSDAAAYGSVISGSGNVVKQGGGELTLSNNNSYSGGTTIAEGTLTATAGGALGSGNIDNRAYLKLDAASASDPFIVADLTTHSGATVEIGAGSTLQANTLTQQDGSTLTADLTATSGPAIRAKNVNLDGTLNVASPASQEPIRSTDDLISLALIESDNAISGDFDDITINGNAMNPDAFITVVGQKNVNDTHYDLVETLTWYADRDNAAIDAHGTFNLADADDSFTVNTVLENVDANSGWNGQSLTKTGAGTLILNAENTYTGSTTISEGTLIATNVEALGTGNVTDNATLEMNTGGDFDNAISGSGQVVKSGDETLTLSGANSYTGGTTISGGTLVASNVEALGTGDITDNATLELNAGGDFANNIGGTGSVVKSGDKTLTLSGSNTYTGGTTISGGTLVASNVEALGSGDVTDNATLEMNTGGDFANNIGGTGSVVKSGDETLTLSGANSYTGGTTISGGTLVASNVEALGTGDVTDNATLELNTGGDFDNAISGSGQVVKSGDKTLTLSGINSYTGGTTISGGTLVASNVDALGSGDVTDNATLELNTGGDFDNAIGGTGSVVKSGDKTLTLSGANSYTGGTTISGGTLVASNVEALGSGDVTDNATLELNTGGDFANNIGGTGSVVKSGDKTLTLSGTNSYTGGTTISGGTLVANNVEALGTGDVTNNATLELNTGGDFDNAISGSGQVVKSGDKTLTLSGANSYSGATTISGGTLIATHVNALGTGAIDNRASLLLDASGQFTVTDLTTESGGNTEIGAGSTLQATTLTQKSDSTLTINLDSNTADPVIHAASQVSLAGTLDITGVGDVLDSDPASTDDLDTFTLIASDKTIAGDFEKLTVAGMDADLADFITVDGRIDDTGKQYELTTALTWYADRDDAVTDAHGTFNLTNADGSFAVNTVLENVDATLDPASATGWDGTSLIKQGAGTLILNAENTYTGGTTISGGTLVATNVDALGSGDVTDDATLELNTGGTFDNAISGSGQVVKSGDDVLTLSGANSYSGGTLISDGTLVASNVEALGTGDVTDDAVLELNTGGDFDNAISGSGQVVKSGDETLTLSGSNTYTGGTLISDGTLVASNVEALGTGDVTDDAVLELNTGGDFDNAISGSGQVVKSGDDVLTLSGANSYSGGTLISDGTLVASNVEALGTGDVTDDATLELNTGGDFINNIGGTGRVEKSGDDKLTLSGSNTYTGGTLISSGTLVANDVNALGTGDVTDNATLMLNTGGDFTNNIGGTGRVEKSGDDALTLSGSNTYTGGTLISGGTLVANDVNALGTGDITDNATLALNAVGDFDNAISGSGKVEKSGDDALTLSGSNTYTGGTLISSGTLVASNVEALGTGDVTDNATLELNTSGTFDNAISGSGQVVKSGDKMLTLSGANSYSGGTLISDGTLVASNVESLGTGDVTNNATLELNTGGDFTNNISGSGQVVKSGDDALALSGANSYTGGTLISSGTLVATNVDALGSGDVTDNATLELNTGGTFDNAISGSGQVVKSGDKTLTLSGSNTYTGGTLISDGTLVASNVEALGTGDVTDNATLELNTSGTFDNVISGSGQVVKSGDDALTLSGSNTYRGGTTISGGTLVATSVEALGTGDVTDNATLALNTGGDFINNIGGTGRVEKSGDQTLTLSGANSYTGGTLISSGTLVASNVNALGSGDVTDNAVLELNTGGTFDNAISGSGQVEKSGDGTLTLSGSNTYTGGTLISDGTLVASNVEALGSGDIDNYASLQLNASGQFVTANLTTHDNATTAIGAGSALRANTLTQEANSTLAVHLIDSNSGAIVTADHANLGGTLDITGIGNVAKSWTRDAYAYTLIDTDSAINSDFAQFTVAGMDAKQVDFLTVDGRVNADDDTRYDVTASLSWYADSDNAATDAHGTFTLSEQGHSFTLNTALTDVDATLNPDSATDWDGKSLIKRGAGTLILGAQNTYSGDTDVQEGALWLAETATIGSAGSAQAVNIAANAAFGGHNATVNGHVNNLGNLYFVDTFTVNGDVVNSSAMISGSDQPNNTLTIAGNYTGNDGHLYLNTQLGDDSSPTDKLIVTGDTAGSTTLHITNVNGLGAQTVNGIEVIEVGGQSDGDFRLYKGHVDINAWTYTLKQDGGDWYLRSESDDVPDDGGEVTPPDDGGEVTPPDDGGDVTPPDDGGDVTPPDDGGEVTPPDDGGEVTPPDDGGDVTPPDDGGDVTPPDDGGDITPPDGGDVTPVAPQYRADIGVYLGNQWMARNLQMQTLYDREGSQYRSADGSIWMRFKAGKAESQAVNGNVDIDSDYSQFQLGGDILTWSDGAQSVTVGLMGSYINASTDSTGNRGADGSQFSANGSVDGYNLGLYATWFADAQSHRGAYIDSWYQYGAYNNSVDNDGLSASRYDSAAHAVSLETGYRYDIALSNRNTVSLTPQAQVTWQRYSADTVIDDGGTRISGQNDDSWTTRLGVRVDGKLYKESGRIQPFMEVNWLHASDNASATFGDTKVSQDLPNDRLEVKVGIQANVSERLSVYAQAAGQKGKNDYGDASFSLNMRYNW

SEQ ID NO: 10332 - protein, 419 aa, Vibrio alginolyticus
MTQNTRLFKKTLLAVTVAFASGQSMAAGFQINAQSATGIGRAFAGDAVIADNAAVMARNPAAMALFDKMELSLGFESITSMIEVKDAKYNVNTPLGSNTVSVADTDDVGDTSIAPNIHLIVPVNDKFAWGVNAYSNFGTKTEFSDNYTAKEYGGLTDVKSFNFGLAGSYRLNEQWSFGAGLDLIYGQGTMKRTTSSSVPRVGGQKILDVDKADGWAVGFNVGTVYELDENNRFGLAYRYSPEFTAKDDKGQEITLPLPDMAEFSGFHKIQDTKFAVHYSIQYIGWKDFDQIDFENLNQGLLKGGYSKDYQWQDGWHYAIGGTYYLNNNWTLRAGYMYDTSAQDKVTSISVPDSDRQWFSTGFSYHIDNSSNIDFGFTYLLGEDVKVNENTQLAPGLSTGVTATTHADAILFGLQYSRSF

SEQ ID NO: 10333 - protein, 320 aa, Vibrio alginolyticus
MKKLAAVISASLLMASAAQAEVYVGGKMGKSWMEDACVAGQACDKDDSTLGAFVGYEMNKYFAVEAGFDNIGDFNQTSFGGHVEAITLAPKFSLPITEDIALYGKVGGAYVMFDGKDDYSYLGAAGLEFNLSQNVTARAEYQTLTDISNDVTRATGNTATLGVSFKFGGNDEPVIVEEPVVVEEVVVEEVVEEPVVVTKTFETQTIGTGSFDLNSTTLKPESAAKLDNLVAFLNEHPQANVEVVGYTDTSGPAAYNLKVSEKRAESVANALVEKGIDSSRIQARGEGENNPIASNDTREGRQQNRRVEVVVPEFEYQVQQ

SEQ ID NO: 10334 - protein, 2201 aa, Zymomonas mobilis
MKKFKNTLFNVNLTKKSLKISLLSASCLALFIPVAGFAQCTTSGNSVTCSGTVGDTTTSQTNYTAQIGTGKNSSINSVTINPNASVSYQRTVISLGSGSSSNHNSITIGGSVISGGLGSGPNGTGGNAVEFGNNTDLTIAKGGLIQVNSTGAYNAEAINPTGSGNIITNYGTIKTNSNASALWMEGTDTSVKTNGINTVDNYGLIQATPSGTGTIIGNSNSGIVYFTNRSGATVNGNISLGSTGNLANVVTFENGSKVNGTVSGGGNAATLNLTGASGSDSLSKSVSGFGTLNKSGNGTWSVGSAEAPLSSLSDSLHINVGKDPSGNTTDGGTLILAGDVSSKNAVIGIDNGTLQLGTGSTSGWVDGITHNNGTLVFNRSDTNTLSSNIDGVGQVQQIGSGTTILTGTNTYTGVTTISNGALQLGDGTTSGTITNSSAITNNANLTINNPANTTLSQVISGTGSLTQVGSGTTTLSGTNTYTGVTTISNGTLQLGDGTTSGTITNSSAITNNANLTINNPTNTTLSQIISGTGSLTQAGSGTTTLAGANTYTGQTTVAQNATLNLPGAVAGNLVNAGTTNVNGGTVGGITSNTGTLNAQNAALQDINNTAGTTSLNNSTAGSITNASNATFSAIGGIIHSVDNSGTMTLGTGNTVVGNVTNNDGSLTLGKGNYVIGNVTNSKGSLTLDGNVIVGTLAANGGSFEVTSANSGLNSLAGTANGNLDGTLKIYDAQDTYSGSMTGQGGVQLLGGTETLSGTNTYTGQTTVALNATLNLPGAVAGDLVNAGTTNVNGGTVGGITSNTGTLNAQNAALHDINNTAGTTSLNNSTAGAVTNASNATFSAVGGSLASATNSGTMTLGNGNNVAGDVTNNDGSLTLDGNAVAGTLAANGGSFEVTSANSDLGSLAGTANGNLDGTLKIHGAQDTYSGSMTGQGGVQLLGGTETLSGTNTYTGQTTVALNATLNLPGAVAGDLVNAGTTNVNSGTVGGITSNTGTLNALNATLHDINNTAGTTSLNNSTAGTVTNASNATFSAVGGSLASATNSGTMTLGNGNNVAGDVTNNDGSLTLDGNTVAGTLAANGGSFEVTSAASDIGSLAGSANGNLDGALNLHNAKDTYSGAISGQGSLNILDGTETLSGTNTYTGQTTVAQNATLNLPGAVAGDLVNAGTTNVNGGTVGGITSNTGTLNAQNAALHDINNTAGTTSLNNSTAGTVTNASNATFSAVGGSLASATNSGTMTLGNGNNVAGDVTSNDGSLTLDGNAVAGTLAANGGSFEVTSANSDLGSLAGSANGNLDGALNLHNAKDTYSGAISGQGSLNILGGTETLSGTNTYTGQTTVALNATLNLPGAVAGDLVNAGTTNVNGGTVGGITSNTGTLNAQNAALHDINNTAGTTSLNNSTAGTVTNASNATFSAVGGSLASATNSGTMTLGNGNNVAGDVTNNDGSLTLDGNAVAGTLAANGGSFEVTSANSDLGSLAGSANGNLDGALNLHNAKDTYSGAISGQGSLNILGGTETLSGTNTYTGQTTIAENATLQLGNGETSGTINNTQDIINHGTLSVNNSHAVTMPMLISSSGQFKQIGIGTTTLGDHNSYSGGTTITSGRLVGSAHSFGTGAINNYSALIIAQPSNATFDNSINGTGTLTKTGAGILTINSNNSLSGSTFLNQGELAVNGSLASSSVTSQPGTILSGTGTVGGITAKAGSIIRPAGNIIGTLNVSGNYQQDAGATYAVQVLPGTNTSDVLSINGKASLSDGAILSVSKASPGNYTLETKYRVLTTKGGVSGNYTLTGDTALSAFYGLGTTYDANNVYLEVKQDHLFVEEGKTSNQIAVAGGLDSLASNSVIKNVVGSLMTGDQARQAFNTLSGEIHASARTSLFQDSFYIRDITVERLRASDCGIGTDADTKKTCDIKKKREAEGACEGAAPALWMQSYGSWGRNSGNDNVATMNHSTGGFVLGADTPIGRSKWHIGGLFGYGYSSFNIPNRSSTGHSNNLTAGAYGGTSWGNLGFRMGASYTWNILSTNRTATIGQFSNQLNGHYNGDTAQVFGDLGYRFDVGNASLEPFANVAYVNLHTDSYHEHGGEAALHGKAIDTGLTYTTFGLRAAATLQKGDTAWIPNITVAYRHAFGDVDPTVTQRFIAGGNDFSVAGVPLSENSALVNAGFKVKAGKRITGGISYIGQYGDHYLSNGLRGTFSWIF

SEQ ID NO: 10335 - protein, 287 aa, Neisseria gonorrhoeae
GAIKAGVQTYRSVEHREGKVVGVGTGSEISDFGSKIGFKGQEDLGNGLKAVWQLEQGASVAGANSGWGNKQSFVGLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQTVRDNSHNSQTEVAATVAYRFGNVTPRVSYAHGFKGTVDSADHDNTYDQVVVGAEY

SEQ ID NO: 10336 - protein, 287 aa, Neisseria gonorrhoeae
GAIKAGVQTYRSVEHREGKVVGVGTGSEISDFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYSEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 10337 - protein, 287 aa, Neisseria gonorrhoeae
GTIKAGVQTYRSVEHTKGKVSKMETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 10338 - protein, 287 aa, Neisseria gonorrhoeae
GAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFGNVTPRVSYAHGFKGTVDSADHDNTYDQVVVGAEY

SEQ ID NO: 10339 - protein, 287 aa, Neisseria gonorrhoeae
GTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWRANSHNSQTEVAATAAYRFGNLTPRVSYAHGFKGSVHSADYDNTYDQVVVGAEY

SEQ ID NO: 10340 - protein, 286 aa, Neisseria gonorrhoeae
GAIKAGVQTYRSVEHREGKVVGVETGSEISDFGSKIGFKGQEDLGNGLKAVWQLEQGASVAGANSGWGNKQSFVGLKGGFGTIRAGSLNSPLKNTKDNVNAWESGKFTGNVLEISGMAQREHRYLSARYDSPEFAGFSGSVQYAPKDNSGSNGESYHVGLNYQNSGFFAQYAGLFQRYGEGTKKMEGYYLYNIPSLFVEKLQVHRLVGGYDNNALYASVAAQQQDAKLYGTWSANSHNSQTEVAATVAYRFGNVTPRVSYAHGFKGTVNSADHDNTYDQVVVGAEY

SEQ ID NO: 10341 - protein, 266 aa, Neisseria gonorrhoeae
GTIKAGVETSRSVAYHGAQADRVKTTTEIADLGSKIGFKGQEDLGNGLKAIWQLEQKAYVSGTDTGWGNRQSFIGLKGGFGKVRVGRLNNILKDTGGFNPWEGKSYYSGLSNIAQPEERHVSVRYDSPEFAGFSGSVQYVPNDNSGKNHSESYHAGFNYKNSGFFVQYAGSYKRHNFTTEKHQVHRLVGGYDHDALYASVAVQQQDAKLTWRNDNSHNSQTEVAATAAYRFGNVTPRVSYAHGFKGSVYDADNDNTYDQVVVGAEY

SEQ ID NO: 10342 - protein, 196 aa, Wolbachia endosymbiont of Hylyphantes graminicola
GPISDEETSYYVRLQYNGEILPLYTKVDGIAHAAGQSPLKASFMAGGGAFGYKMDDIRVDVEGLYSQLAKDTAVVNDSETNVADSLTAFSGLVNVYYDIAIEDMPITPYVGVGVGAAYISNPSKASAVKDQKGFGFAYQAKAGVSYDVTPEIKLYAGARYFGSYGASFKKATTSTTNDINVLYSTVGAEAGVAFNF

SEQ ID NO: 10343 - protein, 194 aa, Wolbachia endosymbiont of Hylyphantes graminicola
GPISDEETSYYVRLQYNGEILPLYTKVDGVKTKGDDSPLTRSLIAGSGAFGYKMDDIRVDVEGLYSQLTKDKNVMDDEKTAGSVTAFSGLVNVYYDVAIEDMPITPYVGIGVGASCLSNPSSATLVQNQKGFGFAYQAKAGVSYDVTPEIKLFAGARYFGSYGASFNRETVSDNKEVKVLYSTFGAEAGVAFNF

SEQ ID NO: 10344 - protein, 196 aa, Wolbachia endosymbiont of Hylyphantes graminicola
GPISDEETSYYVRLQYNGEILPLYTKVDGIAHAAGQSPLKASFMAGGGAFGYKMDDIRVDVEGLYSQLAKDTAVVNDSETNVADSLTAFSGLVNVYYDIAIEDMPITPYIGVGVGAACLSNPSKATGVSDQRGFGFAGQVKAGVSYDVTPEIKLYAGARYFGSYGASFKKATTSTTNDINVLYSTVGAEAGVAFNF

SEQ ID NO: 10345 - protein, 193 aa, Wolbachia endosymbiont of Hylyphantes graminicola
GPISDEETSYYVRLQYNGEILPLYTKVDGITNAAGKEKDSPLTRSFIAGGGAFGYKMDDIRVDVEGLYSQLTKDANVVNDNSAADDVTAFSGLVNVYYDIAIEDMPITPYIGVGVGAAYLSNPSKADGVKDQRGLGFAGQVKAGVSYDVTPEIKLYAGARYFGSYGASFKKATTSTNKDINVLYSTVGAEAGV

SEQ ID NO: 10346 - protein, 196 aa, Wolbachia endosymbiont of Hylyphantes graminicola
GPISDEETSYYVRLQYNGEILPLLTKVDGITNVTGKEKDSPLKASFIAGGGAFGYKMDDIRVDVEGLYSQLNKDAPIINASETNVADSLTAFSGLVNVYYDIAIEDMPITPYIGVGVGAAYISNPSKVDAVKDQRGFGFAYQAKAGVSYDVTPEIKLYAGARYFGSYGANFDKTAKDDAGIKGVLYSTVGAEAGVA

SEQ ID NO: 10347 - protein, 199 aa, Wolbachia endosymbiont of Hylyphantes graminicola
GPISDEETSYYVRLQYNGEILPFYTKVDGITNATGKEKGSPLTRSFIAGGGAFGYKMDDIRVDVEGLYSKLAKDTDVVNTSETNVADSLTAFSGLVNVYYDIAIEDMPITPYVGVGIGAAYISNPSKADVVKDQKGFGFAYQAKAGVSYDVTPEIKLFAGARYFGSYGASFDKAAKDDTGIKNVVYSTVGAEAGVAFNF

SEQ ID NO: 10348 - protein, 199 aa, Wolbachia endosymbiont of Hylyphantes graminicola
GPISDEETSYYVRLQYNGEILPFYTKVGGIASAAGKQKDSPFTRSFIAGGGAFGYKMDDIRVDVEGLYSQLAKDTDAVSTAETNVADSLTAFSGLVNVYYDIAIEDMPITPYVGVGVGAAYISNPSKADTVKDQKGFGFAYQAKAGVSYDVTPEIKLFAGARYFGSYGASFDKTSKDDNGIKNVLYSTVGAEAGVAFNF

SEQ ID NO: 10349 - protein, 206 aa, Wolbachia endosymbiont of Hylyphantes graminicola
GPISDEETSYYVRLQYNGEVLPLFTKVDGITGLKKNATDTADTTDLYNASFIAGGGAFGYKMDDIRVDVEGIYSWLNKDTSVTGTPAPVGGVANNLTAISGLVNVYYDVAIEDMPITPYIGAGVGAAYVSNPLATKVTDDKDSGFGVAYQAKAGVSYDVTPEIKLYAGVRYFGSYGANFGKATKDDAGIKVLYSTVGAEAGVAFNF

SEQ ID NO: 10350 - protein, 197 aa, Wolbachia endosymbiont of Nilaparvata lugens
GPISDEETSYYVRLQYNGEILPFKTKITGITHKSGKDEDSPLKASFLAGGGAFGYKMDDIRVDVEGLYSQLSKDGDVADNPAIAESLTAFSGLVNVYYDVAIEDMPVTPYIGVGVGTAYASNPLATKVTDDKASGFAFAYQAKAGVSYDVTPEIKLYAGARYFGSSGANFGKTAKDDAGIKVLYSTVGAEAGVAFNF

SEQ ID NO: 10351 - protein, 193 aa, Wolbachia endosymbiont of Propylea japonica
GPISDEETSYYVRLQYNGEILPLYTKVDGITYTSGASPLKASFMAGSGAFGYKMDDIRVDVEGLYSQLNKDAAVTDNDAADGVTAFSGLVNVYYDIAIEDMPITPYIGVGVGAACLSNPSKATGVSDQRGFGFAGQVKAGVSYDVTPEIKLYAGARYFGSYGASFKKATTSTTNDINVLYSTVGAKAGVAFNF

SEQ ID NO: 10352 - protein, 157 aa, Wolbachia symbiont 1 of Protocalliphora sp.
TKVDGIAHKSGKDNNSPLKASFIAGGGAFGYKMDDIRVDVEGLYSWLNKDADVVGDTVADNLTAISGLVNVYYDVAIEDMPITPYIGVGVGAAYVSNPLATKVTDDKASGFGVAYQAKAGVSYDVTPEVKLYAGARYFGSYGANFGKTAKDDSGIKV

SEQ ID NO: 10353 - protein, 128 aa, Wolbachia symbiont 2 of Protocalliphora sp.
SDTGKKSTLIGFQHQNEDLNRDTFLGNISPITGALVTADSAAYIYTGVQAQYKLGKINFTPSFAPGLYSKGDGKDLGHILEFKSELQISVDFVSNSQLGFSYNHLSNASLGTKNPGANSYMFNFFKTF

SEQ ID NO: 10354 - protein, 186 aa, Wolbachia symbiont wAlbA of Aedes albopictus
SYYIRLQYNGEFLPLFTKVDGIEYKKGTESHNPLKASFIAGGGAFGYKMDDIRVDVEGVYSQLSKNNVTGATFNPDTVADSLTAISGLVNVYYDIAIEDMPITPYIGVGVGAAYISTPLKKAVNDQKSKFGFAGQVKAGVSYDVTPEIKLYAGARYFGSFGAHFDKDDAAASKDKGEHKVLYSTVG

SEQ ID NO: 10355 - protein, 161 aa, Wolbachia symbiont wAlbB of Aedes albopictus
TRIDGIEYKKGTEVHDPLKASFMAGGAAFGYKMDDIRVDVEGLYSHLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINV

SEQ ID NO: 10356 - protein, 1046 aa, Actinobacillus pleuropneumoniae
MQADEAATLEQVDVAAQFEKAKAAGDKQKEIVNLSLLGRQTAFTSPISVVNYDEKAFEDKAPRNVVDAIAKTDASVMNFGGESNTLSGVYVRNLQLDMRQVSVNGLAGLYSTYNSPTVAVASAQLIKGASTATTGMDPEGSAGASMNIETKRATDEEINKIGFGWYSNNRLQETFDFGRRFGANNEWGVRVSGKYRDGDTARHDYDEMNKELAIGADYRGDALRVGLDYMYSKRDTDGGRARLQDLQNLAYTVPVAPNGKTNLNPHWLGQTTEDETVMGTFEYDLPYGMMLSGGLGHMESRYSGAFGQITSPKQNGEFEVSGIRGFDFRSRTTSGNLKLQGDFEAGAISHNWNLAFDSVIRQRDHDQSSKTNGKIKGGTIYAPNFAQLKNFDLTANTQGVDSKLSANSLAFADTLGFVENTVRLTLGGRFQWIKQQDKKAGTEVKADRFSPMVTLAYVPNPDLVLYGNYLEDLEPGNIDVETGEMNSPRVSKQIEVGVRKNWDNWLTTTLSAYEIRRPGIIRGNKAALKAQAGKEHGKERNRGIEFNTYASLLNNTLRPSLGLTYNQAKVFDFPTYADVITDGVQVTSPRWMAKANVEWDTPFVANLTLNAALQYYGKSYQDTAANYRLPPYTTVDFGAKYVVKVADKQTLTLRGWVDIPKGVVFFIYLFIILATALSVWIGRPLIRLNFNKEKLQGDYRYSLIRVRDNAESIAFYSGESREQHNLTAKFDYIIANRWKIVRKMLGLDGFNTGVTQVAMILPLMLQAPRFFAGQATLGDMHQTVQSFNRLMRALSFFRLFYEEFTLYQARLNRLYGFFITLDKLDQMPVNAPYPCSRGFVLKDFGVKDASGQILLKNINIELHTGDSLLIQGASGTGKTTLLKALAGIYPFETFGIAERACLEQPLFLPQRPYVPQGSLREAICYPNLSVTDEQLKAAMQECCLHKYVDSLDFDTDWQATLSPGELQRVAFVRILLAKPELIFLDETTSALDEPTEAILYRTIRERLPNSIIISVGHRCTLQQFHNKQINLSERERCECMDCGYCS

SEQ ID NO: 10357 - protein, 588 aa, Actinobacillus pleuropneumoniae
MGTESGRISFRGFNGEGRINAIKLLIDGIPSNDNAGGMPYLDAISPLGMSAIEIVRGTNDPRYGLNAIAGHVDVITRSGGNDGLLSVTTGDFGTRKIQWVKGIERGAWSQNYVVSWLDSDGYRDHARAIKRAVSGKWGYADPRDAWRAGLSVRYFHNDAQEPGYLTYDAAVADPRTSPAYSGQDYCQRQTVQTALHLDGRMSEAFHWTAKAYINRYTNDRVVKFTAASARQERYTDETHRGVLTNAIWRPSVDWAYEFSIEGGVDAQWQSNVSRRYRMLDGQRGTVLRDWDFDLDTYGAYLQSMIRVNDSLKLVPAYRVDRIDGRFSDIASWLRYPVYRYGTIQQPKFSVSYDVSQDVTVYANWGRTFQIGSGNGAYRTQADDLAPSMNDGWETGLTFKPWSWANARLVYWQQRASGEVATLFGTNGAIAINEVGNVGKTLRNGWDAQLNLQPDEQWRVWLGYSRQKAEIAIPDPSAPATRGKQIENVPRWLTNVGAEWQVLPKLKFSAWGNGQGNYYVERTNTLGRYGRYFLSNLSATWLLSNKSELTLQLNNVTNRFYVYAWYDSGLSGYSPGDGRALYLTWNLTF

SEQ ID NO: 10358 - protein, 790 aa, Actinobacillus pleuropneumoniae
MFNKKLLAVLISAQFSPLVWANNNDVAVLDEVSVVGSTPSISQGSEVTLLKVSDKIIAGKEFKKRSATLGNALAAELGVHSNPFGGGASKPIIRGQEGARIRILQNGSDVIDMSNLSPDHAVVADSLLAKQVEILRGSSTLLYASSSPAGIVNVVDKRIPTEIPEKGYEVELNSRFDTAAKEKVGALGATFGIGKHIAVRAEGLTRHSDNYRVPGINLGERLNYVPDTYNKSKVGTLGLSFVGEQGYIGASYSKRRDNYGLPGHNHKFDFCIGHIYGNKQGKYAYTYLYPHLIGEENIGSNPHFHCGTDHAEDGTHSHDNPFGHDHDHTHPGPWVDLESKRFDVKAELRQPFKGIDKIKVSYADADYYHDEKDAGVLATRYHKQLKKDQDYGKPVNIFKNRGKNARLEIYHAPLGGLTGVWGVQYQTQKSSMHAPKDREVKFPLVENTNKQMSLFGIEQYMWDNFALEFAGRVEKQKIEIEYDRNEIKRLQDHYRISGGKQVEPDLSPYNQNAYAYSSTLNWFFHPDYQLSFTASHNERFPTPMELYYHGQHIATNSFEYGNKDLKKEQSNNVELGLGYQTERVGYKVNVYYNHFKNYIYNENLFRENQLFMRRYNQAKARFYGIEAEASYRFNDKYQATIFGDMVRGWLTNLPPLTVNSDYSVFKDYLPKDAKPGEDYLIYRADQNTPRTPPVRLGFRFNAEFTPNWSGDLELIRTFTQRRTSQLEYITEGNTMLNIGVAYSNKWKDLDYKISLNGTNLLNQPVYIHTSYHQFVPQTGRNFILVVNVKF

SEQ ID NO: 10359 - protein, 463 aa, Actinobacillus pleuropneumoniae
MNHTFNKTLIASLLTLSAGGVSASLFQLAEVSTSGLGMAYAGNAAVADNASVVANNPALMTKFKRPEISAGGVLVDTDLTVRGITSNGNQAYAGNVVPTAPIPNMYFVLPVNDDFSFGLGYNVNYGLKTKYPTDFAAGSLGGNTELQAHNFNLSGAYKLGYGFSIGAGLNVVYSKAEFIRHLGDKVEAGAARAKAGAAQARAAAAKANAAGLTAQAQALTATANKYQALGNLLSSYKRSTEVARVSGDEWSLGWNAGLVYELNENHRWGLAYHSPVDVKFKGHYSNSISAATGSSIVAFPTAGQEFPGKLTLNLPAFWELSGFHKLTDRLAVQYSWKRTEWSRLKTLDAYGTKGEHYLHKKEDFSDASRYALGVSYDVSEPLTLRAGIAYDENASTNHPSISIPDTNRMWYSVGATYRVTPALSVDAGYAFLRGTANSFDEKGTAFKIKARGNLYGLNLNYKF

SEQ ID NO: 10360 - protein, 898 aa, Actinobacillus pleuropneumoniae
MKNKLNLISLALLSLFAAQSYAEQAVQLNDVYVTGTKKKVHKKENEVTGLGKVVKTPDSLSKDQVLGMRDLTRYDPGISVVEQGRGATTGYSIRGVDRNRVGLALDGLPQVQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKDAESRSKRIQRVDLADNNPQDSNWFKVKNDCPSLNCEPRQQAKVSYDGQKYLTEQLSAKEYTGEERALPDPVKYKSDSWLVKLGYSLSPKHYVAGVYEHSKQRYDTRDMTYPAYWQLSDLKNGNTWYPMNNAKGLYRSNALDGVAIDYFTEDGVKSSKGLRWAKARFIDEWHTRDRLGALYRYTNQDKDRLIDSLSLSFDQQKIDLSTRLRENNCSEYPTIDKNCRATLDKLWSSTKNEQSSYEEKHDTIQLSLDKTVQTGLGKHQLNMLLGSDRFNSTLKRHEILSKFSVGTWHRINGNGYQNNPYIYELKDQAIYSKNECNYSGTIAGRADCATSKIKGHNHYIALRDNFAITKYLDIGLGYRFDKHKFRSTHRWANQGDYKNSAWNVGVVAKPTSFLSLSYRASSGFRVPSFQELFGLRYDGAMAGSSDAYQKAEKLSPEKSLNQEIAATFKGDFGIVEVSYFKNDYKQLIAPAEKMHQTQSMINYFNVQDIKLDGINLIGKLDWNGVFDKIPEGIYTTLAYSKMRVKEVKNYPGYMNIRTPLLDTIQPARYVVGIGYDQPDEKWGVNLTMTHSSGKNPDELRGNEQVGFANYERTATKKRTRSWHTFDLTGYVTPWKHVTVRAGVYNLMNYRYTTWESVRQSSLNAIHQHTNVKDYVRYAAPGRNYVLSVEMKF

SEQ ID NO: 10361 - protein, 686 aa, Actinobacillus pleuropneumoniae
  misc_feature (220)..(220): Xaa can be any naturally occurring amino acid
  misc_feature (236)..(236): Xaa can be any naturally occurring amino acid
  misc_feature (277)..(277): Xaa can be any naturally occurring amino acid
  misc_feature (284)..(284): Xaa can be any naturally occurring amino acid
  misc_feature (303)..(303): Xaa can be any naturally occurring amino acid
  misc_feature (390)..(390): Xaa can be any naturally occurring amino acid
  misc_feature (394)..(394): Xaa can be any naturally occurring amino acid
  misc_feature (407)..(407): Xaa can be any naturally occurring amino acid
  misc_feature (415)..(415): Xaa can be any naturally occurring amino acid
  misc_feature (492)..(492): Xaa can be any naturally occurring amino acid
MKKTFFYSTVASAVALAISPAIAQETAVLDEVSVVGSVSKAGKVEYMTPKSVNVINDAQIADENAQKVDQALRYEAGIVTEPYGGDNDTDWFKIRGFDASMTLDGTALGKNGFFVWLPNTYGLESIEVVKGADSFTYGAVETGGLVNLVSKRPSKEPKGEIKLTGGNKDERGVSFDVSNQFADNLRYRVVGDYNKRHGQLNGTWLESYYFAPSLEWDISXRTRLSILTSYQKDSGXPSSNFYPQEGTLRALPDGSYYSRNLNFGDPVNDHEENKQYXIGYELSXDFGNGLRANSSYRYNHVEXNHRGGYIYPSAYAADWSAVAPSANGYNVSGQTVFNQGKAISHSTDNRISWDFKNDWLKNTVVVGTDYRHNKVDAQYSLYALGYTANXRDYXATWNQTGTPVGTXTHIKSRQXGFYLQNQARIADKYLLGFGIRHDRARQNEYTSDQTVKNNHTSYSGSLMYEGAYGLNPYFSYSESFRLPVGLSGNQSXYDPNITRQYELGGKYLPSFINGTFSLAWFDLEEKNTLIADPSNISVQAGKQKSHGVELQANLGFTDNLSGQFAYTYTKAKTDLSVSQSIRSALIPRHAYAAKLNYRFADNVLNGLTVGAGIRYVGSTTDEQYYKGYKIGHYTLADLSAKYEFAKNWVAQVNVDNLFNKKYLASCSFYCYYGEGRKVTANLTYKF

SEQ ID NO: 10362 - protein, 271 aa, Actinobacillus pleuropneumoniae
MKKTALALFASAFMASSASAVELFNLDSTGTKAEFIGSARVKWTSTSTKDTYQNGSAVRNHVNKPVQNNGSRFGFRLTQQLGSGVYTLGRVEWRLRGADERGVSSSQHDFDHIYAHQLYAGFGHKQYGEVTYGNQTVITDEVKQTDIPNTLSLSDGLLVSGARRSVQYVYKGIEGLKVGAYYGGHSQRSNTNMDLSQDRKDVWGFGSIYNHKFDDVQSVQVATGFSRERFERIGSAPTYDRNAYSVGAAYTYDKTTFGVDLERRKTENQSV

SEQ ID NO: 10363 - protein, 202 aa, Actinobacillus pleuropneumoniae
MKQCIRVCAVLLVLLVSAPLAQAATPYVSASAGLGLLADSDFTDNTGIVSDAVDYKTGYTVSGAVGLDAGTLRLEAALGYQVNDLDGISGVLGPDPDNTRLDILSLMANGYLDVEVPLSMITPYLMAGGGLANVSFDYGDGNSDDDTVLAYQLGAGVGFTGMPNVVIDLGYRYFATTDFTPEDPFSFTIASHNIVAGVRFGF

SEQ ID NO: 10364 - protein, 932 aa, Actinobacillus pleuropneumoniae
MLEKYYFNKSCIAIAISTFLSTSVAYADSLESPHSGIKLSDEISSKYSGKGVKLGVLDGGFVVQHPLNSSKLHPSSFKLTSPDGKVLTYDPSYLQFEVKPVEQNGKKDLTALFETHGLGVSGVISAKASKKDGFKGGVAKDAEIHIATNTPNRSLAELIAEAQQSESEDEGQGDSKNQKPNFDELAKDDLLLTKEKRLSFERLEWATALNKLVERNLFAINNSWNLDPISDNIADFDKLYHSLSTDKQNSLLQAVLNAKRKNTLLVFAAGNESKKQVGVMAMLPRYLPELEKHYLSVVAVDNKNNLTKYSNHCGVSKNWCVAAPGNLAILNAIPDNKLKPQYSLDKEEGTSLAAPVVTGALAILKERFNYLAPTQIRDTLLTTATDLGEKGVDDKYGWGVINIAKAINGPSQFLNDETVNVTRDDHWKNDFSSKFKFTKQGEKSLDLAGKNNIARIDVEQGRLNLSGMTQSKQVKNNAHLGVNQTEIRQGYMATENSQLTLLDSNGLIGKDKAIIQLNGSLKIADKLTENSKQGSISATVVKLHDRASYQGGFTKLIDNKNLANKGLMQDLYFKQSEIIAKVNSNKAFTDPNASDNAKSGLSLLNQLRTSSFAYRQGVYNDWLQSALEQKKLGQLHYAVSNHIYADALALLRHQNAKQLSHVQHNLFTAAYSPQKTSVWLEHSGQKHSKVAIKQNSSTLGLSHKFNDNALLSATLMRKNHHMDKDFAHADLKQTSLNIGLRYPLADHWFSELALQFGQQKYNQRRWYKKSQLGQAQNKGHHMGGEIRVGYQFMPQTWIIEPSLGVQFIQTRMKALNEKGELATNTTALHYNDINLTPSVKLKYTVKFEQGSISPYVGLNYLHRVKGKESKITSQLNGYPLQSYATQKRNHALNLEAGMQFQYKNWFVSANVDYDRIKSTNAFGWKTNIGLTF

SEQ ID NO: 10365 - protein, 358 aa, Actinobacillus pleuropneumoniae
MKKTLVALAVTAFAASASAVTMYDAEGTKVQVDGSLRLVLEQASSKTKYANGQTEKKKNAHSQLRNAGSRFGVRVNHDLGNDFYALGRLEIRFDKNNSDDKFGDLYAKRAYVGLGSKQYGEVTFGRQLTIADDYGQTDDYEYGIVPSYIATSGNQVIRYDYKGIEGLQIGANYNFAEKRNARGEVLGNELKNAYGLGAVYETQLGGNTFNVEGGIGRSNYATGTNHKHYQDGYELALGYAIGDFKLVSDFGYKYEKNGAARTKAFFVAPGFQYQVIPASRIYGNYLYERAETTVDEKDAAKAKKHGFLLGVDYQLHKQVVAFVEGKYVQSKDYIAGNGYKYTGKEIDKAIGVGMRVFW

SEQ ID NO: 10366 - protein, 948 aa, Actinobacillus pleuropneumoniae
MIVIKLRFNLSIAALCVLQYNSALAQEQMQLDTVIVKDGIQQQKISEIKKSAKQLAKQQVQDSRDLVRYETGVTVVETGRMGSSGYAVRGVDENRVAITVDGLHQAETLSSQGFKELFEGYGNFNNTRNSVEIETLKQATIRKGADSVRVGSGALGGAVMFETKDARDFLTEKDYHFGYKTGYSSADNQKANSLTFAGRYKNFDILALKTWRDGHELENYDYKTADGSVQGKEREKADPYSIKKDSTLIKFGYSPSDNHRFSVVADLYEKKNRGHDFSYNLKPTTYINVDEYELRHTNDKSKRQNYAFVYENFSANPLWDTLKLTYSTQKIKNRARTDDYCDGSHCKETENLAGLQLKDGKVVDRDGNQPNLGVDELGLTTITDSKGTYTEGVNLVRAYWFDCSVFDCNKSVTAYYKDYSNNITSEEVALTKTYTDEKGRKFATLDPKSKFKSILLPGSKGYTENIYTERDLDTDTKQLNLDLTKSFSLLGQEHSLEYGGSYSRTEKKMVNRGGFGATSNTQWWTKRFLGMRNNFFKGTEEVITCKNATGSDQWNGLICPNEDTFSFLIPVEAKNGSLYFADNLKANDYLSFDIGYRYDDISYKPKYVAGQTAKIPDDMLQGLFVPLPDRPTKEQIRQNAEENIKYLSRNVKYQKHSYSLAATADPFSFLRVQVKYANGFRAPTSDELYFTFKHPDFTVLPNVDLKSERAKTKEAALTLHGDLGFITTSYFKTDYDNFIDLKYLGPKNLMNAFGGSATARPYQIYQNVNRQEARVNGLEISSKLNFGQLWQALEGFNASYKYTYQKGKMEGNLPLNAIQPRTSVFGLGYAHPEDKFGVDVYVTRVSAKKAEDTYNMYHSEEKAKDSYLKWRSDAYTLLDMIAYVKPWKNVTLQAGVYNLQNRKYLTWESVRSIRPFGTSNLINQATGKGLNRFTAPGRNFKLTAEVTF

SEQ ID NO: 10367 - protein, 215 aa, Actinobacillus pleuropneumoniae
MKKAVLAAVLGGALLADSAMAHQAGDVIFRAGAIGVIANSSSDYQTGADVNLDVNNNIQLGLTGTYMLSDNLGLELLAATPFSHKITGKLGATDLGEVAKVKHLPPSLYLQYYFFDSNATVRPYVGAGLNYTRFFSAESLKPQLVQNLRVKKHSVAPIANLGVDVKLTDNLSFNAAAWYTRIKTTADYDVPGLGHVSTPITLDPVVLFSGISYKF

SEQ ID NO: 10368 - protein, 707 aa, Actinobacillus pleuropneumoniae
MRFSPSKLSMAVFLATTSLAYAQENTVNLDVVSVVSENAGAKSRTNVVTLKDLNKGTKEDLRGVLSAEPAINFGGGTGGTSQWTTIRGMGQDQIDIKVDNTYSDAQIFHHQSRFMLDPSLIKRIDVRKGAGSASAGIGATSGSIEATTVDAKDLLREGQDFGFKLNAGVSSNKGHSQGASVYGKSGAFDALLSGNWETAENYKGGKGYSNKEGSDTVKNSALGQRGLLAKFGVDINEDHRVVLSHRQERYHGERALREEFDFSQDWTTTASLTSEQRAAGYQLGAAAGVDRNGRPTRYLLDKNGALVANDANNDPRYRITTQNTTNLEYIGKNLGLINEVKANAYLLENSREETDTNSKTKVVIKGANINFDSEIGSDHFVKYGVNYRHQEGKPNSLEAFAENRRTRRLEATGVTNNQEKEDIGAYVEGIWGFGPVTMTTGLRYDHFDFKANDGKKVSDGAFSPSVGLIWEVVQGLSLNTNLNYATRSPRFYEVALSGSTARSVADDLKAEKARNTEIGFNYDFNDQISLNGSYFWQKVKDAHAVLNNTLVNSALLRNKGYELGAAYKYSGFTFRLGVADSKPETWVFNDASLDSTVYAVATGRTWTTGLSYKFENPSLEIGWKGRFVEGETGTPSRGSNATTAPVKQSGYGVNDFYASWDANKNLTLNFAVNNAFNKNYKSHSQRAGATSLPSAGRDFRVNVNYTF

SEQ ID NO: 10369 - protein, 360 aa, Actinobacillus pleuropneumoniae
MKKSLVALAVAGFAVASANAAPEANSVYVGAKAGWASFHDGISQIDHKNGGKYGINKNSVTYGAFVGYQIIDNLAAEVGYEYFGRVRGLEQTKAGGSKKTFRHSAHGTTIALKGNYEVISGLDTYAKAGIALVNNSYKTVNVDTKVPTKTSRFQSSLILGAGVEYAITPSLGARIEYQWLNNAGKASYATLRRMGVEGSDYRPDISSVSAGLTYRFGQGAAPVAEPEIVTKNFAFSSDVLFDFGKANLKSAAKQSLDAAHAEIQNLGLATPAIQVNGYTDRIGKDAPNLALSQRRAESVANYMVSKGVAPESITAVGYGKANPVTGNTCDAVKGRKALIACLAPDRRVELQVQGSKEVSM

SEQ ID NO: 10370 - protein, 661 aa, Actinobacillus pleuropneumoniae
MNNDQTRRTRPASVRGLRRTRLLVAGLAFVGAAAAAAPSVRDQVQEASRSGAANLALDLATEHRALFTPLEYAQLQHAAIAQRLRWSRAETWNLTGPERFATLDAALADGWQLLDSLPLAPEYASLRTAVISDMIYGLGLRGRYADAIKLYEGLRATNTPVHPYVLVSAGNAYAYEERYDEAIVCYEEALAKAGPGDIDRVPTQESLFFAYMDRGRYEDAEQLLQRIEKTSPQYVENAPVAERPNEDYATAQRLRAQYLMYSGETEAGTLAIDALQHDAPFSSGLRNAAASARLGDARPREAKAAFTTALAERPDDIQAMTGLARASMALREYPEAEAIVTTLSERFPESSSVRNLQRDYEVYQSPLLTMDFGGDIGHGGDNSNNDNSTIANREWSLNTMLYTSPISHNYRLFFHQFTGYADLGDGHKSRVRNGAGLEYRRGSIEASTELHQSTGPSGRFGASANVAWLPSDGWRLAANFDSDSNDLPWKAYRAGIHGWSSGVSARYQPTERTYYDVAYQLQHYSDSNTRQTIGATWFQNLWTVPRHSVSTWTSVAYSNNSKTDTECFSPDHDLTAQVTAMYEWRPWRDGQYAFRQRVYATGGVYNQAEHGNSALWQLRLEQVWDLPRQTSITYGVGYGRHSYDGDPENRTLFYLTLNIPF

SEQ ID NO: 10371 - protein, 465 aa, Actinobacillus pleuropneumoniae
MTSKTNKKITLCCALALASSSFNAYASENENEVSQIEVPIYQSKITNSSWDDKDIDASFYDNPFQVSLFNAKNGEDNERLMDHTYTVFGLGVGVIAALTVMPESITNWDKTDADIFKKWYDHVSEGPVWDRDQAWLNYVAHPYFGGVFYQSARKSGYRQWDSFLYSAMMSTFYWEYGIESFAEIPSIQDLVVTPVIGWVYGEWAYQTERDIWLNGGTLFGSEILGNTSLFLLDPVDSIGRNINALFGRDLIKAGTGYFTFNQVKLPYGGATENQVGLKLSYKFGDDSSKALPEISAKKDARAKSTMSTQKDPIDTGVVGISAGATWVNLNEKWGLQDTLGSQISVGLYFNRSFSSRLTYTRADMKKIATNKSVIYENYAIDSQYYFNAQENFRPFVSVGFGEMMSDEERDNKRFAMSAGLGLHYKITNKWALQTDWHRYYSTRTSSSEDQFSTLILYRFSNGERG

SEQ ID NO: 10372 - protein, 277 aa, Escherichia coli B7A
MKRVLCLILGLSYALHADSFKDVLTKGDYTFANKKVVSPIKRYADQSAFYLGLGYQLGSIQHNFSNLNLFQQFSKSQIIFSDSLSPVFKNSYVSNGLGVQVGYKWVGKHEETKWFGFRWGLFYDLSASLYGSKESQSIIISTYGTYMDALLNAYNGDKFFAGFNLGIAFAGVYDKVSDALLYQALLQDTFGGKVDPNGFQFLVNLGVRLGNKHNQFGFGIKIPTYYFNHYYSMNNISNNNEYVLKVLRFLEYGINSLLYRVDFRRNYAIYFNYTYSF

SEQ ID NO: 10373 - protein, 366 aa, Escherichia coli B7A
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAVQYQGKNERTDNSHLYGADYTRANGDGFGISSTYVYDGFGIGAVYTKSDRTNAQEKAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 10374 - protein, 700 aa, Escherichia coli B7A
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTQRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 10375 - protein, 377 aa, Escherichia coli B7A
MKSKVLALLIPALLAADAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSATYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGAAYYFNKNMSTYVDYKINLLDEDDSFYAANGISTDDIVALGLVYQF

SEQ ID NO: 10376 - protein, 730 aa, Escherichia coli B7A
MAFLLAATAQAAETAPDSTVIRFTSEEITVSGQKGDILQQVTGSESAVLNPSQMSVYKVINMMPSLSQQSVDPYGLADISNYHEAFKFRGVEATAGGVPSTTANVEGLPVTGRPGGGATIYDLENMQNITIYTGVMPANKGLGLSTVGGKIDMEIKRPTDTFGVDVKQTVGSNDFSRTYLRVDSGELGSGLKAFVSGSTSYADKWKGEGSSNRNNLMFGISETFSDRVKLEAFLTYSKGLIHPYRALSYAEISNLETAYSKDYSTDPTSVWHYDYNKNEFEDWMVMANLEIKTGDSSKLNIKPYYWSDKGYYMETITPTPGTNLVREWDVEHDLKGLLAEYSTKLGDIDLDFGYLFHTQERPGPPSSWKNYTVSTAGDLVFKNWSILSNTSSHELHEPFIEAKYSTGNYRIEGGLKYVNYTLPSIITYDMAAVDVSYDEALASNPSIDASRSATAAKTFSRVFPNLTLTRFINDDTSIHLAYGENYVTHVDIYPYFISNAKNFITNGITFQELWDAREMETAQNFELGMKMKGTNWSLAPTIYYAIHNHKQAVLYDPALNATYPMNNADAKGYGVELEADYKPSRDLKCYGSFSWNRFYFDQAIASDASGNPTIDVKGDQVPDAPEFMAKGMLSYRMGDVSISPIVRYSSVRYGDVLHEEKIDGATVFDLDITWSRPMLGFKNVDCSLSLINVFDKQYVSMISTSDYKTMKTSYQPGAPFTLMATLALHY

SEQ ID NO: 10377 - protein, 760 aa, Escherichia coli B7A
MENNRNFPARQFHSLTFFAGLCIGITPVAQALAAEGQINADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTARSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISGAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10378 - protein, 230 aa, Escherichia coli B7A
MKKINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFVPWFNLTVRNRYNHNNYSSTDLSGELDNNDTYEIGTYWNFKITDKFSYTFEPHYFIRVNDFNSSNGKDHHWEITNTFRYRINEHWLPYFELRWLDRNVEPYHREQNQIRIGTKYFF

SEQ ID NO: 10379 - protein, 1246 aa, Escherichia coli B7A
MNMRIIFLRKEYLSLLPSMIASLFSANGFAAAIDLCQGYDIKASCHASRQSLSGITQDWSVADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSTAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFVHSLTGFQNGTLNIDAGGNVTVNQGSFAGTIEGAGQLTIAQNGSYVLSGAQSMALTGDIVVDDGAVLSLEGDAADLAALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITANVDTRSTTTEHGRDIEMRADGEVAVDAGVDTQWGALMADSSGQHQDEGSTFTKTGAGTLELTASGTTQSAVRVEEGTLKGDVADIFPYASSLWVGDGATFVTGADQDIQSIDATSSGTIDISDGTVLRLTGQDTSVALNASLFNGDGTLVNATDGVTLTGELNTNLETDSLTYLADVTVNGDLTNTSGAVSLKNGVAGDTLTVNGDYTGGGTLLFDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPDPTPDPDPTPDPIPAYQPVLNAKVGGYLNNLRAANQAFMMERRDHAGGNGQTLNLRVIGGRYHYTAAGQLAQHEDTSTVQLSGDLFSGRWGDDGEWMLGAVGGYSDNQGESRSNMTGTRADNQNHGYAVGLTSSWYQHGNQKQGAWLDSWLQYAWFNNDVSEQDDGTDHYHSSGIIASLEAGYQWLPGRGVVIEPQAQVIYQGVQQDDFTAANHARVSQSQGDDIQTRLGLHSEWRTAVGVTPTLDLNYYHDPHATEIEEDGSTISDDAVKRRGEIKVGVTGNISQRVSLRGSVAWQKGSDDFAQTAGFLSMTVKW

SEQ ID NO: 10380 - protein, 380 aa, Escherichia coli B7A
MNIYRAVTSFFNKSSKKGRTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 10381 - protein, 714 aa, Escherichia coli B7A
MTYFAFPKRVALLLGAFVAFNSPMVFAAKELQSNEQVTDSDIERLSIHYRQAYRGNVPAEALPQAISVLDEQLIKDAGLTRFQDVLDYSASVARQNNGGGLWDSFSLRGFPGNENMPSGYLINGFNGGRGFSGHRDLSNVAYVEILKGPGSALYGRSEPGGTVNIVTKKPQYESSGYLKASAGSFDQYRLEGDVTSGLTDNLAFRINGAWQEYDSFRDYVFSDKKIVTPSVRWQVSDKASLLYELEYLKQEQLFDRGVIVLNNDIKTVPRSRYLGEPNDGATKVNATGHQLTYDYELNDDWSLTAGYNYRDSTLKGFSSDAELAAGRQSLFDDGRILTRQHRYRDYASEDNSLRLELSGHLDTGFIRHNLLLGADAYHYNLKTGLYRYRGKKGEYAIDIFEPQYGSAQPEVSLLYENEETQKAWGSYLQDQMDLTEKWKLHLGLRFDTYQQDISETAKETLSEQTDNRVSPKVGLVYLWSDALSFYSSYSEGFLPLSGTDYAGNPFEAEESKSVELGMKFNAAWLNDLAINGSLAVFDAKKSNILTSDPVNVGFSATLGEAKSTGLELDIAADLTESLQGRLSYAYLNTRTANDTLNLDFGVQIPAGSPLVNVPKQTASILLKQDLNDFSIDGHLGLSWRYIDSRLGDSADPSFQLPSYQLVGLFMNTHLSDNLSLGVNLDNILDEHYIASSYSALWAVPGEPRSIKVSVSYEF

SEQ ID NO: 10382 - protein, 774 aa, Escherichia coli B7A
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 10383 - protein, 949 aa, Escherichia coli B7A
MKRHLNTSYRLVWNHITGTLVVASELARSRGKRAGVAVALSLAAVTSVPALAADKVVQAGETVNDGTLTNHDNQIVFGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGLARDTLIYAGGDQSVHGRALNTTLNGGYQYVHRDGLALNTVINEGGWQVVKAGGAAGNTTINQNGELRVHAGGEATAVTQNTGGALVTSTAATVIGTNRLGNFTVENGKADGVVLESGGRLDVLESHSAQNTLVDDGGTLAVSAGGKATSVTITSGGALIADSGATVEGTNASGKFSIDGTSGQASGLLLENGGSFTVNAGGQAGNTTVGHRGTLTLAAGGSLSGRTQLSKGASMVLNGDVVSTGDIVNAGEIRFDNQTTPNAALSRAVAKSNSPVTFHKLTTTNLTGQGGTINMRVRLDGSNASDQLVINGGQATGKTWLAFTNVGNSNLGVATTGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHSVSELPVNWWVQPSVIRTFSSRGDMSMGTAAAGSNMTFSPSRNGTSLDLQAGLEARIRENITLGVQAGYAHSVSGSSAEGYNGQATLNMTF

SEQ ID NO: 10384 - protein, 746 aa, Escherichia coli B7A
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGIGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 10385 - protein, 961 aa, Escherichia coli B7A
MGIKQHNGNTKADRLAELKIRSPSIQLIKFGAIGLNAIIFSPLLIAADTGSQYGTNITINEGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSSIKTNGDNAHGLWSFGQVSANALTVDVTGAAANGVEVRGGTTTIGADSHISSAQGGGLVTSGSDATINFSGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNATNWELYASGTVPEPTPNPEPTPAPAQPPIVNPDPTPEPDPTPNPTPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAHNGFYSDLVVKASRQKNSFHVLDSQNNGVNANGTANGLSISLEAGQRFNLTPTGYGFYIEPQTQLTYSHQNEMAMKASNGLNIHLNHYESLLGRASMILGYDITAGNSQLNMYVKTGAIREFSGDTDYLLNNSREKYSFKGNGWNNGVGVSAQYNKQHTFYLEADYTQSNLFDQKQVNGGYRFSF

SEQ ID NO: 10386 - protein, 729 aa, Escherichia coli B7A
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSTEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 10387 - protein, 1108 aa, Escherichia coli B7A
MESKHSLRKSKLFRALLILLLIAVPVQWAAAQLTLSTPRTTLGTVIKQIQSQSKYQFFYNDKLSTVTVEPLKVKDASLEQVLNTLLKNKDISYKIEENIIYLSEKENSDSLQQQSGKERTITGQVVDAKGEPLIGVSILVKGTTDGAITDLDGNYKIVTKSNNPVIVYSYIGYKTQEIPLKGQTAINITMMDDTQVIDEVVVTALGIKRSEKALSYNVTQVDAESALAVKDANFINSLNGKVAGLNINSSSSGIGGASKVVMRGSRGIEQSSNALYVIDGIPMYNLSASGGSEEMQSQGSTEAIADINPDDIESMSVLSGAAAAALYGSNASNGAIVITTKKGKVGRVALTVSSNTEMLSPFVMPQFQNRYGTSGTDASWGKRLNEANYRGYDPASDYFQTGLIGTESVTLSTGTEHNQTYLSAAAVNSRGIIPNNKYDRYNFTFRNTTLFLEDKMKLDVGAQYIMQKDRNMVNQGIYANPLSSAYLFPRGNDWEDYKMYERYDLERNMYTQYWPQGGGSFRLQNPYWINYRNLRENDKDRYMLSAALSYDILSWLNVAGRVRLDNSYNTYTQKYYASTIATIAEGENGFYGVTNTRDKQTYADLLLNINKTFGEDWSLTANIGASYSDNRSEALAVSGPIAANGLPNFFTVAQLDKETGKREETGYREQTQSIFASAEVGYRSTYYLTLTGRNDWPSQLAGPNSKQSSFFYPSVGGSVVLSELFKLPESISYLKLRASWASVGLPFGRFLAYPTFSWNTSTGAYSSQSAYPLYDLKPERTDSWEVGLTARFLKHFNFDVSFYNTKTYNQTMDAKLSPTGGYSTFYAQTGNVRNRGVELSLGYKNTWNKFSWSSNYTFSANKNKILSLIDGYINPVTGEEITKDRMDVGGLSKARFILKVGGSLGDLYSQSDLLRDSNNKIYVNADGNVAVNDKADDIYLGSVFPKANMAWRNDFQYGNWGLGFLLTARLGGVVYSATQAVLDSYGVSEATAAARDNGGVVINGNDMIDAQKWYTVVGADSGIPQYYTYSATNLRLQEASVSYTIPRKKLKNIMDITLSLVGRNLWMIYCKAPFDPESVATTGNYYQGIDYFMMPSLRSVGFNLKLKF

SEQ ID NO: 10388 - protein, 773 aa, Escherichia coli B7A
MQGKNTIVITGDYSIGLLSQTSGNLNTDTIIRVNSDGSVTPSFSDGDDTFIVTAGNHAVGVLACASPGSARACVSSLDEESTTDTGSNENNAIAKLDMAKGEITTHGTESYAAYANGTVVKAGDTLDYTNASVTLTDVDITTHGDNAHAIAARQGTVSFNQGEIYTTGPDAATAKIYNGGTVTLKNTSAVAHQGSGIVLESSINGQEATVDILSGSSLRSANEILYHKNETSNVTITDSEVSSAADVFINNIKGHLTVDATNSKITGSANISTDDNTHTYLSLSDNSTWDIKADSTVSNLTVDNSTVYISRADGRDVEPTRLTITENYVGNNGVLHLRTELGDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRLEAGSYVANLAAANTLFVMRLNDRAGEMRYIDPVTEQERSSRLWLRQIGGHNAWRDSNGQLRTTSHRYVSQLGADLLTGGFTDSDSWRLGVMAGYARDYNSTHSSVSDYRSKGSVRGYCAGLYATWFADDISKKGAYIDAWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGASNLGEIKLGVNGNLNPAASVWGNVGVQLGDNGYNDTAVMVGLKYKF

SEQ ID NO: 10389 - protein, 1384 aa, Escherichia coli B7A
MNKIYALKYSVRQGALVPVSELATHVKKSSRTGLIKKIIPSLLINTILLGYSVSSLASVVRYDLPYQTIRDFSENKGQFTPGSLNIPIYNKTDAIIGYLNKAPMPDFSSANHQSAVATLVSPQYIVSVKHNGGYQSVSFGDGENKYRLVDRNNQPGRDFHAPRLNKLVTEVEPSLMTQSGMVSGAYSDKNRYPTFYRIGSGTQEIKQTDGQIISLSGAYNYLTGGTAGSLGSYAQGQMISANTNKQLYNLAQGPMGTHPRSGDSGSPLFAYDSVLQQWVIVGVDSSGGGGGTNWTVVDADFVNQSIQEDTDAPVTFVAGQGALRWAFDSTDGTGTLTQQETVYQMHGQKDADLNAGKNLVFNGADGQIVLEDSVNQGAGALTFNGNYTVSTNNGSTWQGAGLDISRDAEVIWQVNGVQGDNLHKIGEGVLKVNGTGINPGGLKVGDGTVILAQRPDEDGKAQAFSSVNIASGRPTVVLTDSRQVNPDNISWGFRGGRLDINGNDVTFHKLNAADNGANIINASDTFATVSIKPITDMTVTINDWDKNKASGGAAGLLYKYNNPYAHTVDYFIQKRKGYGFYPVNQSDNDSWEYVGHNETQAIEQVKSRRPVDDRMYHGNLAGNIDLNIDTSRSSGGVIFDGNIDTPEGGLMQSGGQLTFQGHPVIHAYNNKGVADKLKSLGDDSVRTQPTSFDQPDWEGRTFRLKTLLLKNTDFGLARNASLNGDIEAVHSSVTLGTPNVYIDLNDGNGTKVTPQKGTSVARQDTDRSRYAGKVTLGEQSTLDVREIFTGSIQSQDSAVTVSSRHATLDGYSRFGNTSLALQEGARLTATGGWWSDSDVIVGPAATLSLAGTSVTGQPGQVSPAFYSTDYGAGYQLDTGSQLHFSPYTFVTGDIRAKGDTGISIGGEDGVALADNLPLGEQMMYSLFNGFRNVYSGNVSVPQGRMTMTDTQWQMPGDSHTGALRMIRSLAGFTGRGFNSLTTNTLQANQSAFALRTDLKDSDKIVVNQKAEGRDNTLFVNFLKKPSGQEPLNIPLVSAPAGTNPAMFKAAERVTGFSLVTPTLHTTEQDGKIQWVLDGFKSAPDKGSATSANSFMGMGYKNFMTEVNNLNKRMGDLRDTQGEDGMWVRIMNGAGTGDAGYSDRYTHLQTGFDKKHRLSGADLFTGVLMSYTDSSASGRAYSGDTHSLGGGMYASVMFDSGIYMDVIGKYIHHDNDYNAGFAGLGKRNYGTHSWYAGLEGGYRYRLTESLYIEPQAELVYGTVSGTTLKWNDNGMDVSMRSKTYNPLIGRTGVALGKTFSGKDWSVTARTGVDYQFDLVANGETALRDASGEKRFTGEKDSRMLYNVGLNAQVKDNVRFGLELEQSAFGKYNVDHAINANFRYMF

SEQ ID NO: 10390 - protein, 614 aa, Escherichia coli B7A
MIKKASLLTACSVTAFSSWAQDTSPDTLVVTANRFEQPRSTVLAPTTVVTRQDIDRWQSTSVNDVLRRLPGVDITQNGGSGQLSSIFIRGTNASHVLVLIDGVRLNLAGGSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 10391 - protein, 715 aa, Escherichia coli F11
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 10392 - protein, 778 aa, Escherichia coli F11
MKTQISRIALIAALGGAGLVAAHGPVAVAQEAAQTRAFDIPAQSLNGALLRFAREAGVQVLYDTALVQGRQSPGVSGRMTTSAALEQLLQGSGLGFRVNSPQSISLTAPAAAAVESDANTVVLDEIRLDAGGAVTEGTGSYTTGLTTVATGLPLTMKETPQSISVATRQKMDDRNQRSISEVLEDTTGITVMPMDTERRSVYARGFSSPTYMVDGLPVWYRIQYGSGPSIADTAIYDRVEVLRGATGLMAGAGDPSVVINMVRKTPTSAPQTRLRFSAGSWNTLRSDLDISGPLNADASIRGRFVAAHEQGDSWLDRYERRKTVLYGVVEADVGDAGTLTAGYDFQRNRTRNHQFGGLPLIANDGSQLEYDIHTNAGGGNLPLTQTTQTLFLRYAQDFGAGWQAVGDLSLYKAERKGYLASASWGSPDPQGFGVQTVGGYADTDTEQTALSLTASGPVELGGRSHDLRFGITGNWGKDNHKAYSAFDGTDIDYQPITGSIFDWDGYVPNLVQQAGYVSYVSNTKIDQVAAYGSGRFGLTDRLNLIAGARVVWYDYDYTTDSRSSGTTTHQQISRNGEWIPYAGLTYDLNEDWSVYASYTRVFKQASYRDKDNRIVEPTTGSNYELGTKASLAGDRLNFAAAVYLLEQDNLPVRDRSVSYQLPDGSNPYMSIDGTRTKGFEMELAGEVRPNIQLAASYAWTDAEDGDGQRISTVTPRHSVKLSGIYAFESMPLTLGASLRWQSAIENTWVWPVTGTARQGRADACAVVDVAGRDRLAGS

SEQ ID NO: 10393 - protein, 641 aa, Escherichia coli F11
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGYSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10394 - protein, 366 aa, Escherichia coli F11
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLFYQF

SEQ ID NO: 10395 - protein, 1234 aa, Escherichia coli F11
MIASLFSANGVAAVTDSCQGYDVKASCQASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIVNNTAFTNNTAEGYGGAIYTNSVTAPYLIDISVDDSYSQNGGVLVDENNSAAGYGDGPSSAAGGFMYLGLSEVTFDIADGKTLVIGNTENDGAVDSIAGTGLITKTGSGDLVLYADNNDFTGEMQIENGEVTLGRSNSLMNVGDTHCQDDPQDCYGLTIGSIDQYQNQAELNVGSTQQTFVHALTGFQNGTLNIDAGGNVTVNQGSFAGIIEGAGQLTIAQNGSYVLAGAQSMALTGDIVVDDGAVLSLEGDAADLTALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITSDVDTRSDAAGHGRDIEMRADGEVAVDAGVDTQWGALMADSSGQHQDEGSTLTKTGAGTLELTASGTTQSAVRVEEGTLKGDVADILPYASSLWVGDGATFVTGADQDIQSIDAISSGTIDISDGTVLRLTGQDTSVALNASLFNGDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPEPDPTPDPDPTPDPDPTPDPAPVPVYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSNMTGTRADNQNHGYAVGLTSSWFQHGNQKQGAWLDSWLQYAWFSNDVSEQEDGTDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVRGNISQRVSLRGSVAWQKGSDDFAQTAGFLSMTVKW

SEQ ID NO: 10396 - protein, 660 aa, Escherichia coli F11
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVGASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIDHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 10397 - protein, 1366 aa, Escherichia coli F11
MNKVFSLKYSFLAKGFIAVSELARRVSVKGKLKSASSIIISPITIAIVSYAPPSLAATVNADISYQTFRDFAENKGAFIVGASNINIYDKNGVLVGVLDKAPMPDFSSATMNTGTLPPGDHTLYSPQYVVTAKHVNGSDIMSFGHIQNNYTVVGENNHNSLDIKTRRLNKIVTEVAPAEVSSVGAVNGAYQEGGRFTAFYRLGGGLQYIKDKNGNLTPVYTNGGFLTGGTISALSSYNNGQMITAPTGDIFNPANGPLANYLNKGDSGSPLFAYDSLEKKWVLIGVLSSGSEYGNNWVVTTQDFLNQQQKHDFDKTISYDSKKGSLQWRYDKDAGVGTLSQEGVVWDMHGKKGEDLNAGKNLQFTGNNGEVILHDSIDQGAGYLQFFNNYTVTSLTDQTWTGGGIITEKGVNVLWQVNGVNNDNLHKVGEGTLTVNGKGVNNGGLKVGDGTVILNQRPDDNGHKQAFSSINISSGRATVILSDANQVNPDKISWGYRGGTLDLNGNNVTFTRLQAADYGAIISNNNNNKNKSELTLKLQTLNENDISVDVKTYEVFGGRGSPGDLYYVSASNTYFILKSKAYGPFFSDLDNTNVWQNVGHDRDKAIQIVKQQKIEESSQPYMFHGQLNGYMDVNIHPLSGKDVLTLDGSVNLPEGVITKKSGTLIFQGHPVIHAGMTTSAGQSDWENRQFTMDKLKLDAATFHLSRNTRMQGDISAANGSTVILGSSRVFTDKNDGTGNAVSSVEGSSTATTAADQSYYSGNVLLENHSSLEVRENFTGGIEAYDSSVSVTSQNAILDHVGSFINSSLLLEKGAKLTAQSGIFTNNTMEIKENASLTLTGIPSVGKPGYYSPVISTTEGIHLGERASLSVKNMGYLSSNIIAEDSAAIINLGDSNATIGKTDSPLFNTLMRGYNAVLQGNIMGPQSSVNMNNALWHSDRNSEIKELKANDSQIELGGRGHFAKLRVKELIASNSVFLVHVNNGQADQLNVTGKLQGSNNTILVNFFNKAANGTNVTLITAPKGSDENTFKAGTQQIGFSNITPEIRTENTDTATKWVLTGYQSVADARASKIATDFMDSGYKSFLTEVNNLNKRMGDLRDSQGDAGGWARIMNGTGSGESGYRDNYTHVQIGADRKHELNGLNLFTGALLTYTDSNASSQAFSGKTKSLGGGVYASGLFESGAYFDLIGKYLHHDNRYTLNFASLGERSYTTHSLYAGAEIGYRYHMSENTWVEPQMELVYGSVSGKSFNWKDQGMQLSMKDKDYHPLIGRTGVDVGRVFSGDTWKVTARAGLSYQFDLLANGETVLQDASGKKHFKGEKDSRMLMNVGTNVEVKDNMRFGLELEKSAFGRYNIDNSINANFRYYF

SEQ ID NO: 10398 - protein, 175 aa, Escherichia coli F11
MRLNDRAGETRYIDPVTEQERSSRFWLRQIGGHNAWRDSNGQLRTTSAQAIWMGVDHNVHTEANGSRIENDANNNIQTRLGFHTFIRTQEKNSGPHGDDFEPFVEMNGIHNSKDFAVSINGVKVEQAGARNLGEIKHGVNGNLNPAASVWGNVGVQLGDNGYNDNAMMVGLKYKF

SEQ ID NO: 10399 - protein, 656 aa, Escherichia coli F11
MRLKKRYLCTVLSIAFTQQSVAVQESDTLTVWSSPVSSTTTTVFDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQNNAYDMHASFAASSDLGYLQVSGSQLKQDFLGLPHGVNNDIAGKHGKMTNSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 10400 - protein, 468 aa, Escherichia coli F11
MKKLTSIICLMALAVMALASIAQAGERAGAFSISPFVGGYGFDDDRQAYFKQNRPLGGLRLGYDFTDHFAAELVGTYMKAEYKATKHNVGVYSYRLDLVYNILADSQVVPYLAFGGGGTTIRDERGNSHDGTAEAGGGVKFFMTDNVALRADGRYLVDFMSNHLSRGRDLARNWEYSLGLTFLFGGRERAAAPAETVATPVEQPAAVTPAPEPPLEVPAAEPTPDHYKYCITLHGEFDIDKAIIRPEYKEEIAQVGNFMKKYPTTTAVIEGHTDNVGSYNHNQDLSQRRAEAVVNYLVEQYGIERSRLSAKGYGFTRPIADNATDEGKQKNRRIEAIIDCAFDVQQVTPPDRLCMALVLDFDAGKADVKSQYRNEIAKVADYMKRYNTTTAVIEGHTDNTGSPEKNMKLSQQRAQNVVNYLVDNFGIERSRLSAKGYGATRRISYNNTPEGRQKNRRINAVIDCVVTK

SEQ ID NO: 10401 - protein, 2396 aa, Escherichia coli F11
MSADFLRRIVSFHGNAHSNNEPITRKSMNLARSKKAGEPFPKLLLPTGIFLALSGAGIVPAYATCSTAGTTVTCSGVANPLAPSYSNSANNIHATVNAGASVGVLLGVGGTAMSLTGNNTQLTNNGTIDPSALGTGLGVLSSGAVIGNSAASAGTTVINNGTMNGSTGVAISGVTGMALSVQNGTGGTSTINNTGTIGSNALVGATLAGADAPVVAAYGGATVNMTNSGTITGRVSLGSNGTPGAGNSFVNSGTINGSVSMGANSTNSFTAVTGSSVNTAGGTGGALNITVGPVTLGVAATGTVDGGAGGDNTLNLQQGAGANGTIAANNYINFNHLNVQSGSWTINGASTAQDATLSGGTAIINNNASLGTGTITGNGGALQAGTAGLNVSNNVTLNAGGLTVQGATGLTLSGTVSGGGALTKIDSGTLTLSGANNYTGGTNLNAGGIVVGNNASLGSGALNVNGSGTLDSSTNTTLNNTVNLATGTTLTVGGSNNLGLAGSINGNGGLVKNGAATLTLSGANTYTGDTTINSGTLALSAGGSLAATGTVNLTGAGATFDMSGASGTQTIGALAGSAGTNVNLGGNSLTLDGSGNATYAGSIGGTGGVTLAGTGTQTLSGTNTYTGGTNLNGGNLVVGSNTALGGGAVNVNGPATLDATTNVSLANGVNIATGTTLTLAGSTNLGLSGTVSGGGGLVKNGAATVTLSGANNYTGGTTLNAGGLVLGNDAALGTGALTVGGAATLDTNTNLSVNNAVNLATGSTLTLGGSNALTLNGGITGAGGLVKDGAATTTLTGANTYTGGTTINAGTVAISGGGSLAATGAVNLAGAGATLDVSAATHAQSIGALSGVAGSAVNLGGNGLTLGGTASGTFSGVIGGTGSVTLAGTGTQTLNGASTYSGGTNLNSGSSVVLGNNGALGSGTVNVAGTATLDTNTSVSVANAVNLANGSTLTLGGSNALALSGGISGAGGLVKNGPATTTLNGANTYTGGTTINAGTLAVGAGGSLAATGAVNLANAGAALDLSTATTAQTIGALSGVAGTIVNMGGNGLTLGGTASSTFSGVIGGAGSLTLAGTGTQTLTGVNVYTGGTNLNSGGLVLGNSGALGGGALNVGGAATLDTSASLSVNNAVNLGTGATLTLGGSNALTLNGGITGAGALVKNGAATTTLTSAASYTGGTTINAGTLALGAGGRLSATGAVNVAGAGATFDLSGASGAQTIGALSGVAGSAVNLGANGLTLGGTASGNFSGTIGGTGGLTVAGTGTQTLSGTNTYTGGTTINGGSTLALGAGGSLASGSAVTLAGTGATFNLSGASGPQTLGTLSGGAGTNVTLGANTLTLNGSGNNTFGGAIGGTGGMTFAGTGTQTLTGANTYTGGTTINGGSTLALGAGGSLAATGAVDLAGAGATFNLSGASGPRTIGALNGIGGTNVNLGANALTLNGSTNGTFSGVIGGTGSVTFAGTGTQTLKGANTYTGGTTINGGSTLALGAGGSLASGSAVNLAGTGATFNLSGASGPQTIGTLSGGTGTNVTLGANALTLNGSGNNTFGGAIGGTGGVTFAGTGTQTLTGANTYTGGTTINGGSTLALGAGGSLASGSAVNLAGTGATLNLSGATGAQTIGALSGSTGTNVTLGTNALTLNGSGNGTFGGAIGGAGGVTFAGTGTQTLTGANTYTGGTTINGGSTLALGAGGSLASTGAVNLAGAGATLDASGATGAQTIGTLNGAAGATVNLGANALTLNGSGNGTFGGTIGGAGGVTIAGTGIQTLTGANTYTGGTTIAAGGALQLGNGGTSGSIAGNVVDNGALIVNQSGNVTLASVLSGAGSLTQAGSGQLTLTGTSTLSGPTTVSAGTLAVNGSLGQSTVTVQNGATVTGTGTIGGLVVQGGATAAALQPGAALNVGGNVTFQPGSTFQVAASPQQSGSLAASGTATLNGGAVQVLANQSAYQPGTTYTIVTAASGVQGAFSQVNANYAFLMPTLSYDPNHVYLRLVQNGTSLPDVATTPNQRAVAAALGGLGAGNPLYDAVLTTDVATARRAYGLLDGEIQASLKSMLLLDSRYVRDAVTDRVRQGLAPGSGPLAALSSGGAALCGDNTAGAADPTLPPERRIGSRDGCYGGTPYQPVVWGQAFGGRSRLTGDGNASTINRSMTGFIAGADMALNDKWRAGLAAGVTHSSLDNDQSSSASVNSYYLSLYGGAQYGALGVRGGASYTWYRINSDRSPGFAGFSDHDSAGYDANSAQVFGEVGYALPVGPVAIEPFAGLAYVNLHTDGYTETGGAAALRAGGETTHVGFSTLGLRAASQLGSIASGTFTARGTVGWRHAFGNVSPSSSFTFANGGTSFQVSGVPIARDSAVLEAGIDANITKRLTLGLTYSGQYGSGVRDNAILGNILWKF

SEQ ID NO: 10402 - protein, 725 aa, Escherichia coli F11
MRINKILWSLTVLLVGLNSQVSVAKSSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSDEGATRRANFSLSGPLAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDSDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 10403 - protein, 1039 aa, Escherichia coli F11
MKRHLNTCYRLVWNHITGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFLRLEGDLMRTEVAGMSVTAGVYGAAGHSSVDVKDDDGSRVGTVRDDAGSLGGYLNLIHNASGLWADIVALGTRHSMKASPDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHRVSGSSAEGYNGQATLNVTF

SEQ ID NO: 10404 - protein, 385 aa, Escherichia coli F11
MIYSKDDRDADWNNYGNVVNNVQKLERINATLTHNGYWSKFDSRVRYNYENSDLKDDSGLNTSVGDITQTNNTLDGQLSGYVGSHLLTGGAEYRITDLKNNLTLSKGSEDYSQSAIYLQDEFEIGDLAVTLGGRFDDHEVYGGEFSPRAYAVYSITDNWVVKGGVGKAFKAPSLNQYSDSYAVLACRGACYVVGNPNLKAETAVSYELSTGYKTDSWGATVTAFNNDIDDMIQAETWDRVKKELTYFNVQEAQVRGAELSGWFDVTDTVSLSANYMYTDAKDKTTDKELTLTPKNTVNVQVDWQMRENVYTYVSYQYTGEQYVRTDEKSGGYGTFDLGAQYEAVKNLNLKLGVTNLTDEKRDDAAVKYDYIMKSRTIYAGASYAF

SEQ ID NO: 10405 - protein, 351 aa, Escherichia coli F11
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLNLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLESDNKLNINNDDIVAVGMTYQF

SEQ ID NO: 10406 - protein, 1039 aa, Escherichia coli F11
MKRHLNTSYRLVWNHITGTLVVASELARSRGKRAGVAVALSLAAVTSVPALAADKVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAIKSGAVATDTVVNTGAEGGPDAENGDTGQTVYGDAVRTTINKNGRQIVAAEGTANTTVVYAGGDQTVHGHALDTTLNGGYQYVHNGGTASGTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFIQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRVRGWGWLGSLETGLPFSITDNLMLEPQLQYTWQGLSLDDGQDNASYVKFGHGSAQHVRAGFRLGSHHDMNFGKGTSSRDTLRGSAKHSVRELPVNWWVQPSVIRTFSSRGDMSMGTAAAGSNMTFSPSQNGTSLDLQAGLEARVRENITLGVQAGYVHSVSGSSAEGYNGQATLNVTF

SEQ ID NO: 10407 - protein, 317 aa, Escherichia coli F11
  misc_feature (302)..(302): Xaa can be any naturally occurring amino acid
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDRDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEAFDNDEHYDPGKRITYRSKVKDQNYYSVAVNAGYYVTPNAKVYIEGAWNRVTNKKGDTSLYDHNDNTSDYSKNGAGXENYNFITTAGLKYTF

SEQ ID NO: 10408 - protein, 1101 aa, Escherichia coli F11
MRRVCWLEMNMRLFALLLTAAPAFAQFDTAEVLGTVRDHSGSVISKAAIVLTNQGTGIGAKTSTSEDGQYTISNVKIGVYTVTAEAPGFSKAIAKDVTVNVNARQRVDLVLQVGAVTESIEVTAAAAVLETDTSSRNQLINTQGVVELPLNGRAYSDLALLTTGVLKSPAYSGGREGSFNVNGLRSTYNKYLLDGVDNNAYGTSNQGFANQVAQPSPDAVAEFKVITNNYSAEYGRSGGATIDVAMRSGTNKLHGTMYEFLRNTNLNAVGYIFGTRPSTFIKPTLQQNQFGFTAGGPVIKNRVFFFGDYEGFRSLARTNTFSSIPSLNDRLGILPVAVTNPQTGAIYPANTPIPATATSAFARKVLADLPALTVPGNTVRSNNLQLLALNKTYTDKFDAKMDGQINDRMNGFLRVSQRKLNNYNQPGISGPSGGGGNGYIRALNQQGTAGYTWTVNSSSILEGRFAVSRTDAGKTPPAIGGTSMLDIYGITGLPTTSELTGGLTPQTLSGFTGLGRQATNPQFQNPLSFNYKVNFTKNMGRHALKTGFEYVVIRTQVLDVNPLYGLDSYAGGFSKPAGGPADASSYAIADFLFGLRSAYQLATYSVGNYRQHEYFAYVQDDFRVNHTLTLNLGMRWEYATPRWERDNNLSNYDPVTNSMIKAKSGSIYDRALIDPDRKNFAPRIGFAWSAMPKLVVRGGYGIGYVHQNRVGSGDLLGINGPQVIIATVNQSNPLDPTFRTTQQGYAAGLTTPANFNPVAANVLYMPRGLKTPYVESWFFSVQHTLPLDTVLDVAYVGNHSVATPIMADYNAAFPQPTATSNLSLQARRPNHAFGPITWYDPAGFSSYNALQVKLERRFTKGLQFLNAFTWGKAIDNGTQALDGSNGNQASPQDVRNLASERGISNYDQKFNEILSLIYELPVGRNRRFLAGAPAVVDHVLGGWQFSIINTALSAQPINLRAWNGSVPSAFQTDGNLAEWRGGEAFRPNITGPVLASSGTQSVDNYFNKDNVALPTDPSHPFGNAGRNIARATAMNQLDLGLFKNFRLPKENMRLQFRSEMFNALNHTNFTAANGDRASASFGTIRGTYPARQIQFALKLMF

SEQ ID NO: 10409 - protein, 768 aa, Escherichia coli F11
MKVSGRNVSRWSMGLLATTMLTAVAAPAAAQTGGPTLEEVVITAQKRSENLQDVPISVQALGTERLDQLQVSDMADYVKFLPNVTIQSGAPGFTTIYMRGVASGENSNHSGPLPSVAVYLDEQPVTTITGPLDIHVYDIERVEVLAGPQGTLYGASSQAGTIRIITNKPSPAGFAAGYDLEVNSVSHGGIGYGAEGFVNQPLGDQAAVRLVGWAIHDAGYIDNEAATLTYPTGPVTIDNADLADDDFNEVDTYGARAALRIDLDENWSITPAIQGQRTEADGAFFYDPGRGRLDTARFRPDRSDDKWFQAAMTIEGTASNLDLVYAGAYMRRWIDSESDYSDYAYFYDTLYGYGAYWTDDAGNPNDISQYIQGKDYFTKQSHEFRVSTPADERLRVTMGLFYQKQTHNIQQRYKIDNLASGVEVTGWPDTIWLTKQLRVDRDLAAFADLGIDVTDKLTINGGIRFFKARNGLEGFFGYGSGYSSRTGEAACFGPEIVEGSPCTNLLQLTEDKGDTYRLNATYDFDDNRMVYLTYSTGYRPGGVNRRGGDPYEPDYLKNLEFGWKTTWLDNRLRWNGAIFKEKWNDYQFSFLGQNGLTIIANGGKAKMKGIETDVSWVLAEGLTVNGAASLIDAELAQDYRADPAGPILAPKGQSLPVTPKFKGNLNVRYEWAMGGYDAHVQGSVVYSGSAYSELRSADRALVGKMPEYTTFDMTAGLTNGSWRVEAFAKNLFDENGQLDRAVACVVCSRVWVTPIRPRIIGVRFGQSF

SEQ ID NO: 10410 - protein, 850 aa, Escherichia coli F11
MLSALRPLHCLPARPTLLALCLAMSLAAEAAPVAFDLPAQPLAHSLSQLAQQAKVQLLFDEALLGKAQAPALKGDFEAEAAISRLLVGSRFSVVRMGSTYVVRLREDDPSADNSIQLGALSIVGDGQQVDPGNVGRSTLDQEQIDRYQPSNIPSVLATLPGVNMGGSAKPGGQTINIWGLGDAEDVPMTVDGAPKSGFERYQQGTIFIEPELIKHIEVEKGPHSVKTGNGGFGGSVNMETKDAGDLLQEGRNSGAMLKYGYASNDHQQIYSSALFGRTDDGRIDGLVYYTKRDGGNLKMADSLPDPTNQWPVNPQRVPYSALDLDGALLKTNIHFTDEHSLGLSWSRSESERWTTFASTAFPAPPNAADIKKYGYDGALKRFLANRTTIDTTWSATYKYQPIENPWVDLQVKYSESDTQQTDERDATAFFQPATGGRKMDTEYKDRMLDVKNTSTFLTGPLEHALTAGVQVRRHDRDTQMWMPGKTYEVPKYNYGNFQPYFMPSGQVDSQGYYLQDAITLGDLTITPSLRYDHVTNEGKPNDAPYYNNPAAGHDYSDKTYSGWSPRLSLFWKMTEQTALFADYSKTWRAPVLDEQYEVQGVGSRTSTSRDLDPERITGIRVGSISNFSNVFTQGDSAQVRTMLFRNKITDEIFKATGVGCQQQLVTGGTIANTCGNGLMGNYRNIGDVVYKGFEVETFYDSTYLFGAVSYSWMEGRHEGAYTNPWGPDVWAKDVPAPKWITTLGVKIPAWDARVGWTAQFVGATNHLPSDKYFEGPASALGDRYYDNFGNEKYEIHGLFANWKPQQAYLKGTEVNLTVDNLFNKAIRPELSGENAYTVGRNAKISVTRFF

SEQ ID NO: 10411 - protein, 966 aa, Escherichia coli F11
MFTNSKLTKSIRLAMAVGTVAAISSSNVYAQEAASAAEDAAVEKIQVTGSRIQRANMVSASPVTEISAADIKVSGITRVEDILNDMPAVFAGQTSGTANGATGTATIDLRNLGPERTLVLQNGRRLPSGSPSAGGISADVNQIPAALIERIEVLTGGSSATYGSDAVAGVVNFILKDDFEGFSFDYQHSFYQHDNDNSGIQDLVSGSGFPVASGSVDDGNANDFSFLFGANTDDGRGNVTMYGTFRDIQAVVQSSRDYSSCAINGSPDAMGCGGSSTTPLGRFTDFDTFNYQLSGEEFVPFTDLYNYGPLNYFQRPDERKTFGATSHYEINEHVEVYAELSYMDDRSVAQIAPSGNFFSTDRLYCGNPYLSDSQFDLTCGAAGLTDEDYYEGFYIGRRNVEGGPRQDDLRHTSLRGVLGVRGIIDDNWSYDVFANYGTVSYLETYRNELSVDHMKKALDARIDPDSGDIVCASVLDGSDPSCVTWNIFSEGGVTDEALAYLIKPLYSRGDTKSTQVSGYVTGDLTDSGIVVPGTSTGVGVVAGVEYRKEQLILEPDFGFTSGDGAGQGGPTAGVRGDFSVKEIFGELNVPLLEGKEFAEELTLELAYRYSDYSTDKTTNTYKYALNWGINEQARVRASFQRAVRAGNIRELFRPSSLGLFNMDIDPCGVGGDFTLAQCLNTGLTEAQYQTSALESPAGQYNSITGGNTEVNPEESDTFSFGVALSPDFLPGFTLNIDYFKIEVEDAIDSIPETTILQLCGDTGNAAYCDLINRGPNGNLWVGTSSITATDLNIGYLKTEGVDFDANYEMDLGEGGELRLGFIATLLDSLATQSIPGGDVDECAGYWDRTVCGQPTPEWRHNLKATWVSPWDVNVTATWRHMSEVNEYEGVGQEDGPGKIDAQNYLDLSANWQAHENVNLRVGVNNILDRDPPIIVNAPSGTGNGNTFPGFYDALGRYVFGGVTVTF

SEQ ID NO: 10412 - protein, 1732 aa, Escherichia coli F11
MNVGAGTATLGGAVIKATTTKLTNAASVLTLTNANAVLTGAIDNTTGGDNVGVLNLNGALSQVTGNIGNTNSLATISVGAGTATLGGAVIKATTTKLTDAASAVKFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGDIGNTNALATVNVGAGTATLGGAVIKATTTKLTNAASVLTLTNANAVLTGAIDNTTGGDNVGVLNLNGALSQVTGNIGNTNSLATISVGAGTATLGGAVIKATTTKLTDAASAVKFTNPVVVTGAIDNTGNANNGIVTFTGNSTVTGDIGNTNALATVNVGAGTATLGGAVIKATTTKLTNAASVLTLTNANAVLTGAIDNTTGGDNVGVLNLNGALSQVTGDIGNTNSLATISVGAGTATLGGAVIKATTTKLTNAASAVTFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGNVGNTNALATVNVGAGLLQVQGGVVKANTINLTDNASAVTFTNPVVVTGAIDNTGNANNGIVTFTGNSTVTGDIGNTNALATVNVGAGITLQAGGSLAANNIDFGARSTLEFNGPLDGGGKAIPYYFKGAIANGNNAILNVNTKLLTASHLTIGTVAEINIGAGNLFTIDASVGDVTILNAQNINFRARDSVLVLSNLTGVGVNNILLAADLVAPGADEGTVVFNGGVNGLNIGSNVAGTARNIGDGGGNKFNTLLIYNAVTITDDVNLEGIQNVLINNNADFTSSTAFNAGAIQINDATYTIDANNGNLNIPAGNIQFAHADAQLVLQNSSGNDRTITLGANIDPDNDDEGIVILNSVTAGKKLTIAGGKTFGGAHKLQTILFKGAGDCSTAGTTFNTTNIVLDITGQLELGATTANVVLFNDAVQLTQTGNIGGFLDFNAKNGMVTLNNNVNVAGAVQNTGGTNNGTLIVLGASNLNRVNGIAMLKVGAGNVTIAKGGKVKIGEIQGTGTNTLTLPAHFNLTGSINKTGGQALKLNFMNGGSVSGVVGTAANSVGDITTAGATSFASSVNAKGTATLGGTTSFANTFTNTGAVTLAKGSITSFAKNVTATSFVANSATINFSNSLAFNSNITGGGTTLTLGANQVTYTGTGSFTDTLTLNTTFDGAAKSGGNILIKSGSTLDLSGVSTLALVVTATNFDMNNISPDTKYTVISAETAGGLKPTSKENVKITINNDNRFVDFTFDASTLTLFAEDIAADVIDGDFAPGGPLANIPNAANIKKSLELMEDAPNGSDARQAFNNFGLMTPLQEADATTHLIQDVVKPSDTIAAVNNQVVASNISSNITALNARMDKVQSGNKGPVSSGDEDMDAKFGAWISPFVGNATQKMCNSISGYKSDTTGGTIGFDGFVSDDLALGLAYTRADTDIKLKNNKTGDKNKVESNIYSLYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVSAIDARLQGMTAPLPTNSFKQSKTSFDVGVGVTAKHKMMEYRINYDTNIGSKYFAQQGSVKVRVNF

SEQ ID NO: 10413 - protein, 614 aa, Escherichia coli F11
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGTYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 10414 - protein, 790 aa, Escherichia coli F11
MKRVLIPGVILCGADVAQAVDDKNMYMHVFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSSVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPESDREMGNKSYGLAWDMDTQLAWAKLRTTVGWDHISDYTRHDHDIWYTELSCTYGDISGRCTRGGLGHISQAVDNYTFKTRLDWQKFAVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHISQVDINPQIVFSYIKSKGNLSLNNGYEESNTGDNRVVYNGNLVSYDSVPVADFNNPLKISLNMDFTHQPSGLVWANTLTWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 10415 - protein, 700 aa, Escherichia coli F11
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 10416 - protein, 387 aa, Escherichia coli F11
MKRKVLAMLVPALLVAGAANAAEIYNKNGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 10417 - protein, 1098 aa, Escherichia coli F11
MRKITRIKCLIVVLLTFIGTLAPVHAQQSGNFEISGVVKDTSGEPVIGATVIVKNTQIGTTTDVDGKFKLKVPHKSLLQISFIGMKTKDLKVTNNTFYEITLEDESVLLDEVVAIGYGTQSKATVTSGVVSVKKAELMSSVSASPLNNLQGKVAGLDIRQTTGQPGAQPVVLIRGGSTDPANDSPLFVIDGVVRSNMNGLNQEDIESMEVLKDAASAAIYGAKAANGIILITTKQGSSKDGKATISASYRLGVEQIRQHYPFSGARDYLYASRLAGSRGINDANVSGRLEGGAYPYSTGNINYKNGALEGYGYSRFTTEYLDDLISNMGQSYVDDLLNRQGYETMTDPYSGKQLIFKDNHYQKDVLFQTALTHNYDLSVSGGNDKGNYYVSLGYINSEGIVLGTGYDRFSLTANGNYNLRSNLKLTVGLKHSTISNKATDPENSGTSTMDRSSRYPTTFRLYYDDGTPGIGEAGGSPRNRLHELYYQDISDKAYRNTIQLGLDWEILKGLHFKPSASYYMQENIYRFFEKYNEFNKGRKTLEKHDQYKQIMADAVFTYDKVFSDKHTLNAMIGMNYTQDDTYKLKGTGSEAPTDYVPTLAPTKPDLQRTTSSLDKEVLVGFFARVNYDYKRRYLLTVSARYDGASQFAEDHKFALFPAVSGGWNMHYEDWFPKTVVSRMKLRASWGQTGNNKLSYSNTQGEYASYIYAGNPGVLNSVLANNSLVWETTSNVDYGFDAGFFDNRLELSVTGYNKLTSDRLYDKALPAQTGFSSIKANLGTVQNKGFELSLTAHPLSTTSPVNWDVTGTFSMNRTYMKKLPYNGRDKNRVQGGLVWDAKSGTYVETGGLAEGERIGGRWGYKYLGVYDTDEEAAKAPVDTKVSGSKMNKKKVAGDAIWADLDNNGVIDDKDITFIGWANPDKKGALINNLSYKNFSLRLVVDFALGHSIANIWRCRANANARNAIITTTDVTNGNIWWQTGDAATAKYPRYDVASDWDNGYRNHMRTIAYAGMNSNGNADNTAYYSKGDYLCFREVSLGYELPRSVCSKMKVKGVSLNAGVTNIGYITAFDGLNPEQYDGQETGEYFLPIQFNFGVRLTF

SEQ ID NO: 10418 - protein, 995 aa, Escherichia coli F11
MHSWKKKLVVSQLALACTLAITSQANAANYDTWGYHDNTTTDLVWPYDTDNDGIADAGGMDPMGSDGNYVTYNGFVYYNNANGDFDTVFKGDTVNGTISTYYLNHDYASGSVNQVDISNSVIHGAITSELPFGYYSITPAEVNAKGEVVTPQTYNGYNFYNGITTDLDYNWYDGDVFTLNVSNSTIDDDYEALYFTDTYLDGDKSKSTNETFYTALGVAVNLDVESNINITNNSRVAGIALSEGNTSNTTYTSEYHQWDNNINVSNSTVTSGSQTPLEESNGFFGKSAEPSDYAGNGGENDVALSFSDNAGSNYSMKNNVNFDHSTLLGDVEFTSHWNNDGVFFYSTGHDSNGDGVLDTNGGWVDDAQNVDELNITLNNGSKWVGSANMSAEVIAPADMYDVAPNSLTPGATIEANDWGRIIDNKVFQSGVFNVALNNGSEWNTVNSSVIDTLAVNNGSQVNVTDSSLVSDTIGLTNGSSLNIGEDGLVATDHLTVDSYSTVNLTESTGWNNYSNLYANTITVTNGGVLDVNVDQFDTEAFRTDKLELTSGNIADHNGNVVSGVFDINSSDYVLNADLVNDRTWDTAQANYGYGVVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLANSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 10419 - protein, 843 aa, Escherichia coli F11
MKNSIYGVLLFSSFALSIATELLADADTVNLAAGFNGSSSETFNVKQTNNVEGTTYTLTGAVSFANINKFDQADTSCFANSAGDLTFTGSRRLLYFNNITSSAKGAAISTTADAKTLTLSGCLSLIFYMSPKEDIGNGAIYSNSSMLIQQNSDVSFGYNKSAGKGSVILCEKSTSAGATSPTLTIQNNGEFKVLANLSASSGGAIYAEKMLLSAGGNTVFQANVTQEKGGAIAIAANGEISLSADGGDLTFERNIIIENNETIRNAIHLEDGAKFLQLRAAKDRSIYFHDPITTTGNVADRLTLNAANGATPYEGTIVFASGVSYVNSPLSKLYSFSQDLTLAAGSLILKDDVLIKAKSFEQNQKSLLFMHPGTRLQTTNNLSIKNLHLDLSKIAATAVEIAATADAAAIEICGPMVMHVDDEIFYNQEALADSLSFECLHVRAPHLDNITVDDVPLIPITTMETHRGYQGKWTVSWEEEHEMIFGNVSTQPNKKMSLVWNPSGYIPFVGGTGEFTTSLVPNSLWNLFLDTRFAQQAIETNAQSPGNGIWISSLTNSFRKGSTENNHGFRHKSSGYVAGGKFQTLQDDIFSVGICQLFGRSKDFGSAKSKDKAFSGSLYAHHSRYLLPITRFLAGTSRSQPRFLSRIPKDFPINFDALISYSYGRNHMKVKYADHSQTTSSWNTYGYSAQIGSSLPCALDVSHTFFQYVSPFVKLHWIYAHQVQFQEQGIKRRSFNNSNLKNLSLPIGLKIQGQSLHHLSYELTGMYIADLYRCNPESVTSLISGGLLPWTTTAANLGKQAALLQGSGNLSLTSHINIFAQGTVEFRRSSYSYAMDAGSRVHF

SEQ ID NO: 10420 - protein, 760 aa, Escherichia coli F11
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10421 - protein, 446 aa, Escherichia coli F11
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGNTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 10422 - protein, 468 aa, Escherichia coli F11
MRTFSGKRSTLALAIAGITAMSGWIVVPQAQASGFFDDSTLTGGIYYWQRERDRKDVTDGDKYKTNLSHATWNANLDFQSGYAADMFGLDIAAFTAIEMAENGDSGHPNEIAFSKKNKGYDEDYSGDKSGISLYKAAAKFKYGPVWARAGYIQPTGQTLLAPHWSFMPGTYQGAEAGASFDYGDAGALSFSYMWTNEYKAPWHTEMDKFYQADKKTNVDYLHSIGAKYDFKNDLVLEAAFGQSEGYVDQYFAKASYKFDLGGNPFTTSYQFYGARDKVDDRSVNDIYDGTAWLQALTFGYKVAEVVDLRLEGTWVKADGQQGYFLQRMTPTYASSNGRLDIWWDNRSDFNANGEKAVFFGAMYDLKNWNLPGWAVGASYVYAWDAKPATWQSNPDAYYDKNRTIEESSYSLDAVYTLQEGRAKGTMFKLHFTEYDNHSNIPSWGGGYGNIFQYERDVKFIVIAPFTIF

SEQ ID NO: 10423 - protein, 657 aa, Escherichia coli F11
MYMNVIKTAICTLITLPVGLQAATSHSSSMTKDTITVVATGNQNTVFETPSMVSVVTNDTPWSKNAVTSAGMLRGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGVSLWGNIASGDHSTGSGLTWFSKTEKTDALLSVIMRKRGSIYQSDGERAPNKEKPAALFAKGSVSITDSNKAGASLRLYRNSTTEPGNPTLTHGDSGLRDRKTAQNDMQFWYQYAPADNSLINVKSTLYLSDITVKTNGHNKTAEWRNNRTSGVNVVNRSHSLIFPGAHQLSYGAEYYRQQQKPEGTATLYPEGHIDFTSLYFQDEMTMESYPVNIIVGSRYDRYNSFNARAGELNAERLSPRAAMSVSPTDWLMMYGSISSAFRAPTMAEMYRDDVHFYRKGKPNYWVPNLNLKPENNTTREIGAGIQLDSLLTDNDRLQLKGGYFGTDARNYIATRVDMKRMRSYSYNVSRARIWGWDIQGNYQSDYVDWMLSYNRTESMDASSREWLGSGNPDTLISDISIPVGHRGVYAGWRTELSAPATHVKKGDPCQDGYAIHSFSLSYKPVSVKGFEASVTLDNAFNKLAMNGKGVPLSGRTVNLYTRYQW

SEQ ID NO: 10424 - protein, 753 aa, Escherichia coli F11
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTAHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNELEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFNIDTRDLLVEQDALRFKALAYRSRIQNYIYSESYLVCSGGRKCSMAEVIGNDWEGISDEYSDNMYIYVNSASDVIAKGFELEMDYDAGFAFGRLSFSQQQTDQPTSIASTYFGAGDMTELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 10425 - protein, 723 aa, Escherichia coli F11
MTAASTSCFTSRPSALAAACLCALAALAAPASAQVGAGLEPVIITGSTREQKLVDAPYAINAVGAEALRSAGPMVNLSEALASVPGLVVANRNNYAQDLQISSRGFGARAGFGVRGMRLYADGIPATMPDGQGQVAHFDLAGADRVEVLRGPFSALYGNSSGGVIAAYSKPVRERNFQVGIDAGSFGLRQQRVSVESPFDGGFSIAANFSNFDIDGFRPNSDADRRLANIRLAWVGEDDHVTLAISDQHQRANDPLGLNRALFSQNPDQTALAATNFRTRKTIDQTQAGLSWQHQLGGDSALQSTQVSGYLGRRSVFQMLSTPRANQLITADPGSTTPPNPNSAGGVIDFDRDYAGVDGRLSWRLGEADLVTGVNVERLRDARKGYENYRSATDLGVVGDLRRDETNRATTREAYAQLEQPLAEQWQLIAGVRTGQVELSNTDHYVNPPTNPTNPDDSGSLSFRYTNPVLGLRWQAAPTLTLHASASRGYESPTLGEVAYRPDGATGFNDTLQAQTSRQIELGAKWRPTPDYAIDAAVFRISTDNEIGVNANVNGRGTFKNVGRTLRQGLELSQRWRHSPTLRGQLALTVLDASYRSAPIDGNQIAGTQPASLFAEIAWKTWPGGEWGLEVRAQGRTALNDANQDAPGTPGGGFAAGWGIANLRYLHAWDIGSEAKVELLARVDNLADRRYAGSVIVAEANQRYFETAPGRNHLVSLRYLRKF

SEQ ID NO: 10426 - protein, 656 aa, Escherichia coli E22
MFRLNPFVRGGLCASALSLALPVIAAESGDTMVVTASATEQNLKDAPASISVITQQDLQRKPVNNLKDVLREVPGVQLTSEGDNRKGVSIRGLDSSYTLILVDGKRVSSRNAVFRHNDFDLNWIPVDAIERIEVVRGPMSSLYGSDALGGVVNIITKKIGQKWTGTLTADTTIQHHRDRGDTYNGQFFTSGPLVDGVLGLKAYGSLSKREKDDQQKSSTTATGETPRIEGFTSRNGNVEFAWTPDENHDFTAGYGYDRQDRDSDSLNKNRLDRQNYSLSHNGRWDVGNSELKVYGEKVDNKNPGNSSPITSESNAVDGKYVLPLGEINQLLTLGGEWRHDKLEDPVNLTGGNSSNTSASQYALFIEDEWRIFEPLALTTGVRMDDHETYGDHWSPRAYLVYNATDTMTVKGGWATAFKAPSLLQLSPDWTTGSCRGACEIVGSPDLKPETSESFELGLYYAGEEGWLEGVQASITTFQNNVDDRISITRTANVNDAQSYPNYVGLNGDGEPIFRYYNVNKARIRGVETELKFPLAEDWKMTLNYTYNDGRDISNGDNKPLSELPFHTANGTVDWQATQAWSFYVQGNYTGEKRAVTDGEPTPGGYVVWNTGGAWQATKSVKLRAGVQNLLDKDLSRDDYSYTEDGRRYFMAVDYQF

SEQ ID NO: 10427 - protein, 363 aa, Escherichia coli E22
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 10428 - protein, 999 aa, Escherichia coli E22
MNMQSKKYINKKNKAYRGFLFANCLYKLRSNQTHLLCSLSVLASAFFSLNVLATVTTGQMVQFDIKAQRADKALIEFAKQTEQTVVFSYELAKQYNANSLYGFYTQLDALEALLGDTKLDAVVDQNGLLSIKLKQINRKNNNMMKLSGVSAAILPALLAANTQGVNAAEDVAQEKIEKIAIVGSRVAGRSVEDLPVPVDILSAEALENTGQTEVGRMLQSIAPSFNFSSSSISDGTDALRPATLRGLGPDQTLVLINGKRRHQASIIHINTSVGRGTAGTDMNAIPASAIKRIEVLRDGAAAQYGSDAIAGVINIVLKDGSEGGKAAINYGQYSEGDGETINLDFNKGFALGDKGYVNTTLNYRDRAPTNRAGLHGSCQFNGCTTLDDGTLVAGDPRELTADRDTFRIGDADSQQFGLIVSTGYELGDGELYGFITYSTRDNESAAFFRHNANGGGNTVLQDNDATIQAGFLPKINTTIDDISYNFGYKTQFDNDASLDLSYTYGENSIDYTTSDTINASYANFLRYDQGLSAADIRATIPREAYAYGMELSLQTLNLDFTQNFDDYSLAMGAEIRTDEYRILEGSEYAYRDYDTNNGVSIYDGLSGGVGSEDASGGTQGFGGSSPMSSVDESRDVISFYLDAETYIIEDVILSGALRYDNYKGFGDTVNFKLAGNWSITDDISLRGALSSGFRAPSMQQLYFNNISTQFVVDDVTGNLVAEEVGTFRNDSTLAQSLGIPKLTEEKSQNRSLGIVYNVTDNINVTLDYYSIDIDDRIVISNRLGKGLSPSLDAALISSGAGAGQFFLNGADTETQGIDFVATWNTEGLGGTLDFTLAANFTKTDVVSLFTPAGSGLETVPVEDVFSDQEISIIEEWQPEDRINLSALYQRDDWTVNLSLNRFGEYTVEDGGRQTYGAEILTDVKVNYFVTENLSVNIGANNLFDVYPDENTIGNSRTGTIVDAQGNTIVSSPGVFKYSRRSAPFGFNGAYYYLGAEYRF

SEQ ID NO: 10429 - protein, 199 aa, Escherichia coli E22
MRKVCAAILSAAICLAVSGAPAWASEHQSTLSAGYLHASTNVPGSDDLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKKHDVLTGSDDGRHSNTSLAWGAGVQFNPTESVAIDIAYEGSGSGDWRTDGFIVGVGYKF

SEQ ID NO: 10430 - protein, 700 aa, Escherichia coli E22
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNINLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWAWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 10431 - protein, 199 aa, Escherichia coli E22
MRKLYAAILSAAICLAVSGAPAWASEHQSTLSAGYLHVSTNVPGSDELNGINVKYRYEFTDTLGMVTSFSYAGDRNRQLTRYSDTRWHEDSVRNRWFSVMAGPSVRVNELFSAYAMAGVSYSRVSTFSGDYLQVTDNKGKTHDVLTGSDDGRHSNTSLAWGAGVQFNPTESVAIDIAYEGSGSGDWRTDGFIVGVGYKF

SEQ ID NO: 10432 - protein, 949 aa, Escherichia coli E22
MKRHLNTSYRLVWNHITGTLVVASELARSRGKRAGVAVALSLAAVTSVPALAADTVVQAGETVNGGTLTNHDNQIVLGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGIARDTLIYAGGDQSVHGRALNTTLNGGYQYVHKDGLALNTVINEGGWQVVKAGGAVGNTTINQNGELRVHAGGEATAVTQNTGGALVTSTAATVTGANRLGHFSVGNGMADNVVLENGGRLDVLEGHSAQNTLVDDGGTLAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIRFDNQTTQDAVLSRAVAKGDSPVTFHKLTTNNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESSGSYGLVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHSVSELPVNWWVQPSVIRTVSSRGDMSMGTAAAGSNMTFSPSRNGTSLDLQAGLEARVRENITLGVQAGYAHSVSGSSAEGYNGQATLNMTF

SEQ ID NO: 10433 - protein, 746 aa, Escherichia coli E22
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYVTTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLARANYIAGAGAYTYNEPGRTWYMSVNTHF

SEQ ID NO: 10434 - protein, 317 aa, Escherichia coli E22
MRAKLLGIVLTPPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKIPYIGLTGSYRYEDFELGGTFKYSGWVEASDNDEHYDPGKRITYRSKVKDQNYYSVAVNAGYYVTPNAKVYVEGAWNRVTNKKGNTSLYDHNDNTSDYSKNGAGIENYNFITTAGLKYTF

SEQ ID NO: 10435 - protein, 199 aa, Escherichia coli E22
MRKLYAAILSAAICLAVSGAPAWASEHQSTLSAGYLHARTNVPGSDDLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10436 - protein, 365 aa, Escherichia coli E22
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 10437 - protein, 546 aa, Escherichia coli E22
MESNNGEAKIQKVKNWSPVWIFPIVTALIGAWVLFYHYSHQGPEVTLITANAEGIEGGKTTIKSRSVDVGVVESATLADDLTHVEIKARLNSGMEKLLHKDTVFWVVKPQIGREGISGLGTLLSGVYIELQPGAKGSKMDKYDLLDSPPLAPPDAKGIRVILDSKKAGQLSPGDPVLFRGYRVGSVETSTFDTQKRNISYQLFINAPYDRLVTNNVRFWKDSGIAVDLTSAGMRVEMGSLTTLLSGGVSFDVPEGLDLGQPVAPKTAFVLYDDQKSIQDSLYTDHIDYLMFFKDSVRGLQPGAPVEFRGIRLGTVSKVPFFAPNMRQTFNDDYRIPVLIRIEPERLKMQLGENADVVEHLGELLKRGLRGSLKTGNLVTGALYVDLDFYPNTPAITGIREFNGYQIIPTVSGGLAQIQQRLMEALDKINKLPLNPMIEQATSTLSESQRTMKNLQTTLDSMNKILASQSMQQLPTDMQSTLRELNRSMQGFQPGSAAYNKMVADMQRLDQVLRELQPVLKTLNEKSNALVFEAKDKKDPEPKRAKQ

SEQ ID NO: 10438 - protein, 1349 aa, Escherichia coli E22
MAFNALLFMQSWFYLDVLLEIVMNKIYRLKWNRSRNCWSVCSELGSRVKGKKSRAVLISAISLYSSLVFADDVIVNQDKAIDFGKENQSIDYRITVTDNANLVINATDTSRPRLTLASGGGLDITGGKVTINGPLNFLLKGTGFLNVSNAGSELYADDLYESNSGMRHDRGYFNVSNGGKIHVKGTSRLTYLQGNVSGEGSQVNSKTFFMGVYGSYGGNQYLSVNNGGEVNASEKISLGYYDQNSDTTLAVSEGGKISAPTISLSTNSELALGAQEGSAAKAAGIIDAEKIEFVWAKTSEKKITLNHTDKNATISADIVSDSEGLGYINALNGTTYLTGDNSAFSGKVKIEQNGALGITQNIGTAEINNRGKLHLKADDSMTFANKISGNGTISIDSGTVALTGNNYAFSGYIDVASGAVAVISEDKNIGRADLDVDGKLQINANKDWVFDNDLQGRGIVEINMGNHEFSFDEFAYTDWFQGSLAFQNTTFNLEKNAEFLQRGGITAGQGSLVTVGKGAHSISTLGFSGGTVDFGALTAGAQMTEGTVNVSKTLDLRGEGVIQVSDSDVVSSVSRDIDSALSLTEVDDGNSTIKLVDAQGAEVLGDAGNLQLQDKNGQILSSSAQRDIQQNGQKAAVGTYDYRLTSGVNNDGLYIGYGLTQLDLHATDSDALVLSSNGKSENAADLSAKITGSGDLAFSSQKDQTVSLSNKDNDYTGVTDLRSGTLLLNNDNVLGNTHELRLAAETELDMNGHSQTVGTLNGSADSLLSLNGGSLTVTNGGTSTGSLTGSGELNIQGGTLDIAGDNSNLTANVNIANSANVLVSHAQGLGSANVENNGTLALNNSAEKRAAASVNYTLGGNLTNNGTLMTGMSGQQAGNVLVVKGNYHGNNGQLVMNTVLNGDDSVTDKLVVEGDTSGTTAVTVNNAGGTGAKTLNGIELIHVDGKSEGEFVQAGRIVAGAYDYTLARGQGANSGNWYLTSGSDSPELQPEPDPMPNPEPNPNPEPNPNPTPTPGPDLNVDNDLRPEAGSYIANLAAANTMFTTRLHERLGNTYYTDMVTGEQKQTTMWMRHEGGHNKWRDGSGQLKTQSNRYVLQLGGDVAQWSQNGSDSWHVGVMAGYGNSDSKTISSRTGYRAKASVNGYSTGLYATWYADDESRNGAYLDSWAQYSWFDNTVKGDDLQSESYKSKGFTASLEAGYKHKLAEFNGSQGTRNEWYVQPQAQVTWMGVKADKHRESNGTLVHSNGDGNVQTRLGVKTWLKSHHKMDDGKSREFQPFVEVNWLHNSKDFSTSMDGVSVTQDGARNIAEIKTGVEGQLNANLNVWGNVGVQVADRGYNDTSAMVGIKWQF

SEQ ID NO: 10439 - protein, 760 aa, Escherichia coli E22
MENNRNFPARQFHSLTFFAGLCIGITPVAQALAAEGQTNADDTLVVEASTPSLYAPQQSADPKFSRPVADTTRTMTVISEQVIKDQGATNLIDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10440 - protein, 978 aa, Escherichia coli E22
MHSWKKKLVVSQLALACTLAITSQANATTYDTWTYYDNPTTALDWNNMDAAGTVDGNYVNYSGFVYYNNANGDFDQTFNGDTVNGTISTYYLNHDYNDATSNELNISNSVIHGSITSMLPIGYYDRFDTLDHDGYSEYYRFNNGTDTVDGNWYDGDVFTLNIANSTIDDDYEAFYFTDSYKDGDVTKYTNETFDVSEGVAVNLDVESNINISNNSRVAGIALSQGNTYNNTYTTESHNWDNNINVFDSTVTSGSDYILDSAYTTDTGTFGTGHFGNSDEPSDYTGAGDVALSFTDDNGASDYAMKNNVYFSNSTLMGDVKFTSNWNANFDADGDDTNGDGVPDTNHGWADDGLNVDELNLTLDNGSKWVGQATYTVDTTSRMYDVETNSLTPGATLEDNAWNRIVGNEVFQSGVFNVTLNNGSEWDTVGDSTVDTLAVNNGSQVNVSNSDLTSDTIDLTNGSSLNIGEGGYVDTDHLTIDSYSTVGLTESTGWSTYSNLYANTITVTNGGVLDVNVGQFDTEVFSTDKLELTSGNTADHNGNVVSGVFNIHSSDYVLNADLVNDRTWDTTQANYGYGTIAMNSDGHLTINGNGDINNGDELDNSSVDNVVAATGNYKVRIDNATGAGSVADYKGNELIYVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 10441 - protein, 1212 aa, Escherichia coli E22
MNKIFSLKFSTASGGLIAVSELARKCVKKSFRRRHIASCLLMATLYPGFIFAGTVNSDIDYQLFRDFAENKGHFIAGATNITVTDKNGNVTGILDKAPMPDFSPVSTNGVATLINPQYVASVKHNGGYQGVTFGNKSQNPDNDHFNYKIVDRNNHTKLDFHAPRLNKVVTETAPSAITEQGATPGAYLDKERYPVFYRLGSGTQYIKDASGNLVKVGAAYSYLTGGTVPNLSSYNNGQMISAASGTVFNYSTNGALPIYGEAGDSGSPLFGWDTTLNKWVLVGVLTAGNGPGGRANNWAVLPLDFIQTTLDEDNDAPVIYDSVNGGALDWVFDSATGIGTLTQGITKFEMHGQKAADLDAGKNLIFSGVDGKLNLKNDVHQGAGALTFKNDFTVASDSGNIWTGAGVIVDKDATVKWQINGQHNDALHKIGEGTLYVNGIGTNPGDLRVGDGTVILAQQADENGNKQAFNKLTITSGRPTVVLKDAEQVNPDNIYFGYRGGRLDLNGNNLSFSRIKNADSGANIVNNNKEIASLLTINGKGMDDKNNFQTFLGILGETDSKRHNGVLNVSYAPVAGSGVLNLSGGSNLNGDINVQNGGTLLLSGNPVQHAGNVFIEGDWNKTQFNLNNINVASGSSLHVSEYAELNGNINAGEGAFVSLGYTEGVTQRCKLDNNTGKTSCSHMTPENVVDSKASRVIATGDVTLNGGSLMHVGNASLTGGISGAPDSHLILSSDAMINLDKNSSVGRLVSEGGKVSMLSSEWSPKKFTIEESYTSNLALNMGVNIKDNVGDKIEILNLAQGANNSLDLSNLYGQSGELAYDLTIASAPSGTSHDFFSFASFDRGFTVYTPNTQVTEQDGKVLWQLKGKNPAPPESEKPVPPESEKPVPPETEKPVPPETEKPVPPETETPGATQPGNGLFDGKDNKKLLKDARNMFASRQYLISNSSDRWEMIIDDATRNDNVWAMNTFRTGGYDGFTAKQHGLDLGIHKAQDSDYFWGAGIGFHKGDTSNSLFRDDYKMFSGNLYLGKDFESGLFVNAAVGYKHLSENFKVKGELNDLSGKVNTNIVTAGARVGYRMHSDELQASVSPSVSVNSSWMEGGKIHAKERQVDLHSGWAASVKAGVLADKSFENSKVTGGIYRNFSVKDMPGVTLSDSWKSRSYEAKKDDHFTATIGVEGKITEKMNANLKLTSHFGGDFKTDTIGTLGLKYEF

SEQ ID NO: 10442 - protein, 878 aa, Escherichia coli E22
MDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGLAIYTQRNSIETQVHKDALKGVQSYNRLIATTDTSSGYFVIQDECPKPNDYDSCITSAKPPAKLSSQRETVSVSDYTGANRIKPNPMKYESQSWFLRGGYHFSEQHYIGGIFEFTQQKFDIRDMTFPAYLRSTEKPDLANRSFYPMQDHGAYQHIEDGRGVNYASGLYFDEHHRKQRVGIEYIYENKNKAGIIDKAVLSANQQNIILDSYMQHTHCSLYPNPSKNCRPTRDKPYSYYHSDRNVYKEKHNMLQLNLEKKIQQNWLTHQIAFNLGFDDFTSALQHKDYLTRRVTATADSIPGKVGKTGKLRNGFKEQPYLYPKPKVDFAGRDHCNYQGNSSNYSDCKVRLIKGKNYYFAARNNMALGKYVDLGLGIRYDVSRTKANESTISVGKFKNFSWNTGIVIKPTEWLDLSYRLSTGFRNPSFAEMYGWRYGGNNSDVYVGKFKPETSRNQEFGLALKGDFGNIEISHFSNAYRNLIAFAEELQKNGTGKGNYGYHNAQNAKLVGVNITAQLDFNGLWKRIPYGWYATFAYNRVKVKDQKINAGLASVSSYLFDAIQPSRYIIGLGYDHPSNTWGINTMFTQSKAKSQNELLGQRSLGNTSRNVKSTRKLTRAWHILDVSGYYMANKNIMLRLGIYNLLNYRYVTWEAVRQTAQGAVNQHQNVGNYTRYAASGRNYTLTLEMKF

SEQ ID NO: 10443 - protein, 409 aa, Escherichia coli E22
MSGFGVGVSILASLFNMTFQLRRSIDVKKISAAVAAFVALAAASAHAQSSVTLYGLIDAGLMYTNNVKKGGSEGALVQATSGNINGSRFGLRGAEDLGGGLQAIFVLENGYNVQNGKLGQNGRLFGRQAFVGLSNKEYGAVTLGRQYDSLVDFVAPLSGTAGTFGDTGFAHPFDNDNLNHSVRMSNSVKFMSSNYAGLKFGGLYAFSNNTDFSINRAYSAGVSYANGPFKAAAGYLQINGSNSTTNTGGAVDLGESTANGTGGFQLGADVQRTAGAGLSYAFGPVTAGFVYTHSQFQNTTSFGATHGSMRFDNYELNGKYALTPAVTLGAAYTYTDAHVGGTSTYGSDSKWNQVNLQAVYALSLRTDVYAEAMYQHVTGKGYTAFINTAGGASSTGNQVVGAVGIRTRF

SEQ ID NO: 10444 - protein, 127 aa, Escherichia coli E22
MKGDWADSHRDEADDFYRHQADIKYYSFLAGPAYRLNDYISFYGLVGISHTKAKGDYEWRNSVGADESDGYLSESVSKKSTDFAYAAGVIINPWGNMSVNVGYEGTKADIYGKHSVNGFTVGVGYRF

SEQ ID NO: 10445 - protein, 850 aa, Escherichia coli E22
MQGILMKNSIYGVLLVSSFALSIATELLADADTVSLATGFNGSSSKTFTVKQSSNVDGTTYNLTNAVSFLNINELNPANTSCFANTAGNLTFNGNHRLLYFDGVKSTAKGAAISTTADAKTLTLSGFLNLIFYMCPKEEVGNGAIYSNSSILLKNNSEGSFGYNKSAGKGSVICCEKSTSVGATSPTLTMQNNGDLTFLANASKASGGAIYAEKLLLSSKGVVSFRSNVTEGKGGAIAIAANGEISLSADSGNILFERNILVENNENIRNAIHLDNNAKFLQLRASEGRFIYFYDPITSTGSVADGLTINGNNGGPAYEGTIVFSTGGDHTYSSSPLSKLTTFSQDLTLASGSLILADGVTIRAKSFEQNRKSLLLMNPGTQLETSGNISIKNLHLDLNNMENDPVVITTTTDGSSVDVHGSIVMHTDNEIFYNQTALAQELSFELLHINAPQLNNISLSDIPEVPLSTLESHRGYQGTWKISWADQDPANIGGISVRSNKKMSLNWKPSGYIPVIGGTGEFTTSLVPNSLWNLFVDTRFAQQAIETNAISSNNGVWISSLTNSFLKGSTNNNHGFRHKSSGYVVGGKTETLYDDIFSVSFCQLFGRSKDFGSAKSKDKFFSGSFYARHSRCLLPIMRFLAGTSRFRPRFLLQIPRDFPINLDALVSYSYNRNHLRAKYSDRSQTTGAWNTYGYSAQIGSSLPFALDVSHIFFQSISPFIKLHWLYAHQVQFQEQGIKRRSFNNSNLKNLSLPIGLKIQGQSLHHFSYELTGMYIADLYRCNPESVTSLISGGLLPWATTATNLGKQAALLQGSSNLSLTSHINIFAQGTVEFRRSSYSYNMDFGSKVHF

SEQ ID NO: 10446 - protein, 199 aa, Escherichia coli E22
MRKLYAAILSAAICLAVSGAPAWASEHQSTLSAGYLHASTNVPGSDDLNGINVKYRYEFTDTLGLVTSFSYAGDKNRQLTRYSDTRWHEDSVRNRWFSVMVGPSVRVNEWFSAYAMAGMAYSRVSTFSGDYLRVTDNKGKTHDVLTGSDDNRHSNTSLAWGAGVQFNPTESVAIDLAYEGSGSGDWRTDGFIVGVGYKF

SEQ ID NO: 10447 - protein, 215 aa, Escherichia coli E22
MTENKEVIMRHLYATILLFTTLLAGIAFPAQAESGHGAFSVGYAQVHPGGVPALSGTDARAGDLKGINVKYRYEFTDHLGGIVALSYASVKKSDTMKTGENTFHYESLRGRYVSLMAGPVWQLSERVSLYGMAGMAYTRWSDSVQDYRRDEVKPGYVKETTTASDGHTARHLSPAWNAGIQFSPVETVVIDLAYEGSGSGDWRTDGFIVGVGYKF

SEQ ID NO: 10448 - protein, 189 aa, Escherichia coli E110019
MKIVLALIATVAVGLGTESLAQGAAVEEESGLYTNGDLVGVKPKVTNLGSIDDGGIIYKAGGGYQFNKYFALEGNYTRFPNLKSGRVIPEKSNTEIYAAGKAIIPLKKGYNVFAKIGAAQVSITTVPGMEDVSGINLSNTHSEVLPYGGLGVGYSVSQKVGFNLQFAGTPEGDNIPARYAVMGGLSYNF

SEQ ID NO: 10449 - protein, 244 aa, Escherichia coli E110019
MRKLWILLSACLLSISPTIASAEQTGLYIAPKFIWGFAPVDIKTTGTIGIVNVQTISDSVSHKKTESLPGGALAVGYDFNHMFQTPIRTELEFSFFKKMDIKHNGQKTDITLGALLVNGYFDIKTDSPFTPYIGVGLGIAGVKTKSNAIIDSLGYDIKVKLDDKTKKNFAWMATVGTSYEISETFALDLGYRFAGFGKGETKSWNKSQIVDLLPLGPVTATANASLKTKEIFMHQIILSARLTF

SEQ ID NO: 10450 - protein, 790 aa, Escherichia coli E110019
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADHISWRNVSLMPGVRYDYDNYLSNHNISPRFMTEWDIFANQTSMITAGYNRYYGGNILDMGLRDIRNSWTESVSGNKTLTRYQNLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 10451 - protein, 747 aa, Escherichia coli E110019
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 10452 - protein, 199 aa, Escherichia coli E110019
MRKLYAAILSAAICLAVSGAPAWASEQQATLSAGYLHARTSAPGSDNLNGINVKYRYEFTDTLGMVTSFSYAGDRNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10453 - protein, 367 aa, Escherichia coli E110019
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 10454 - protein, 351 aa, Escherichia coli E110019
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 10455 - protein, 186 aa, Escherichia coli E110019
MNVSKYVAIFSFVFIQLISVGKVFANADEWMTTFRENIVQTWQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 10456 - protein, 424 aa, Escherichia coli E110019
MKKSLFAVAALSAIAGSAQAQSSVTVYGLLDLGYVGYNTRAATGSTQNPQAVNKTTGNAFSSSAESTSRLGFKGTEDLGGGTSAFFTVELGLTPNNNQAVNTGGTQNRQTFVGLKKNGIGQFALGTQYTVVHNAVAATDPGQANNISGNLIYPATTEGAGSAENSTGAAYTVRTNNQLSLNSDTFAGFKANAMLVANNKNSNETITVTGTPAAGTYAAAGGLNNQNGWGLGLDYTFKNFYATANYQAMTSKQSAQTYTYTSPYVTGITAGAPAQGYAGGSSANGTNVQDNQWYVAATYDFGILKAYAQYITRKVSAQQDNSYYYKRSAEQIGVRSFITPTIEAWVSGGLGRYNGYGANTANLTAWQIGSNYWLSKRTNLYAIYGQVGTSNASYPTSVAGGAQNTNLNPASANISNYAVGVRHTF

SEQ ID NO: 10457 - protein, 760 aa, Escherichia coli E110019
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10458 - protein, 732 aa, Escherichia coli E110019
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLSLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 10459 - protein, 215 aa, Escherichia coli E110019
MTENKEVIMRHLYATILLFTTLLAGIAFPAQAENGHGAFSVGYAQVHPGGVPALSGTGARAGDLKGINVKYRYEFTDHLGGIVALSYASVKKSDTMKTGENTFHYESLRGRYVSLMAGPVWQLSERVSLYGMAGMAYTRWSDSVQDYRRDEVKPGYVKETTTASDGHTARHLSPAWNAGIQFSPVETVVIDLAYEGSASGDWRTDGFIVGIGYKF

SEQ ID NO: 10460 - protein, 438 aa, Escherichia coli E110019
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 10461 - protein, 774 aa, Escherichia coli E110019
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 10462 - protein, 212 aa, Escherichia coli E110019
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 10463 - protein, 863 aa, Escherichia coli E110019
MLAVCCALFYSQSSISAESVEYDSSFLMGSSASTIDISKYSDGNPTPVGTYSVKVFVNENPVSSLSIPFIDIGKVSAEACLTQKNLAQLHIKQPEINATNQILKKGEEEDQDCLNLPVAIAHSEVNFDMGEQRLDITVPQAWLIEGYDGYVEPSLWEDGIPAALLSYSANGYHSTNGSADNDSMYAAFNTGINLGAWRFRANGNYNWTKDSGSSFDYQNRYLQRDLPSMRSQLVVGETYTTGETFDSVSIRGARLYSDNRMLPSQLANYAPIIRGVANSNTKVSITQGGYKIYESTVPPGPFEISDISPSGYGSDLIVTVEEADGSKRTFSQPFSSVMQMQRPGVGRWDFSAGEVNDDELHDKPYMAQGSYYYGLNNFLTLYTGVQGTDNNYLAGLLGVGLNTPLGAFALDVTQSRTEIPEDKTYKGQSYRLTWNKLIEPTATSFNVAAYRYSTQDYLGLNDALQLIDDAKHKDADDRNTMLNYSRMKNQVTVSINQPLRFKEVDYGSFFLSGSWTDYWATNESRTDYSLGYGRGFSWGSLSINLQRSWDEDGEKDDSLYINFNVPLENLLGGGRRKSGFSSLTAQMRTDFDGGYQLSMNSNGSSEDHTLNYSVNTGYTMQKNEKNITDVSGYASYQSPWGDVTASASANNDSSRQYSLATTGDFVLHGGGVTFTNDNFGNSDAIVLVKAPGAKGARINGGNSTIDRWGYGATNSLSAYRENQVNIDIDTLENDVELKSTSTTLIPRDGAVVLASFETDQGRSVILNMSRNDGKALPFGAEVYENDVQIDNMGQGGQAFVRGISDAGELSVRWFEENQPATCLATFALPATQQTVGSSQTLLLDHITCRVNNLKSNGIDNEKE

SEQ ID NO: 10464 - protein, 961 aa, Escherichia coli E110019
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKIKTDGSTGVYIGGLNGNNANGAARFTATDLTIDVQGYSAMGINVQKNSVVDLGTNSTIKTNGDNAHGLWSFGQVSTNALTVDVTGAAANGVEVRGGTTTIGADSHISSAQGGGLVTSGSDATINFSGTAAQRNSIFSGGSYGASAQTATAVINMQNTDITVDRNGSLALGLWALSGGRITGDSLAITGAAGAKGIYAMTNSQIDLTSDLVIDMSTPDQMAIATQHDDGYAASRINASGRMLINGSVLSKGGLINLDMHPGSVWTGSSLSDNFNGGKLDVAMNNSVWNVTSNSNLDTLALSHSTVDFASYGSTAGTLTTLNVENLSGNSTFIMRADVVGEGNGVNNKGDLLNISGSSAGNHVLAIRNQGSEATTGNEVLTVVKNTDGAASFSASSQVELGGYLYDVRKNGTNWELYASGTIPEPTPNPEPTPAPAQPPIVNPDPTPEPNPTPTPTPAPKPTTTADAGGNYLNVGYLLNYVENRTLMQRMGDLRNQSKNGDIWLRSYGGSLDSFASGKLSGFDMGYSGIQFGGDKRLSDVMPLYVGLYIGSTHASPDYNGGDGTARSDYMGMYASYMAHNGFYSDLVVKASRQKNSFHVLDSQNNGVNANGTANGLSISLEAGQRFNLTPTGYGFYIEPQTQLTYSHQNEMAMKASNGLNIHLNHYESLLGRASMILGYDITAGNSQLNIYVKTGAIREFSGDTEYLLNNSREKYSFKGNGWNNGVGVSAQYNKQHTFYLEADYTQGNLFDQKQVNGGYRFSF

SEQ ID NO: 10465 - protein, 215 aa, Escherichia coli E110019
MTENKEVIMRHLYATILLFTTLLAGIAFPAQAESGHGAFSVGYAQVHPGGVPALSGTGARAGDLKGINVKYRYEFTDHLGGIVALSYASVKKSDTMKTGENTFHYESLRGRYVSLMAGPVWQLSERVSLYGMAGMAYTRWSDSVQDYRRDEVKPGYVKETTTASDGHTARHLSPAWNAGIQFSPVETVVIDLAYEGSGSGDWRTDGFIVGVGYKF

SEQ ID NO: 10466 - protein, 199 aa, Escherichia coli E110019
MRKLYAAILSAAICLAVSGAPAWASEHQSTLSAGYLHVSTNVPGSDELNGINVKYRYEFTDTLGMVTSFSYAGDKNRQLTHYSDTRWHEDSVRNRWFSVMAGPSVRVNEWFSAYAMAGMAYSRVSTFSGDYLRVTDNKGKTHDVLTGSDDGRHSNTSLAWGAGVQVNPTESVAIDIAYECSGSGDWRTDGFIVGVGYKF

SEQ ID NO: 10467 - protein, 757 aa, Escherichia coli E110019
MTENAGLQWRKVLHLELESSQVTIDGMNMGTPEDGTRSTPLDVIPSDSTERLKVVKSPTPDMPGDSIGGAIQVESTSAFDRDGRTLRGSIEGSHQSLFGKTSPNGAFNYSDIVGGTFGVAVGVNYQDRELESDNTEVAYEIFEGGADDDLFAGEVQRRKYFIERTRMGANLNLDWRPDADNRYYLRSLYSRFDDAETRHRTIFGLSDGEVSANGDGTYDVADLPADSISKRVRYRTKQEDNMAVSVGGENRLSSATVDYKVGYTKTTEHVNDEKEARFNYDGDDLSATVDQRSGIARLWFSDNGWQSNDDFVFDRFVIAPKQVDDSERSAQINVRFDGEHSSLKVGVLGRWRERDVNVDESELRRGPAIDLSDWTKAAPEHRGGTLGESIGSDGMRRYWNTSGTLYSARPQDVGGNLQTSLQDDYNASEDVFATYAMGTCDIGALRMIAGVRVENTQFNATANQVDVAPNGRTATVTPREASSSYSNVLPGLHLRYDSGNDWVLRFAANKTLSRPSFGDVSPRVSINRGDNEVSIGNPDLNAYRSQNLDLSFEKYIGSTGLISLGVFHKSIDDYIVQTLNTNDAQFPGFQVTRAINGDTAKVRGAEFNWQQTLDFLPEGWNGVLVGASASATALDSDFDPGLTNRAGDDFMLPRSSRRIYSGHLGYEKYGFSARVAAVYRSPYLDTIGQSRAYDIYVAPHTQMDFSMSYQFNSHVSLYLEAQNLLDEPLELYQGIPSRTLQNEEYGRTYALGLKVAL

SEQ ID NO: 10468 - protein, 948 aa, Escherichia coli E110019
MKRHLNTSYRLVWNHITGTLVVASELARSRGKRTGVAVALSLAAVTSVPVLAADTVVQAGETVSGGTLTNHDNQIVFGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINENGRQIVAAEGTANTTVVYAGGDQTVHGHALDTTLNGGYQYVHNGGTASDTVVNSDGWQIVKEGGLADFTTVNQKGKLQVNAGGTATNVTLKQGGALVTSTAATVTGSNRLGNFTVENGNADGVVLESGGRLDVLEGHSAWKTLVDDGGTLAVSAGGKATDVTMTSGSALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVHGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 10469 - protein, 773 aa, Escherichia coli E110019
MQGKNTIVTTGDYSIGLLSQTSGNLNTDTIIRVNSDGSVTPSFSDGDDTFIVTAGNHAVGVLACASPGSACACVSSLDEESTADTGSNENNAIAKLDMAKGEITTHGTESYAAYANGTVVKAGDTLDYTNASVTLTDVDITTHGDNAHAIAARQGTVSFNQGEIYTTGPDAAIAKIYNGGTVTLKNTSAVAHQGSGIVLESSINGQEATVDILSGSSLRSANEILYHKDETSNVTITDSEVSSAADVFINNIKGHLTVDATNSKITGSANISTDDNTHTYLSLSDNSTWDIKADSTVSNLTVDNSTVYISRADGRDVEPTRLTITENYVGNNGVLHLRTELDDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRPEAGSYVANLAAANTLFVMRLNDRAGETRYIDPVTEQERSSRLWLRQIGGHNAWRDSNGQLRTTSHRYVSQLGGDLLTGGFTDSDSWRLGVMAGYARDYNLTHSSVSDYRSKGSVRGYSAGLYATWFADDISKKGAYIDSWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGVSNLGEIKLGVNGNLNPAASVWGNVGVQLGDNGYNDTAVMVGLKYKF

SEQ ID NO: 10470 - protein, 830 aa, Escherichia coli E110019
MAEAAANGDAPDLAEGTAEDIVVTANKRPERSAAVPATIASVSEDILRQAHVRDLFDITNLVPSFRVEQQQSSAQTNFLIRGFGNGDNNVGIEPSVGVFVDGVYRSRSAAQISDLVDVAQVDVIAGPQTTLFGKNASAGVISIRTNEPAFTLGGNVEASYGNRNAVMLKGAVTGPLSETVAVRLSGSYDRDDGYAHNLTTGRSVNDRNRWSAKGQVLWVPAPDFRVRIIADADRIKESCCAVVNLQRSGANDLIDAIGGAVNTEAQALSDRFYSNFDPTNDIKTHGVSVQLDYQTGPFHITSISAWRAIQSDSNQDADFTGADLLTEYSQRQRIRTLTQELRVSTDFQGPFNFLAGAYIFNERIRQSNVMAWGTQMRPYADGLIQGLSSQLGVPTSLAEVEGAISALSGTDLTGQFFGEGQAQLQRYGLQNDSYSGFIQANFKATNHLTITGGLNVTRDTKHYRVQISSTDVFSSLDLPAIANGAINAGFPEDVGLGLVALAPLQLLPSTPEVPNAVENGRTANTHLTWTARAAYQFTSALTGYVNASTGFKPSSINLSRDSRPSLADAPALVAANLAPPATIAVAGIPISTSAYGSRYSAPETSTLYEIGLKGRWRNAALNVSLFKETVRDFQTVIFTGTGFFLQNAGKQSNWGIEGDITLRPLPHMTVSGALAWYNPKYDHFPDSSVGDLTGTKPANIAPLSLTIAGEYEHPLSNGNALKLRTSWHHEGRTRIMDGLPAETLRDPITQSVISYEPAIAAAQAYARKVDQIDAALSFIARSRIEISAWVRNLTNSRHLIGVIDSPAQPGSISGYFNRPRTFGASVALRW

SEQ ID NO: 10471 - protein, 1503 aa, Vibrio parahaemolyticus
MINKNFPLSYLASFVAFAVSLSATASVFRDDIDLQYYRDFAENKGKFTVGASNIEIKDKSGNTLDALFPNVPMPDFSAANRNLGIATLVAPQYLVSVAHNTQYNTVEFGAPGTNADAHHYTYKVVDRNDYGIVEGGQHQDYQVPRLNKLVTEVAPATVTDLGNNASAYQDSSRFTHFARLGSGRQIVKNTEHKDNQISTSYQYLTGGVHLPIAVHNSDYWLDFRGNALNNSPYGALTAFGTRGDSGSGVYGYDQKTKRWLLLATYTFGTPANNYYNRAGIIRQDYHDKQFAEDIAGTLTNAQQNAVFEWSAQGKDSSIGNKGKNLTVSLADRSIKDNSASPLGYGGTPQLQLPQDNTGKTLNIEGQDSTIVLKTDIDQGAGALNFNANATVRPENDQSWVGAGIVVAKGKQVNWQVKNPQGDRLSKLGEGTLHINGKGENLGDISVGQGTVILTQQAGENGKKSAFNQVGIVSGRSTVVLNSADQVDPNKIYFGFRGGRLDLNGNNIAFNRIQNSDDGARIVNNHLQKAATLTINGPKPPEATDLKWGTWKENSADIYEYINPHANNRTDYFTLKGNPNQYMPTNGASNAHWTFLSSNKDAAVKQVLAQKGLEHRYNSFNGFIGETDNTQHNGRLNVVYDPKASTPPATASEVTWGKGLVAGADIYLFTNPKTKIREYFALKGDPKQPVPRGGLSSEHWEFLAADRNQAINKVLARKNAPIEQEKLNSIYTFSGGLNLNGDLTVKGGKVLLSGRPTPHAYDAINKQDVVYADDWQNRQFKADNMQLNQYAQLYVGRNVSNLQANLSANDHAQLHLGFINEQTPSCYYSEYTGKTSCDTQAVVSNEIFATLPTTQINGDVSLAEQSQLHIGKANLIGTIQAAATTSIRLANQASWTNTGDSRTGNLVAENGSTINLNEKFVTGEIPTRFNTLIIDGNFQGNAKINYLTDIAAGKGDHLQVNGLAEGTFTLALRNSGKEAEVVSPLSLLTLTHQAQADKAKVSLENGYVDLGAYRYVLANRSNGYRLYNPLKDAKDRNQSIATAKAELDHAIAEADKQKQEISRLNAEAEKERQAEKNAKQAAANAQSQLSQANSELTRLQQYADYYRRYYPTYYRQIQGQITVAKQKVTQASAALTTAENNAKASAAQIANVEQAVETAQNIAKQVEAKLATLRITAGNSEAILNAEALKLCQENGANCEHLQAHADTDSSNIQQSDWVSQYANTALSELSAQANSALQIGQDLDRQLFAKHDKFHVWSSIEHQKTEHQSDLYRPYEQQTNLTQLGIELPLANGINAGVMLSRNHANAEFDEGVNGKSNLLMASLYGKWHSENGTFVSLDGSYGKAKNRIDLFGENRFNRHIMAIGANLGHNFDLAGVQVQPAVGTRYYRFSAQNYKLGEVEVRSPKAHFMAYQAGVKVSKAFDLSSWKVEPSLAAHYVDASSKRLSVAVNDNTFSQRFGRYLKTEVGVGVTKGQWQLSSHLGLLKGNEIGKQHFAGFKLGYSW

SEQ ID NO: 10472 - protein, 933 aa, Vibrio cholerae
MKQTFFWKLVFLSSLAPLTQLSATEVVLPLSGIHTGEDPELFTMLTTSPQGTQYTLRGEFTLKDFLGLSIHKPGGAFRNLEGNLTFTGSSPLAVLNFTNLQLGSQGAGIFSKSLLNFENLKTLRVQNNQSTGGVITSRQDMFFTKNTQLLFENNVSRGPGGAILLTGTQPNRVVFSEQRGGISFINNQAEVVQNISHSGNGGAISSEVAGSTILFDGNQEILFQKNQAKFGGGIYNAQGSVEFSKNRNTITFTENYALESGGVICANLCSINTQSAPVYFRKNRADYFGGAIHSHQTIVKNNDAAIFFSENSAEGGGAITASSCHLIASQPIIFSENSAGNLGGGAIYLGGPQPQLYLHAQAGDIIFIGNVARVSTKHSSGLHNNAITIKGSPENIRLVANENQSIIFYDPFLATSPSAHPININSGDNIFHCGSVIFSGEKLPLDRQDKTNKTSIFNQPVYLHNGTLSITGGAILAVQEFKQFGGVLNLSPGSMLTSYNSLGKDVVISNINFGLDTAHSHLPAEIRSGNAVIKLSGSPQIHDPDNIFYDNHSLASQPYQMEIIFKSDKGIHTEKFVSEEIAIQQNTYGYQGIWKFHWSEGDSKKHKTLRALWIPTGTFVLNPEKEGSLVPSSVWSTFSGMRASNDAILDNYLNNNTLFPIKHMCIFGGVVSSILEQNTNHDNHFSTTQAGHNLGIKLPFSPNTVVCATFSQLHGSSSQDQIPGKSRSHMLMGTVAAFKNWKALSFRFSISYAEESHVMKHQFSKKDITRGAWKNQGIRGCVGLSYAYPKGIRCLKITPFVNLEYTTINQNPFIETGYDPRYFTSSRLNNLALPTGVSLELRFFGAKYSLLSEFSMAYIKDLFREDPLATASLILNQHSWKVGGVFMGQEALNLKFRTTFKCKLAKAYLGISTMQREGNSFSGDAFGGISLSF

SEQ ID NO: 10473 - protein, 225 aa, Bacteroides coprocola DSM 17136
MQENSPLLQLQNVGYLAGDAKILNNINFSLRAGEFKLITGPSGCGKSTLLKIVASLISPTSGTLLFEGEDVSTLKPEIYRQQVSYCAQTPTLFGDTVYDNLIFPWQIRNRQPDPAIFLDFLERFALPDSILTKNIAELSGGEKQRISLIRNLQFMPKVLLLDEITSALDESNKHNVNEMIHRYVREQNIAVLWVTHDKDEINHADKVITLQPHAGEMQEARYELA

SEQ ID NO: 10474 - protein, 1541 aa, Bacteroides coprocola DSM 17136
MKKRIRRRILPAAALLSLGIPAGMAATDTFTFTPGSPITIPSGSLTGVADVQNPAASINVIQNVSVSLNIAGNPTDFSTGDLYAYLRLDTPGGTGFTILLNRVGVTASDPFGYADTGFNVTFSAAAPNGDIHLYQNSAAYPNALSSGTLTGTWQPDGRNTTPPLVALDTDARTALLNSFDGLSAKGTWTLFVADVFAGSDATLNSWGITVDGLNGPFYWKGQTSGSWSAVGSSTFNWAADTAGTIPILATPDATSDVVFSATGATNQANTTLDQDFTIHSLMVNDTAPVVISSGAGGPHTLTIAGDAGTGITVGNGSNLTINSNVTLGGASDTVEVDGTGLAKITGVLDGSNGVHKTGTGMLTLTGVNTYTGGTFIDAGVVQIDNDKALSTGTVTMADGTELDAIGNASLSQSLSITSGATATLAAVAGKTLTLGGFNIGANSKTIFGSSGNTGVVVVGPISVLSSISASATVEVANGTLRAGDGTLLTGITSNITSTTVDAGATLDLNDFNMTVKKLLGAGSVTTGTNAATVLTVNDGDFSGGISGAGSLVKDTNTTFILEGTNTYTGSTTIKGGGTLQIGTAASAGSLAAVSNVDVQTGNTLQLVNVAGNTFANNISNSVAGVGTVEVNSANYNILSGVLSDGAGQVALTQSGSGTTALTGNNTYSGTTTINAGVLQVGNGGASGTTGIGGGSIVNNAVLAYDRTNLFTESNVISGSGVLRQIGSGATALTAANTYSGDTNIYSGMLLANNTAGSATGTSSVFINSGAALGGNGTISGAVTLNSGFIVPGAVPTGVSAGTLKIGSLTWNSGGTLDTQLGTTSDLLSITGALTKGTLGTYGINISDAGGFGNTTHYVVATFGSNAGFAASDFTLSSSFGAGLKGTLTLTGTELDFDITSLIVGGPILQNSAPVGTPIFADFIVGGPVTTGNPTENNQVHTLTFTPGSSLLIHHTLYVVQGPVTLVNGSSIQLDGNLSTSLLNMLAGSYLHGNGSIIGNLVNGGLLSPGNSPGQIHVTGNYTQTSSGTLRIEIAGRDLPQHDLLSVGGTASLNGTLQILPIDGFKLKRNKPITFLTANEGVIGRFSLVENSFPSDTILKPTVVYHDTSVTLDPVQASFANLDGLTPNQRAVGRALDSAAHDRRMNGIFDYLDYRKLNELPRDFDKIAPEELTSMFTIGISLANVQSGNIQRRTDDIRSGAGGFNAAGLAINGAGPSYSGSFSGVAGPNGNDGKENKAVQQPVAPAEDRWGAFLSGTGEWVSVGNTDNARGYTIDSGGFTLGLDYKVTPNLAIGVAAGYTGTSSDLTDGGRVYVNGGKVGIYATYYEYQRVKAAPVDSSKEGLPQSYAEARGFYADAAVFGGYNSYHTHRAALQDDATGDTDGGELNVLFGGGYDFKKGNFTFGPTASFNYTYLGTNTFTEHGSLAPLDIHGGKGESLRTAFGIKASYDWKVGGVSIKPEIRAAWQHEFGDAAYSLDSSFANGAGDSFRVSGPQLGRDSALLGAGFAIQLNERWSTYFYYDGELGRRNYQSSSVTGGLRMTF

SEQ ID NO: 10475 - protein, 1247 aa, Bacteroides coprocola DSM 17136
MSKFLDRFRYFKQKGETFADGHGQLLNTNRDWEDGYRQRWQHDKIVRSTHGVNCTGSCSWKIYVKNGLVTWETQQTDYPRTRPDLPNHEPRGCPRGASYSWYLYSANRLKYPMMRKRLMKMWREAKALHSDPVEAWASIIEDADKAKSFKQARGRGGFVRSSWQEVNELIAASNVYTIKNYGPDRVAGFSPIPAMSMVSYASGARYLSLIGGTCLSFYDWYCDLPPASPQTWGEQTDVPESADWYNSSYIIAWGSNVPQTRTPDAHFFTEVRYKGTKTVAVTPDYAEIAKLCDLWLAPKQGTDAAMALAMGHVMLREFHLDNPSQYFTDYVRRYTDMPMLVMLEERDGYYAAGRMLRAADLVDALGQENNPEWKTVAFNTNGEMVAPNGSIGFRWGEKGKWNLEQRDGKTGEETELQLSLLGSQDEIAEVGFPYFGGDGTEHFNKVELENVLLHKLPVKRLQLADGSTALVTTVYDLTLANYGLERGLNDVNCATSYDDVKAYTPAWAEQITGVSRSQIIRIAREFADNADKTHGRSMIIVGAGLNHWYHLDMNYRGLINMLIFCGCVGQSGGGWAHYVGQEKLRPQTGWQPLAFALDWQRPARHMNSTSYFYNHSSQWRYETVTAEELLSPMADKSRYTGHLIDFNVRAERMGWLPSAPQLGTNPLTIAGEAEKAGMNPVDYTVKSLKEGSIRFAAEQPENGKNHPRNLFIWRSNLLGSSGKGHEFMLKYLLGTEHGIQGKDLGQQGGVKPEEVDWQDNGLEGKLDLVVTLDFRLSSTCLYSDIILPTATWYEKDDMNTSDMHPFIHPLSAAVDPAWEAKSDWEIYKAIAKKFSEVCVGHLGKETDIVTLPIQHDSAAELAQPLDVKDWKKGECDLIPGKTAPHIMVVERDYPATYERFTSIGPLMEKIGNGGKGIAWNTQSEMDLLRKLNYTKAEGPAKGQPMLNTAIDAAEMILTLAPETNGQVAVKAWAALSEFTGRDHTHLALNKEDEKIRFRDIQAQPRKIISSPTWSGLEDEHVSYNAGYTNVHELIPWRTLSGRQQLYQDHQWMRDFGESLLVYRPPIDTRSVKEVIGQKSNGNPEKALNFLTPHQKWGIHSTYSDNLLMLTLGRGGPVVWLSEADAKDLGIADNDWIEVFNSNGALTARAVVSQRVPAGMTMMYHAQERIVNLPGSEITQQRGGIHNSVTRITPKPTHMIGGYAHLAYGFNYYGTVGSNRDEFVVVRKMKNIDWLDGEGNDQVQESVK

SEQ ID NO: 10476 - protein, 762 aa, Bacteroides coprocola DSM 17136
MFLLLLPGLLLPAVAVAADAAEKVAPAESRTGSSEIGYTAAEGAPAPGHADETAKKDHPLDPIVVTATRTEKSIVDVPAATSVVTREDIESRNIQKVDEAMNLVPGLFDKRAKGLDTTGRVTLRGLPDQKRTLVLLDGQPLNNGYTGHVDWNSINPEDVQQIEVARGPFSSLYGGNAMGGVVNIITRMPEKREFTVKGGYGSDNYWSTYGSYGDKLFDRLRLLASFGYKSSDGYPSGLVVKKPSGSGGTPARGAVPTTDTYGNPAFIIGDTGDNSWWTQSGGLKLSYDVCEEAKVFFSYRNNQYGYGYDNPNSYLTNAMGDTIWSGPVNFRGNTLSFTEGSFLSGGGGILQNLYNGGLETRLFGDSVLKLSGGLIDMPTNWYVTPSSSTATRSGGPGTISETPTRAYHADAQLSIPVLEKHMLIVGTAFRHDEANNQEHALTDWTDTGSKADLTYEAKGADNIFSFYSQAEIALFRDVTLYAGLRGDYWETFDGMADQVGVAGYPQYYDSKGEFSVNPKGSVVYKPLDGTTFRASVGTAFRPPNVYELYRTWVTSYGTVYQGNPKLDPESSFSWDIGVEQKIGQSTVLKLTYFNNTIDDFIYFRTVTPTLLVQTNAGKAETDGFELEAETRPWECLKLFTSFTYTHSEMLDNPANPLTEGKQLPGVPRYMFSAGGEVKYRRLSFTAIGRYVSKQYSSDQNLDTVSGVYGSYDAYFVGEFAARYKLTDWATIDFAVNNIFDNNYYSYYKAPGRQFFGGVTARF

SEQ ID NO: 10477 - protein, 1108 aa, Bacteroides coprocola DSM 17136
MKKDILLLMLCLFCSIGAMAQTKTITGVVSDAAGEPIIGASVVEVGTTNGTITDIDGKFVLNMNPDGKIRVSYIGYQVQTIDLKGKTSFRIQMKEDSEMLEEVVVTGYGGKQLRTKVTNSISKVKEETLKQGLYSNPGQALSGAVAGLSVSQTSGNPGSTPTLVLRGGTNFDGSGSPLILIDGQVRSSLSDINPDDIESMEVLKDAGATAIYGARANDGVILVTTKRGKSGRAEVNLKAKFGLNYFKNSYEFLDAGDYIYWMRMGYKNAYMGDMKHPDGSVVKAWSSLSSLTSATPYGTGNAYFASDGVTPLDGNKTSSAIWSTMKYTDNLAFLLDQGWQTMIDPIYGDKLIYKNTDIADFNVQTPAFSQDYNLSVSGGNEKGNYYAGLGYNKSDGTAYGNWYKRITFTFNADYKLKEWLTSSSSFNFADATWNGLPATQTAEANYFSRCLSLPPTFRGYNADGEMLLGPNSGDGNQQYNFDKFVRDQNTDKFTMNQSFTVNFMKGLSLKLGAIWYYQEEKDESFNKDYLSSPGNKVTSRSTSAYYDRTLDQTYNAVLNYNYQINKDHYLDAMAGFEYYDSYNKGFNASGSGAPTDDFMDLQYTSKEEGKRSIDSWHSRQRIMSFFGRVNYDYQSKYLLSLVLRKDGYSKLAKENRWGVFPGVSTGWVFSKEKFMANTSDILSFGKLRASFGLNGNVNKNFVGNYTVQGSYGSNTYNGATGFLLGSIPNPYLMWEKSRTFEIGLDLGFLENRINANLTYYNRLTSDKYANITVPSTSGVGSVVSNNGKFQNQGFEFELAFRIIDRKDWKWNLNWNGALNKNKVVALPDNGLERNRQDAYQVYTGYGDAKMWVGGYQEGQRPGDLYMFIADGIYKSQDEIPAGLIDITSGNNGSTGRPLYGGAEGYNKLSDSQKENALPIQPGDVKWKDVNGDGVIDNYDMVKVGNTVPKWTGGFNTTVSWKDLTLSARFDYALGFKAVDWKSMWIMACAQGTYNTIQETKDTWTPDNPNAKYPTYVWADQLGKRNYCRSSSMFVYNGNYLALRELSLTYRLPSIWVQKAKLSNVELSVTGQNLGYLTEAKHLFSPEKADNNGGYPLPRTVIFGINVSF

SEQ ID NO: 10478 - protein, 465 aa, Bacteroides coprocola DSM 17136
MKHINMKISRIIFVVLVSVSLSHLYAQNTKLSSYDFGEGFNFTNPNGSTIKLQGYIQPFSETEIYEDSDLANETRFRMRRLRLRLSGQSANERFGYRLQVDLAGQDEAQREGDVSDLRNYLLDAYVSYKVARRVELIFGQRATYTDNRELFMNSNALQLPERSRLTSAFASIREFGLFAKGTFKTGRGTYLKPYVTITNGDGANVFNNDNGGLKYGARLDFLPFGLFTNFGQFRQADVVREQTPKLVFGVTANYNDGITSRRGRNSGRIVYLNDINANGALDDGEERLPDYSKVGIDFLFKYKGFSVIGEYHKSFASDIADDINLRNDIFGDDNTVLTDRFRGRVNPTSEDFRDFTPDEYVRRQMMLGEAYNIQGGYLFKNGFSLDARYTHINADEHSFLNNATFFNRTDYYTVGVSKYLNRSYGAKIQASYTWINAGEFGISDNQGDPLPGDERLLRLILTLAF

SEQ ID NO: 10479 - protein, 235 aa, Bacteroides coprocola DSM 17136
MMKKTMLTIGAAGLALGTSASFAQVQGNSSYATVPSTSSVSTTTNYAQPSYSGGAAKEYGAYLGLGYTFLDLETNDDIGDSTSAVTARFGYALNRELSLEVEGSFGVDSGSFDFEEDEEDFEIDDNDDGDLDDVLIADGDLGLDYLFAAFVRYGVPVSDALKVSGRVGYAFAEIDSTVELASTEIEFGGSEDGLAFGAGLEYTFTPSSTLLLDYTRYEFTDSNGDAVTAMYQYKF

SEQ ID NO: 10480 - protein, 999 aa, Bacteroides coprocola DSM 17136
MLAQNITVTGQVVDVTSEPIIGASVVVKGTANGTITNFDGKFTLSVQKGETLHISYIGYVAQDVKIMGNQPVKVVMSEDTETLDEVVVVGTAMKKSDLTGAVASVSSKVLEEKPVTNVNQALQGRVAGVFISQPTRPTDDASIKIRGINTINGSTDPIYVVDGMVMDNSFSGFNAVNLNDVASIEVLKDASATALYGSRGSNGVVVITTKKGKKGEGKVSYDGWIGFQTYANTPKTMNTRQLFELRKEAYTNGYMQTNPDGDVNAYINDVIMGSNTVFADYEFDAYNNNKNYDWLDAVSRTGVQHNHVVSLSNGNDKGSYYISFGYTDNKGVIEKSEQEKYTGRINADQQIKSWLKVGTNTTFTRTENTLVDDGVMNRARCANPMLEISDEIETLNWQGIFDQNNFNPLRSLKVDNDLVYNRLLSSNYININPIEGLNLRSTFSIDYAQKQQNKYTPNDIYESERYGTQGEAKDDRDTRTVWQWDNSLSYEASFGKHKLNAMVGTSATRTTYNYINATATGFGTNLFGYHSLGSGYKKDQRGLSTAWSEQTLLSYIARVNYNYAGKYLLTATARYDGSSKFAKGNQWGIFPSVSAAWNITEEKFMKNQTIFDQLKLRAGFGIVGNQNIDDFAYLSLYNVSYTGTSDTGYTNSFVSNGRRGTPDISWEKQKQWNLGVDMAFLQNRVRLSVDAFLIKNKDLLMSHSLPTTTGFSSTIENIGAIENKGLEFALNANLVRAKDFEWNFAATLSMDKNKVTQLYGDNDVVYNVDSDRNIQKEGNLFLGESRNTIYIWKTGGIAQEIDMDRLNKINWNGYNVNPGDLYPLDYDNNGQIDQNDRVVIGSTDPKFYGGFSTDFSWKGLSLNAVFSYSYGAKKLSPWYETLIGSTGSGVASTDLLDRWTPENTDAEFPRVLAGFDYNHYGASSMDFSVQKASFLRLSALTLAYTFPTKVINALKLANLRVYATGSNLFCLTNYNGYDPETGDWYPPTRMYTFGLNLAF

SEQ ID NO: 10481 - protein, 636 aa, Bacteroides coprocola DSM 17136
MKKERFVLAFFTGCLISAVSLQAQTSKDSTKVARSYAINEVVVTGTRSETDVRHLPMTVSVVGRPQLEASQQTSVLPVLNSQVPGFFSTSRGVMGYGVATGASGQMSLRGIGGPAQAALPTTGLLVLIDGHPQYMGLMGHPIADAYQTMMAERVEVLRGPASVLYGSNAMGGVINIVTRKMQEDGIRTNINIGAGAYGSVQTEATNRIRKGRFSSTVTASYNRTDGHRADMAFEQYGGYAKLGYDFTDNWKVWGDVNVTRFNATNPGSVMKPYIDNDQRITRGMTSFALENHYEKTSGALSFFYNWGDHWINDGYQPGGEPLQYRFNSNDQMLGVSWYQSIQLFQGNRLTVGADYFHFGGEAWNQFFDGHRETSADKSLNEVAGYVDFRQDIAAWLTLDAGARVDYHSQTGTEFIPQVGLAFHLPENAEIKAMASKGFRNPTIREMYMFPPQNPDLKPEKLWNYELSFSQRLMDNRLSYGLNVFYINGENLIIRLPNPNGSGMLNQNSGEIENWGAEANVGYQFNPVWSVMANYSWLHMENPVLASPEHKLYGGVNFRKGRWSASTGIQYVKGLYTDLDAATKENFVLWDMQGSFKATNYLSFYVRGENLLAQRYEINAGYPMPKATFMGGVNINF

SEQ ID NO: 10482 - protein, 428 aa, Bacteroides coprocola DSM 17136
MAKTSKFTQTLLASALAVVAGSASAAAFQLAEVSTSGLGRAYAGEAAIADNAAVVATNPALMSLLKQPEISVGAIYVDPNINLTSPMPGFAYKNIAPNALVPTVYGVYPINEKFAVGGGLNVNYGLATEFDDKYAGGFLGGKTDLTAINFNLSGAYRVTEKFSVGLGLNAVHAKAKLERYAGVALKLKVPNVAQLAALPANTVISKLQGDKWGFGWNAGLVYEFNERNRIGIAYHSQVDINFKGQYSNHFPLAAAALLQTKGITATGGKEIPGTLHLPLPAYWEISGYHKMTDRFAMHYSYKYTQWSKFKELRAKGTDGKTLFSKTEEFRDSSRIALGASYDVTDALTVRTGIAYDESAADEHNTISIPDTDRTWFSVGATYRFTPNVSIDAGFAHLKGKKNTFKEEGVPFTSKASANLYGLNVNYRF

SEQ ID NO: 10483 - protein, 480 aa, Bacteroides coprocola DSM 17136
MLLAWGLPALAGVTLGGVARADDAAPAPLTVAQATPSAGAGAGASVAQATTPNAIVNAEATQAVTPPDEPSAQSKSNGFIADSHLNFLFRNYSDVLDSKGGPHRHAWVQGVMANFESGYTTGLIGFGVDASVYAALKLDGGAGAGSMVHIAKGGGGGNQLAWAYPGIYDVKARISNTVIKYGLQAVDNPFMEQHDNRALPPTFLGATIVSNEFKNVMLEAGSFTKNDARGHTTLTNLTTQYGGTRVNRLTYVGGTWDYSPNGEVALYANQADDVWHQYYASVKHSIGSADTIKWTGFGNVYSTHDTGDALQGKIDNNAYSLSLAAQHGPHELLLGYQQILGDQFFDYLNETNGIFLTNSMDVDYNAPHEKSLQLRYTFYGKEAGLPGFKAMIWGVTGWGADGSAGAANDPSKSSIYWSNGAPVQGRHHEFGFIPSYTFQSGKLKDTKVTFIAMWHNGSAHYSDATNREYRLVVNLPLHAF

SEQ ID NO: 10484 - protein, 691 aa, Bacteroides coprocola DSM 17136
MKTRATLLLLLSFYSLCSQDQPRDSVIGLNEVILQVERTAASPLGLVPSEIVTSRAIRQQNPVDFAGTLNQVPGLYFLSGALNTNRITIRGVGARTPFGTDKLRMYFNEIPVTNGTGVSALEAFDLENLSSIRVVKGPKSAAYGGALGGAILLQSDPAGQPGTHLRSRTSAGSYGLFKTNLALTHADSTLRAEVRYNRLTTQGYRENNAFERDGLLLNLGFDAGERHRLNLLANYIDYTAEIPSSLNRSDYETNPTRAAFTWAQAKGYEANKYTLLGLSDRIGLGSGTSLTTSVFFSYLDHYEPRPFNILDEFTFGFGLRSVLETGFRLGGGPVRARIGGELYRDEYSWGTYENRYEENNGQGSLQGEQLSDNKEFRRQDFLFGSLDWQATGALGIRVGLGLNDTRYDFRDLSGEGPDNRSAARDFDPVLLPSLDLRYSWREAFFTYLNVSRGFSNPSLEESLSPEGRINPDIGQEKGWNYEAGVHWASRDTRMQLTAAAYTMDIRDLLVAQRVGQDQYIGRNAGSTRHNGLEVSWEYRVRPGAGYSVTPFLSYTLNAHNFRDFTDQDEDYSGNRLTGVPRNRVYAGVRLAGDAGWYVNGSYQYVDPIPLTDSNSLFSDPYGLVNLQTGYTLPLGRQIRAGLEFGVNNLTNTRYASSVLINATGFGGSDPRYYYPGNDRNYYMGILLAASL

SEQ ID NO: 10485 - protein, 411 aa, Bacteroides coprocola DSM 17136
MRTFDVTKAAVVATTAFAAAAPAFAQSSVTLYGIVDDSIVYQSSQTSLGSTNGGRSNVKMASGIWAGSRFGLKGAEDLGGGTKAIFQLESGFNLNNGAQQYANAMFGRQAWIGLTNETFGTLTLGRQYTSYYTLMAPYSPTNWLTGYFGAHPGDVDALDTIYRANNSIVYTSPKLYGVTVSGSYSLAGVPDSVYRGSTWSAAIQYQQGPIGGTVAFSRINNSTVGGGVYGADSTMNTAGQSGVSAVTNGYQGAQAQNRFAVGLGYVFNSAWDLSATYTNVQYIPGVLSKFTDEQVFNTAGTVLHWKPVTAWDFAAGYSYTWASKANGVDDAASYHQFSLSQYYALSKRTGFYALEAFQRANGRTLGTPTFTTAGATNRQIDATASIGDGFQSAPSSSRSMFAAGVGIVHRF

SEQ ID NO: 10486 - protein, 713 aa, Bacteroides coprocola DSM 17136
MNKGRQGIAPTRHAPLCLGLLLALSPLAMAVADARKDGETELPDMVISGEGTSASQPPGVTTLGKMPLKPREIPQSASVIDRERLEQQNLFSLDEAMQQATGVTVQPFQLLTTAYYVRGFKVDSFELDGVPALLGNTASSPQDMAIYERVEILRGSNGLLHGTGNPAATVNLVRKRPQREFAASTTLSAGRWDRYRAEVDVGGPLNASGNVRGRAVAAYEDRDYFYDVADQGTRLLYGVTEFDLSPDTLLTVGAQYQHIDSITNMAGVPMAKDGSSLGLSRDTYLDVDWDRFKWDTYRAFGSLEQQLGGGWKGKVSAEYQEADSRLRYAGSFGAIDPQTGDGGRLMGAAYKFKSIQRSLDANLNGPLQLFGLTHELLGGITYAQGETRQDTAQLLNLADTPVNVYRWDPHSVPRPQIGAYRSPGTTTTTQKGIYALGRIKLAEPLTLVLGGRESWWDQDTPATRFKPGRQFTPYGGLIWDFARDWSWYASYAEVYQPQDRQTWNSEPLRPVEGKTYETGIKGELADGRLNLSLAAFRIDLENNPQEDPDHPGPPNNPYYISGGKVRSQGFELEGTGYLTPYWSLSAGYTYTSTEYLKDSQVDSGTRYSTFTPRHLLRLWSNYDLPWQDRRWSVGGGVQAQSDYSVDYRGVDMRQGGYALVNLRLGYRVDEHWTAAVNVNNLFDRTYYQSLSNPNWNNRYGEPRSFNVSLRGTF

SEQ ID NO: 10487 - protein, 1080 aa, Bacteroides coprocola DSM 17136
MRSVQKNLYLLIILLISFPLNVLAQNKTITGTVRDVNDVVIGASVTIKGQSSVGTITDMDGNYTLSVPASAKELTFSYIGYETQTVAIKGRTQINVTLKESSQMLEEVVAIGYAKVKRKDLTGSSVSVGANDLKMSPVSTAAQALAGKAAGVNIVQQSGAPGSEINITVRGGTSITQGTQPLYIVDGFQMENGLQNVDINDIESIDVMKDASATAIYGARGSNGVILITTKSGKSGKTEVSYNGFVSFDHLGKKLDLLGVEDYVKYQYEFQLLRSNQSSFANLFGGNINDADFYTGAYSRIHDNYGSREGIDWQDEVFGSTGITQNHNVNITGGTEKTKYMISYNYTDENGIMAKHGYQKNSIRAKVNHELWKGVRFDFSSSLQMTKVEGGGSLGGKLKQTILQPVTGGVQFTNEQMLSQDLSEAYSDMPGADNYDINNPLLDNEAIDQEKYTRFATVNAGIEIDIIKNLTWRTAASYMWQQVREDYWDNGSTRQADANQSPYGYGYRNNDEKYSWQVTNTLNYAFDLDDHAHDFNILLGQETWYTESMNLDNEYRKFTDGNFGLNDVSMGEPYTWKSGKSREGLVSVFGRLSYNFKERYLFTGTLRADGSSKFAKGNQWGIFPSASAAWRISEEAFLEDVDFLDNLKLRVGYGTAGNNNIDNNMYATSYGSGHYGINGSDYITYVPGSTLGNSNLKWEKTTTTNVGLDISVLGSRVNLSVDFYNNESSNLLIKNKIPTSTGYSDQYQNIGAIRNRGVELVLNTTNIRTKDFTWNTDFNIAFNRSKVLELYGNKETNYFIQDYESRMGYKIEVGKPLGQFYGLVYDGIYTTDDFVQQPDGTYMLKDGVPSLKGFDRSQVKPGDAKYVPQTGEVDENGNPVWSTNDRTVIGSAAPKFTGGMNNTFRYKGFDLSVFMNFSFGNDVFNMSTQRFIGPYLSNQNSLAIMNNRFTLIDPATGKEATDLVRLAELNPGQYGDDIMWNISQNNKTAISDHSSYYIEDGSYLRFSTITLGYTFPKAWIQNLKLNNARVYCTLNNIATITGYSGYDPEVSAEGGALTPGIDNSSYPRSKSWVVGVNLTF

SEQ ID NO: 10488 - protein, 734 aa, Bacteroides coprocola DSM 17136
MKIKHLWILSPCFASFIAPATFAAENKQDEMTVSATRSYRSVSEMAQTTWVIDNVEIEQQAEGGKELKDILSQLIPGMSVSGQGRTNYGMNMRGRSMIVMVDGVRLNSSRSDSRQLDSIDPFNINHIEVISGATSLYGGGSSGGLINIVTKKGQEEKQVDLQIGGKTGFSNGKDHDENVAAAMSGGNENAHGRLSVAYQRYGGWYDGKGKAINIDNTQTGLQFSDRLDVMGAGVINIDDNQQLQATVQYYKSESDGKHGLYLGKDFAAVKGQGEAHNSGKLNSDRLPGTERHMLNLQYSNGDLWGQDFVAQVYYRDESQKFYPFPALNKAKDVTSISASDQKTNFYGTKLTFNSEPVDNLTLTYGADAEHEQFRANQMFFNLDKAKESGGMDLKKAYQVGRYPSYTTTNMAAFLQSSYDINPIFTLSGGVRYQYTENKVDDFVGYAQQQQIAEGKIKSADAVPGGNTDYNNLLFNAGLLINLTEDQQTWFNFSQGFEIPDIAKYYGTGKYAAAPDANGHLALENSININDTKVKGIKVDSYELGWRYTGENLRTQIAAYYSLSDRSYDINNTDMTIYMKSDKRRIYGVEGAIDYFFDNSDWSVGSNFNLQKSETKVDGKWEKWSVKFASPSKVTAYVGWEPNDWSLRLQSQQTFNVSDADGNKLDGYNTVDFLSSYLLPVGKVSFAVENLLDEDYTTIWGQRAPKLYSPSYGAADLYTYKGRGRTFALNYSVTF

SEQ ID NO: 10489 - protein, 691 aa, Bacteroides coprocola DSM 17136
MKKSLLLSLSLIASLSRAEDDGFYTSVGYQIGEAVQQVKNTGALQNLADRYDNLNNLLNQYNYLNSLVNLASTPSAITGAIDNLSSSAINLTSATTTSPAYQAVALALNAAVGMWQVIALFIGCGPGPTNNQSYQSFGNTPALNGTTTTCNQAYGTGPNGILSIDEYQKLNQAYQIIQTALNQNQGGGMPALNDTTKTGVVNIQQTNYRTTTQNNIIEHYYTENGKEIPVSYSGGSSFSPTIQLTYHNNAENLLQQAATIMQVLITQKPHVQTSNGGKAWGLSSTPGNVMDIFGPSFNAINEMIKNAQTALAKTQQLNANENAQITQPNNFNPYTSKDKGFAQEMLNRAEAQAEILNLAKQVANNFHSIQGPIQGDLEECKAGSAGVITNNTWGSGCAFVKETLNSLEQHTAYYGNQVNQDRALAQTILNFKEALNTLNKDSKAINSGISNLPNAKSLQNMTHATQNPNSPEGLLTYSLDSSKYNQLQTIAQELGKNPFRRFGVIDFQNNNGAMNGIGVQVGYKQFFGKKRNWGLRYYGFFDYNHAYIKSNFFNSASDVWTYGVGMDALYNFINDKNTNFLGKNNKLSVGLFGGFALAGTSWLNSQQVNLTMMNGIYNANVSTSNFQFLFDLGLRMNLARPKKKDSDHAAQHGIELGFKIPTINTNYYSFMGAKLEYRRMYSLFLNYVFAY

SEQ ID NO: 10490 - protein, 247 aa, Bacteroides coprocola DSM 17136
MKKFLLGTVGVVALGLAAPAVAADLPARTYTKAPAYVAAVYDWSGFYIGANAGWGNSRDSRFDETFGLDLGAHDADGAVAGGQIGYRWQTGTWVFGLEAQGDWADLSGNHLNPLVFDNRLSSKTDAFGLFTGQIGYAWNNALLYVKGGAAVTDRKYDFTVDSTGAPISSTGYKTRWSGTVGVGLEYGFAPNWSFGVEYDHIFESRYTVAFTTPGGLPAADSFRTGGDTDLVTARINYRWGGPLIPRF

SEQ ID NO: 10491 - protein, 1072 aa, Bacteroides coprocola DSM 17136
MVMKTNRSTLSPCFRKTMIASLLVPLCSPLYSWAVQTASITDGSTMVISGGYDTEANNHSAVFVQGSGSTINGGSDVVIETTGVGAIGAYASEGGSLGLTGSTINTENGVAFGVLNDKGTVNLQGGTITTKGQTAYGVYSSGLGSNTDIHSSAITTSYSLTHAIYGAGGTGLTLNNTTLNTSGSGSYGIYLDGSGGSLTGANNTINSTHATKGAGIYISAGGSNATLDNTTLNITKGAVGVNVGEGSSITMDGLIATGNITNLFKVNGNASVSNANIELAAGGVLMAQGSSASNQAVIILNNVNVISNSGSTTLVDVNKDADVTINGGAYHSKGNNAKGIWVRDNNSSLNVDNAVIITEGVNATAIENRGTAIVKNTTVITKGNNSHGLYSEQSLDATNMAISTAGIGSIGVAAAKGGNLNLNDAFIETTGNSGMVLGTFADSSISAKNITGISTGAGAYALWVDDGSSILLEESQITTQGQGAGGIYASNTGTGSHTAYTQVTLNNSQIHSEQGPGIWANGADINVDVKNGSQLTGGNGLLVYASSNAGAASNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYKIDDYRWNLQSNLINPGPGPEPEIEPEEIAYRPEVPGYIAAPWLNAFYGFTTLGSLHERRGSAEGAAEGFNQDSWGRIRGQHNNFDAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDSISEIGGTDYSVGQVRGGLRLFSDASEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 10492 - protein, 794 aa, Bacteroides coprocola DSM 17136
MNAPLSALATAVVAALLASPALAQTAAPATAPANTLDTVIVTGTRVSDRTVAESQSPIDIISAESLQATGTPELATALARALPSLNFPRPALSDGTSAIRPAQLRGLSPDQVLVLVNGKRRHTSSLLNLNGTIGRGAAAVDLNTIPVAAIARVEVLRDGASAQYGSDAIAGVVNIVLKGAEKGGSLQAGFGQYSAGDGNNYELSGDTGVAYGGDRGWLHVAAQLNQQDPTDRARAYAGAPSVSQPAVGQKAFKIGDPEVNAQAVSANTEFAFSDSITGYAFATASNRDITSFAFFRAPGSSQNILSVYPQGFLPEIQTYAKDRSLVAGVRGSTASGWDWDASYNYGYNRIDFHTRNTLNVSLGPTSPTAFYDGALETTQNIVNLDVKRGFDWGLAYPVTVAFGAEYRNEKWNQSPGEVGSYFQAGTLAGGAQGFGGFAPSVSGRYSRDSYALYADIEADFTDKFSAGLAGRYEDYSDFGSQASGKFSARYAFTDRIALRGTVSSGFRAPSLAQQYFQSTSTTFLAGNPNPFEIRTFPADSTVARALGAEPLDAETSLSYSLGLVLQPTDALYLTVDAYQIDVDDRIVLSSNLTGAGVRSLLESQGIFGINGGRYFTNAVDTRTRGVDVVGSYRWQLAASSVDLTAGYNYSETEVRSVAANPAALSANGLSLERIDRTERGRIEAGFPRDKFLINGSWNSEHWTLALGATRYGKYSTRPADASNDQTFGAKWVVDASASYKIDRWTLTLGADNVLDQYPDENNFANSTSGQFPYSNLSPFGFNGAYVYGRINYRW

SEQ ID NO: 10493 - protein, 1040 aa, Bacteroides coprocola DSM 17136
MKSDKRALFFTLLFTMVCMVLQAQSLQVEGTVISKSDGEPIIGATVLEKGTTNGTITDFDGKFSLSVKQGAEITISYVGFKSQTLKVKGVLKVILEEDSEMLQEVVVTGYTTQRKADLTGSVAVVSTESLKTTSDTDPMRALQGKVAGMTITGNGSPSGTATVRIRGIGSFNSSQDPLYVIDGVPTNMSLNSLNTNDIESMQVLKDAASASIYGSRASNGVIIITTKKGKKADKVKVDFSANLTAQFYTSQSLMDVCNSSEYATAMAQAALNDGLDPVSYASNYGLNLNAASGTPITVWNPSTSQYVNYTVNGLYDGYINSKKTMRYSDTDWMDEISRVGFSQNYDLSLSHANDKHSTMFSLGYKKNNGILKYTDFENISARMNSSYNVNKYITVGENFTVTYTSQVDCAPMENALKMAPIVPVYEEDGTTFSGPVGGMSDRQNPLREQYQNKDNALNYWRLFGNGYVDIKPFKGFVFRSNFGLDFYNSFINAMTHTYHSDIVNNDIAKTTLSNKNEVNWTWSNTINYNFNVASKHDINVLLGAELSKQSSIDFSAYSEGYALEDVDYMWPNAATGVMKNTGAKVGYRLASFFGKVDYNYDDFILASFTIRRDGSSRFGKGNRWGTFPAATLGLRLSKLLKANWMDDWKVRLSWGQTGNQAIDNNAQFGLYVVDYGLDRVTSTAYDLYLQGSGTFPSGYRATQLANPDLKWESATQYNIGTDFAFLNNSLYGTIDGYIKDVDDMLINPAYLGAIGEGGASWLNGPSLRNWGMEFSLGYRKSLACGLGLDINANVDFFRNKVTYLPATTTGSYAHTSKENLVESGMPYGSSVGYVVEGIFQNQAEVDASGQANARVGGLKYADLDGNGIITSDDQDWIYNPVPAFSYGLNIALNYKNFDLSMFWQGVYDQDVYNNQKAQTDFWSITDAGSNKGSRLLGAWNTNNTGSTIPALTTNNTADEGRASSYYVENGSYLKLRNLQVGYTVPTSFLSKFKMTSARIYLSGQNLLTIKSKSLTCPDPENPNWNYPLVTSVSFGLQIGF

SEQ ID NO: 10494 - protein, 928 aa, Bacteroides coprocola DSM 17136
MKSSLHWFLISSSLALPLSLNFSAFAAVVEINLGPTNSFSGPGTYTPPAQTTNADGTIYNLTGDVSITNAGSPTALTASCFKETTGNLSFQGHGYQFLLQNIDAGANCTFTNTAANKLLSFSGFSYLSLIQTTNATTGTGAIKSTGACSIQSNYSCYFGQNFSNDNGGALQGSSISLSLNPNLTFAKNKATQKGGALYSTGGITINNTLNSASFSENTAANNGGAIYTEASSFISSNKAISFINNSVTATSATGGAIYCSSTSAPKPVLTLSDNGELNFIGNTAITSGGAIYTDNLVLSSGGPTLFKNNSAIDTAAPLGGAIAIADSGSLSLSALGGDITFEGNTVVKGASSSQTTTRNSINIGNTNAKIVQLRASQGNTIYFYDPITTSITAALSDALNLNGPDLAGNPAYQGTIVFSGEKLSEAEAAEADNLKSTIQQPLTLAGGQLSLKSGVTLVAKSFSQSPGSTLLMDAGTTLETADGITINNLVLNVDSLKETKKATLKATQASQTVTLSGSLSLVDPSGNVYEDVSWNNPQVFSCLTLTADDPANIHITDLAADPLEKNPIHWGYQGNWALSWQEDTATKSKAATLTWTKTGYNPNPERRGTLVANTLWGSFVDVRSIQQLVATKVRQSQETRGIWCEGISNFFHKDSTKINKGFRHISAGYVVGATTTLASDNLITAAFCQLFGKDRDHFINKNRASAYAASLHLQHLATLSSPSLLRYLPGSESEQPVLFDAQISYIYSKNTMKTYYTQAPKGESSWYNDGCALELASSLPHTALSHEGLFHAYFPFIKVEASYIHQDSFKERNTTLVRSFDSGDLINVSVPIGITFERFSRNERASYEATVIYVADVYRKNPDCTTALLINNTSWKTTGTNLSRQAGIGRAGIFYAFSPNLEVTSNLSMEIRGSSRSYNADLGGKFQF

SEQ ID NO: 10495 - protein, 557 aa, Bacteroides coprocola DSM 17136
MKKAICILASAFLLSGGAVFAQGEMDAYKFSQYDLSGTARYLGMGGAFGALGGDISAMGGNPAGLGIYRSSEIVTTLSLSSMKTNTEWSGTKMDENRTKFNFDNIAYVGYFPTGNDEGLIGWNVGFAYNRVKNFNRRYRMGRGPGGFSLSDYIATLTNRAGVTGNDLLISDSHDPYMNQDWLSVMGYDTYIIGSANPSQKGGFHSSFGTGVDGTWQNWEVQQADMYVNESGAVDKYDFSLATNISNAVFIGATVSVTDLNYHLSSVYDENFGFANNNAANSDNLFLDNYSSVDGTGCSFNLGVIARPSDFLRLGVAYNSPTWYKMKNYYRAEAGAYIEGFFANDPKAETPNLNSFTSTPDGAFTEYRLRTSDRWIFSAAAIIGQTALISVDYELTRYKAMHLSGWAGEVEGWQGTVDNDYIKEDFGLGGLLKMGTEVKITPQFAIRAGGAWQHSPAKSTLLYDEKGDGVMALNEISTTGTNTAYTVDRNVGYITVGLGYRFTPNFYADLACVYRMQKEDVYPFSNIYDGDGNVLVESIPATLKTNTTKVALTLGYKF

SEQ ID NO: 10496 - protein, 1195 aa, Bacteroides coprocola DSM 17136
MRTTVIRVLAVLALLFVFTSLVFGQAETGQVTGTVTDPSGAIVAGAKVTITDVNTGAQRTGTTNSSGSYTFTNLKPSTYDVVVEGSGFAKFTRRVDVTVGSKNEVSAQMSVTGGGTTVEVTAEGGAAQVNTESQTLSTVVTSKQVTELPTLTRNPYDLVATSGNVNDDPSARGAGLSINGQRSASTDILLDGGENVDLFTATVGQSVPLDSVQEFRVITSDFSAEYGRASGGVVNVATKSGTNAFHGTAYEFNRVSALAANTYINDSTRYDAFNGVPIDGLDPTCVVGQPCDAGKKGGFTRNQFGYSIGGPVVKNKLFFFSSTEWTRVRSSATQNAAVIDPSLIGSGYLAPNVVDFLNSASLRSSATTVGHVTCDQTITPTKPLGQCPTAIPGSQDLYQLVSFTLPNDSGGGAPQNTYSTVNRVDWNISDKTTLYGRYALYSEADAAGTNSWSPYDGFDTGTNVFNNNLNINLTHVFTPNFVSQSKIIYNRLNNQQPLGAAPIAPTLYSQANTVPRINGAELLYPGYLPFSPGNAIPFGGPQNLYQLYQDFSWTKGKHQFRFGGDYIQTRDNRVFGAYETAVSILSNGNADRAINNLFSAASGGGDGTLDLFEVGVNPQGAYPCPRYLTPKPAYCQYTTPVGPPSFSRNNGYNDGAWYVQDSWKIHPRVTLNLGLRWEYYGVQHNSDPNLESNFYEGPGSSLPAQIYSGQVMIGKDSPSNGLWDKDTNNYAPRIGFAWDVFGDGKTSIRGGYGISYERNFGNVTYNVIQNPPNYAVVTAGGIPLTTGNYDSINGGLPDGTLIGLSQPSLRLVSPHIKTAYSEFWSLSLEREVLKNSILAFEYSGSHGVHLYDIGNVNKAGFGNYYDPADMQAYATGVLGLADASDMPCYPLCKLNQQYGNANNRGDQGFSHYNSLNTRFTSNNLFNLGLQLNFNWTWSHAIDNLSNTFSEGSNSFQLGYTDYFHPNLDTGSAEFNATHRLAISGVWDMPFGKKSSNGFVRAALGGWSVSPIITYRTGQPYTIWDCWNGIYNCSHFIPAGAQGRDGGYGTAHAAGVFDYMSINPVWATADGSAPHDDGTNPAFPGTPGRGGSVELPLAPCQGAVGCQMYTGPRDNYIGPGNHQFNMVVGKQFKLTERFSLQFRGEMYNVFNNHNLYILTGNNDVSTGLPNVQASKGGYGNSTDERRNVQFGLKLIF

SEQ ID NO: 10497 - protein, 526 aa, Bacteroides coprocola DSM 17136
MMGVNNQYLATYARTFADKHNADLLVGYEQYRYKNQVLYGENTNLYNPYIGELNNAGGIDKKNAKSYTDNYMTEGILSRLQYNYDGKYFLSASYRRDASSRFHKDHRWGNFGSVGGAWLINHEKFMENVKWVNMLKLKASWGVQGNDRLLITVNGVQRDNWYAYQDQYDVNYANGQYSLILKYKGTKDLTWETSYAFNIGTDFELFNNRLNGTIEYFSRKTVDLLYNKPIPVSSGISTGYEPTNVGDIMNKGVELDLNGIILRGKDYEWAMNFNLTHYTNKITALDPDLEKNGGQKGSYYIYRVGGSLYQSYLKTYAGVDPDTGKALYYVDPDNGDYTKTSNYEEAQQADQGTTLPKVYGGLGTSVRFYGFDFSLQLSYQLGGKYYDGAYQAYMHNGNSGMQGTNWSTDIRKAWTPDNRYTDVPRLSASDASYQQDSSRFLVSSDYLSLNNITLGYTIPKRLTSKLGLSHCRVYLTADNVALLSARKGLDPRLGLGLGSSTAESGANTTSSYSAMRTITGGISLTF

SEQ ID NO: 10498 - protein, 851 aa, Bacteroides coprocola DSM 17136
MLRKSRLSAAVAFALASAAVVATPVLAEEGQNVEKLQKIKVTGSRISRVDVEGATPVVAISKAKIEQSGQQTVADYLKQASYNSFGSISPSSGSSAQSQATVSLRGLGSERTLVLLNGKRVAGSPSMGGSSINLNSIPMAAVERVEVNLDGGSALYGSDAIGGVINVILKQDYEGLEFQGRIGSPTEEGGDEKSGSIVSGITGEKGALMMVYEHDVKDEIYYKDRDYMAREGASAPSLYGRNIKGIDAATGKTVTRTLEGIDCANTGPGFVPVGSACRFDFAQVAAKTASRTRDTVYVNGRYHINDSVDFVPQLIGSRVTSFGRFAPAAGPFSIDGTTPGGAQLLADNGFIGEKATVYYRFSNVGPRDNDVTDLTGSMNLGFEGTLPTEAVGDVEWNAGYMYSKTDNKSRGTGYVLNPAVQQEVDSGNFKNGEFSSDATNSLSYDTSRTSKMDFFQWYGGLGWSMGELPAGPIGWYLGAEYNDWVYSDTYDSQSAAGNVIGSSGNSGGGVRDVFAAYIESLIPITEQIELNLAGRFDKYSDFGSAFSPKASLRYQPLDNLLLRTSWSQSFRAPGLEDLYAADADSADFAKDYVSCQANGVANCPEEQYTTVRQSNKNLKEETADTFGIGAAYSPIDDLNLSLDYYYIKIDDVIQLATTQTQFYQELNTGSNPNVIRDANGDVEQVYAGMVNLGQLKTSGLDFKADYKYDFDVVTVRYDFGSTYILKYEEGLFAGGPMVDKKGWNAKPELRFNSGVGVNVPQWWNMDAYLSANYIDSQSQDYVDGQTEGHIASQTTWNLNVGVDTPWNGKLQAGVKNMFNVGPSLSSDGFTYDEDLYSIDGRIVYLDYTQKF

SEQ ID NO: 10499 - protein, 211 aa, Bacteroides coprocola DSM 17136
MKAISRVLIAMVAAIAALFTSTGTSHAGLDNELSLVDGQDRTLTVQQWDTFLNGVFPLDRNRLTREWFHSGRAKYIVAGPGADEFEGTLELGYQIGFPWSLGVGINFSYTTPNILIDDGDITAPPFGLNSVITPNLFPGVSISADLGNGPGIQEVATFSVDVSGAEGGVAVSNAHGTVTGAAGGVLLRPFARLIASTGDSVTTYGEPWNMN

SEQ ID NO: 10500 - protein, 1048 aa, Bacteroides coprocola DSM 17136
MIKNFYARSASIAVIAALAPVAAVYAQVTTSNARGAVTTAEGQPVAGAVVSIVHEPTGTVTSATTNANGQYTTQNLRVGGPFSFTVTAEGLPTSRVENIFTGLGDVSVIDITMAAADDTARLDTVVVTGSAQIAQVATGPSASYNLETLQNAPVISRDLKDVLRFDPRVYIDDGFNDAIQCAGANPRYNSLTVDGARLSDSFGLNSNGYPTESIPFSFDAIQQVSVELAPFDVEYGQFTACNINAVTKSGTNEIHGGLFYDYTSNDLRGDSVEGNEVSSQDFEDKRYGFNVGLPILKDRLFFFGAYEKNEAVNLFDNGPARASVDPALYQQVIDVAVNQYGYVAGGLPTSIPVEDEKIFAKLDWNITNNHRAALAYMKNEAFNFNPSDSGSDEIADGNHFYQRGGLLESYSASLNSDWTSNFNTELRVTRVEFDAVQDPVAGFDGFGEVQINVPRTVGSDETTIYLGADDSRHANDLIYTSDVYKAKANWQVGDHLLTFGAEREELDVFNLFIQEVKGEWVFDSLQDFIDGNFSDFRYENAAGSNNQDDGAASFGYEINTAYVQDTWQVSPNFNVTAGLRYDYYTSGDAPALNQSFLTNYGFRNDATMDGRDLLQPRIGFKYDFSDAIRFHGGFGLYSGGNPNVWISNNYSNNGVTLFEDRIRGGNINDYTYAGGAGSPFINVPDESIDAVANANGRGPVNALDPDFEIPSDWKFALGTVIDFGADDAWYGNDWRLMADFLYSKVNEAAYIQPISWEQEDVAADGRPIYSGNTNDFMLTNTEEKGFSRVLSLGLSKSYDNGIDWGLGYAYTDAEDVNPMTSSVAFSNFTNFATFDPVNPKTGVSDYVIPHRFTFNLNARREFIQNYASKFSLFGTVNQGSPYSYTIGSNTAFDPIFGNRRQLAYIPTGLDDANISPLSDAAALASLVNFVGSSDDLQKYRGGIIDRNTENDPWRSRFDVRFAQELPGLRAADRTEAFVVIRNVGNLINDDWGVMKEHGFPGNASLYTLDGLDDQNRLIISGFNEEVDEASTLNNASLWQIRLGVKYTF

SEQ ID NO: 10501 - protein, 854 aa, Bacteroides coprocola DSM 17136
MSKAYSAIEVSGHEITLILLCSVSIVQPQHVLAAPEQHPTLDQPQAHPATTVTDWLTQIEGDLVKVTNVQIETTETGLSVQLNTSAGQLATPQIQSIGNRLIAVIDNAILEDPQGFQSIDPASDITELTVIQATPTQIRVLVTGVELAPIAQVTVGTEGLALVVTPITDDAETEITVTAERSQTGYFIPKATTGTRTDTAIRNVPQSIQVLPKEVLKDQQVTRLDEALRNVSGITGDTTEGAGFQFSLRGFSAAKVLRNGFSLSGSDALSNTGLLTLPETANLEQIEVLKGPSSILYGEINPGGVINLVTKTPTSQPLYEAEVQVGSRTFFRPRIDFSDTLTQDGQLRYRLNALIQRDEGFRDYDQNIQREFVAPVLSWDIGEETNLTLDFEYLHDQRPNDSGLLAFGRGVVDVPRERIVGEPDDVIDRDFITTGYTFKHQFNENWSVRSAFRYSKQDYLSNFFLPLNFNEATGLVARINGSTDWFQDYLGLQTEVTGKFKTGPIQHTLLFGVDLSQDRSGIDARVNFAPSLLDIFNPVYGTPTRLSFNDFATVARAQDVTTRRLGILLQDQIKVLDNLQFVVGGRYDTVDQQVTNSPSLFDPAGRQGEQTVDAFTPRVGVVYQLIPELSLYSSFAQSFTPSASTTAAGDFLIPETGEGFEVGFKAEVVPDKLFATLAYFNITKQNVATPDPNALGVFNAFVATGEQQSQGIELDLSGEILPGWNVIASYAYTDAEITQDNVIPIGNQLTGIPKHSANLWTTYTLQQGDLQGLGFGIGFTYASDRQGDLSNTFVLNDYFITNAAIFYQRQRLRLAVNFKNIFNVNYIQGTPISRIRGIEPGEPFTVIGSITYQF

SEQ ID NO: 10502 - protein, 939 aa, Bacteroides coprocola DSM 17136
MKYINRNKNYLLVTVVLIVQTVLTTLSAQIKGDSLVNVAFNKAESRDLQGGIASYNVQELLEKNYFTGSLDGLQSQLAGMKGTSIWGQNGLLLIDGVPRSQYDVQPTEIENITVLKGANAVALYGSRAAKGVILITTKRGKEGALRIDVRANTGLHIPKAYPTYLNAAEYMTLYNEACLNDGKKIQYDASTIYNTAVGANPYRYPDMSFYTDEYLKKVYNKSDVTAEIHGGNERARYYSNISFTHNNSLMKLGEQKKDKSIDFRVRTNVDMNLTKWLKASTSAAVKIQNGYDGRGDFWGQAATLRPNWFSPYLPVDMIDPNNSILQEMVNANRHLIDGKYMLGGTSTDLTNTFADAQVAGYIKDRNRSFLFDVTAEADLGMLVKGLSFKTAFSIDYTDFYSEAYKLNYAVYQPTWSNMNGKDMIIGLTKYGVDDQSTNEFVGSSSYTQTMMFNAQFDYHRTFANHHNVQAAFLGWGFQQQNSADGDHDGSDYHRLSNVNLGIQAAYNYKHRYYFDFSGAVVHSAKLPEGNRNAFSPTVTLGWRLSDEKFFKENIEFMNNLKFSASYGVLNQDIDISDYYMYKGYFRTDAGWYPWNDGTAGGNAAASARGDNMDLGFIQRKELRVGLEAALFNNAIVLDANYFHQDTEGKLSQGKNTIYPSFFASNNFNQLSYTNYENDRRQGVDLSLQLNKKIGQVEAQLGLLGTIAWSEALRRDEVYEDSYQYRTGRALDASFAYVCEGFFKDQADIDSHARQTFGDVKPGDLKYKDINGDKQIDSKDQIDLGNTGNPFYFGLNLTLRWKDFIFYLEGTGNTGGIGYKNNSYYWVKGSSKYSEVVRGRWTPETASTATYPRLTTTDNSNNFRNSTFWMYKTNRFDLTKVQLTYNLPKYLFNGKLVKGLSVYVSGSNLLTIAKERKHLEMNIGSAPQTRFVNLGFKTAF

SEQ ID NO: 10503 - protein, 277 aa, Bacteroides coprocola DSM 17136
MRSVKYLLAAGAASLLTTTAVFAADMPSIMPPPAYAPPPVEDFGGWYLRGDIGFSNQKVKELRNVEPALYPAGLALTQEASFDTAGIYGLGVGYQFNNWFRADVIGQYRGNSNFKGLDTFTLGANTGYNLYGGSKSEWLAMANAYVDLGTWWCITPFIGAGVGAARVTVANFTDIGQYSAGAPSWVSAATASKWNFAWAAHAGLAYKVSPGLTLELAYSYLNLGDGFTGDAVPYNGANLYANNPYKFKDITSHDLKLGVRWNLDSPPAYAPPLMRKG

SEQ ID NO: 10504 - protein, 218 aa, Bacteroides coprocola DSM 17136
MKRTILALALLVALVLPGMAKAEGTGMYLAPKFLMTIQESGTIERSGMGGVDEYSQFTLGGALAAGYDFWPQYLVPVRVELEYALRGNSEKSWGSNWGSVDCTWNSSTLFANLYYDFRNDSAFVPYIGAGIGMSFNYLGFDLHRNGSAVSRDESTTNFAWNVGAGVAYNVNDALYIDAAYRYVDLGYTEASGALNGDQIKVGSRPYNHEFMLGLRFAF

SEQ ID NO: 10505 - protein, 506 aa, Bacteroides coprocola DSM 17136
MKNPTQKRPATVKNHLSVALAALTTVGGSLALPNFAHAQLEEVVVTARARSESLQDVPSTVTAFTAGQINDMGIQRAEDFISQTPGVSFVNTVETGDSSVSIRGINGARDAETNFALIIDGILYINTYAFNREYADLEQIEILKGPQGALYGRSAAAGAIIMSTKRPSQEFEGDVRISMAEDSTYTGLATVAGPLGENVAGRLTADYRSTDGFYSNSFLNDNVVDDAENYSVQGRLVFDPTDNLSIDTKLRYGKSEGAAITFNAAFALPPFLGFGTPGVESFYQDVNTHEFVFAGNVRPVNEQDVLEFSVKADWDMDWATLTAWGFYSDTEDTFIADGTSGAFGFYGATSACTNSLDALTPSYTPSVPGGVTALPAPTFIFGSAPGAQVLPPYSPTTCDGYQYQERFQEDMSFQVQLTSNSDQRLRWQAGLYYLDIERYQAVSQLRDDGSNWPNAASNVPTTIYNQFTDAMVNDTFDTTVMAAFGSINYDLTESMELSVALRYDRE

SEQ ID NO: 10506 - protein, 1011 aa, Bacteroides coprocola DSM 17136
MKDKISHHLAVRKPLSKIYLALFSAPLLLMGSADMARADDVIFDGESKVTEPLAYSGNVYVGRNQSGNLLIDNGQVGGYNINIGTRSDGKIYESLVTVRGPNAVLSAVNDQNVLRGSLNLGQGTLRVEDGGLASAKEIIVGTTGGYDSHLNVKGAGSKVTSDRLGIGFGQGARSTLLIEDGGVVTTTAAARIDSGFKPDEADKLNPKATVTGKNSQWNISQTLTANGDVDVLNGGVVNVGSAEIAGVSGSRKTAELYIAGEGSRFTSAGSVNVGDYGNGVLSVVDGGTFSAGANELRLGDTGSGSNRGALIIGSRGNMDTGTGLTEPTLGAAGGAGTVDAQTVVNLRGGLFGSYVYFNHTSDNYDFRNKMVGEGEVINTAGQTTLSGDLTQLKANVTARGGKIIINSDINTQPEDSPFDVQTLSAENGGTLILNATAGSDVSNGLGYSSAASIKSGGTLGGNGTLGQTEIQSGGHISPGDGNIGTLTLKRYLNFIGESFYDVDIAGDGSSDKLLVTGKTTISDQAKVQVTALDSQTSYQTGQSYRILTSEGGIDGQFAEAVSKSAFLDVALKHEANAVDLTIAQKGGGENPGGENPGGENPGGENPGGENPGGENPGGENPGGENPGGEGPGEGSGKPGIFQTVAQTDNQWDTAGALSTLAQGGPSLALYNSLLLLSAPEAREAFNQLSGEVYPSMQSNLIAGSTMLFNVLNQRMLRAFDNDTLPVPPLAMTLVQPAQAENSGVWGQTFGSWARNSGNDNVGKLDGNTSGFLLGADHKLADSSVRVGGYFGYSRGDYDVDSRSSKSDSDNYHLGLYAAGQQGAFSLRGALGYTWHRLENERNVNFGNYSDRLKADYDADSLLAFTEAGYRFGQSDANLEPFVNLSYIRLHTDNFEESGGAAALSVRNETMNTFYSTLGVRGTVELPQNVSLYGSLGWQHAYGDKTTSSRMAFAGSDAFTTQGTAVDDNLMVADVGVSVKLSRSTSLDLGYQGQYGSDTQVNAVNANIRWSF

SEQ ID NO: 10507 - protein, 282 aa, Bacteroides coprocola DSM 17136
MNKNKSIIIGTALTFLLAFSPIESFSANQTDETIPITAPISGIYFTGQYKPGISNFSNFSAKETNYNTQKLVRLKKDAKESNLLGVNTNFEDTYSVKFQNNIISFSGIIGYATSKGIRLEIEGAYESFDVKSPVGYSKDNAYYRYFALARSMTKENPKEFTVMKNNGLSVASIMINGCYDFALDDFALSPYICAGIGEDFIEFFDALHIKIAYQGKLGISYRVSPKISLFIDGYYHHIIGNQFKNLSVHHAVELSEFPKNSSAVATLDIGYLGGEVGARFIF

SEQ ID NO: 10508 - protein, 730 aa, Bacteroides coprocola DSM 17136
MAIEIRPVRIMSALAAGAALWQVPALAAAQTAAAVDDSGIAEIIVTAQRRSESLENVPISITAATADMLTARGVNSMRDMIAAAPSVTLVTVAGYLQPRIRGIGNAAVGPGFEGGVAVYVDGVYQAAPQANLFSLANIERVEILKGPQGTLFGRNTTGGLIQVITRQPSHDFGGTASVTAANYQDFTGDIYVTGGLSDTVAMNFAGHAEVQGKGWGDNIVTGKDAYRTYHDVAVRSSLLFEPSDATKVRITGDYLDNRNNISPSTVLAPGTGFPFPGLILPTRTWDTASDVQPNSRVKSGGATAQITQDLGFASLVSISAYRKARYSLVFDGDVSNLKLVSIDIGQSDRQFSQEVQLTSNPDSKISWVLGAFYFNAAGRFDPNGVALDGFVRPSSPLGPVTGSFSYARLGTRSLAGYAQATAPITDATRLTLGIRYTRERKSLTDIESFTTFAALPAPVPGAPVADRSVRYNRPTWRVAVDHRFSPQLLVYASYNRGFKSGGFNGQFPTDAAYLPERLDAYEVGAKANLFDRHLRIDVAGFYYDYSNIQVSKFIGSQQSFYNGAAARVYGLDVDFEAKLSSRLSLSGGMTLLHDRFTRFPNAVISTQVPTGIVITTGSAKGNRLPVTADFSATLTATHRTPLSFADLLVDLSYTYNDGYFTQPDNILRQPSYNLLAAGARLDFPNGVNARLWMRNILNEKIFNTLQAGTFDSNASYQAPRTYGITLGVKF

SEQ ID NO: 10509 - protein, 135 aa, Bacteroides coprocola DSM 17136
MAGIRLTKIKDSGYQEYGISFQNLTIQKRQYNKVEGILGGEIKTTYYKDEFIIRPQIHAFINYDFKGKTPAIVADLNGLNEPLLVLAPKPTKMLYDLGAGAVIKKGRMEHGVHYSLNLAKKYHAQSGTLRFKVNF

SEQ ID NO: 10510 - protein, 102 aa, Bacteroides coprocola DSM 17136
MYNDAEARMNGLYFPSFAELGYTDPVLTSAFYGLQNLPRIQEYSDLRYRQIDLSAGGTYQFTPNLFMTAQAGFQQFMDDAPYVYGDQDGITYTGSVGIGYKF

SEQ ID NO: 10511 - protein, 692 aa, Bacteroides coprocola DSM 17136
MKRHLILLFVGVSLPFLLAAQQKNSVSITKRVLRIPEVTVVGKRPMKDIGVQRTRFDSIAMKENIALSMADVLTFNSSVFVKNYGRATLSTVAFRGTSPSHTQVTWNGMRINNPMLGMTDFSTIPSYFIDDASLLHGTSSVNETGGGLGGLVRLSTSPANHEGFGLQYVQGVGSFSTFDEFLRLTYGDKHWQSSTRVVYSSSPNDYKYRNRDKKENIYDEDKNIIGSYYPTERNRSGAYKDLHVLQEIYYNTGEGDKFGLNAWYINSNRELAMLSTDYGNDMDFENRQREQTFRGVLSWDRVREKWKVGVKGGYIHTWMAYDYKRDKGNGEMASMTRSRSKINTFYGSADGDYAPSEKWLFTAGVSVHQHLVESADKNIISQEGNKAVVGYDKGRVEFSGSVSAKWRPVDRFAASLVLREDMFGTEWAPVIPAFFIDGVLSKKGNIVAKASISRNYRFPTLNDLYFLPGGNPDLKSEHGFTYDVGLSFSVGKENVYALSGGINWFDSHIDDWIIWLPTTKGFFSPRNLKKVHAYGAETNAHLDIMLGKDWKLDMNGTFSWTPSINESEPMSPADQSVGKQLPYVPEFSATVTGRLSWRTWSLLYKWCYYSQRYTMSSNDYTLTGYLPPYFMNNVTLEKQLSFRWADLSLKGSINNLFDEEYLSVLSRPMPGINFEIFIGITPKFGKNKNSKR

SEQ ID NO: 10512 - protein, 277 aa, Bacteroides coprocola DSM 17136
MFNTARKALLALLFAGLASPVFAADLPEPQVEEAPPPVYEQPVDVGGWYIRGDIDYHKSDVRGIDYMTYGIDPCNCTVIPGGKSFDYGKLKGGFSLGGGVGYKINDRLRADVTADYWFKSNFNGGTSDLVSTSTEVSKMSALLLLANAYVDIGTWHGITPYVGAGIGGARVKWDTVYDPNTAETNPGASNWRFAYALMAGASYCLTDKIILDAGYRFSHIQGGRMFEWDASSAGPGFDRGINTHEVRGGLRYQFGGNNGCAAPVVAYQPEPEPIYTK

SEQ ID NO: 10513 - protein, 713 aa, Bacteroides coprocola DSM 17136
MFTLKSYSPIALAVAAALTHTSLMASDTPPANDEMEVIVVTSDFRQSSLDKMPSSISVIDQQQIEDEGAQHFEDVLNGIANFNWSGGSSRAKYFQIRGVGEQEEYQGAPNSSVGYIIDDIDMSGLGMISSMYDLQQVEVLRGPQGTRYGANALAGLIYLKSNDPTSVFEHGAELQLGDDNLRTYSGFSSGPLTDSGKLLYRVSLQQHEQNGYRDNLYLGRDDTNGRDEFTGRIKLRWYATDDLVADLSLMHADFNNGYDAWTLDNNGFDTLTDEPGVDKQRTTGGSLKLTYSGADSFELVSLSSMAQSDTHHGYDGDWANPEFWAARSCEGEPCQYDYTWNKLGDRTTLSQEFRLSSTEAGRIFDGSTDWLVGVYGLRLTEDNDTLEIYNGWEDRLLAEYEATNLAVFAQLDSDLGNGYALSVGARLERRESDYSDSDKDAFDPSENMWGGHIALSKTLSPGQQAYARIARGYKAGGFNMSLPVSLSDKKEFQAETLYNYELGLKSEWLDGDATTHFSLFYMDRRDQQVSASQQNPDEPQKFILYVENAGSSHNYGAELEANWYATDNLKLYGTLGWLETAYGDYAYQDKYGGLVDLTGRELAHSPNLTYSAGATYRSDLGWFANLTTSGKSEFYYSDSNDSKSEPYTIFNARVGYETETWSAYLWGRNLFDEKYGVRGFYFGNEPDNGWADKQYIRYGDPRQLGVTLNVKFM

SEQ ID NO: 10514 - protein, 306 aa, Bacteroides coprocola DSM 17136
MKNKLIATGIVLTLLSFIPNISFSEITHNNTEIRYSIYISGQYKPSVSNFSNFSVKETNTNTENLVATKQDIAPLDIDAGLVTPKPPQKSQKIYKGLRESTNFNHPYTAEFQDNNISFGGAIGYSSTKGTRVELEGSYEFFDVKDPIGHKLHDAHRYFALARAMNKYKPFEPKRQYELRTHHTVMRNDGVYISSIMLNGCYDFSINELKISPYMCVGIGINAIEFFDALHLKLAYQGKFGISYPISNNIKLFADGYYYKVTDNKFKNLKVIHVADLNNTPLVTSAIATLNVEYFGGEIGIRFGLKL

SEQ ID NO: 10515 - protein, 739 aa, Bacteroides coprocola DSM 17136
MAKVSSRSWGIFPIRPVVSALTLAFGGMAGANASEPVPLPEIKVKSGKTSERSNEYKVDKSASQKFTAPLIDTPKSITVITDEVIKDSGSLTFQDALRTTPGITFGSGEGGIASGDRPFIRGFDVFSSIYVDGLRDLGTQTREIFAVEQMEVLKGPSGSFDGRGSAGGSINIVTKQARAGNFFKGSAGLGTEKFKRGTIDGNYTIGENVAVRLVGMAHKADTPGRDGVDVERWGLMPSITLGLNTATSATFSWYHFETDDKSDWGIPFIQNTANGGIPEGKPVGSRSAWYGVKGRDFQDTSADIGTFKISHAFSDNLVVRNTTRYSITTNEFFVGRPNISSADFAAGLVNRDATRNRGTRTETVANLTDVSFIFDTGFIKHSLNAGFEVSWEDYRNRTYAGGAIINPADRLTPLGNPDSSVAFDPVTRNAYPSAEIEAHNKSAYIFDSMELTEKILFNAGIRFDNYQVDLQNRNASTGANTTSFKQNKSFFNYQVGAVYKMQPNANIYAAFATSSSPVGLSMGDFGYAGGDLNANTESLKPERTETYEVGTKWHVLHDLALTAAVFHTIKTNARVNVGPSVENAGRAVVNGFELGFAGNVTDKWNVFGGYTFLDAEQTRVGDSTDQNAVGSAGSKGKQLHGTPKHAASFWSTYKVLPRVTLGGGLFYTGKVYADPSNNGYLPSYVRFDLMAKYNISQNLDVQLNVQNLTDKRYFNTTYFRHYAIPAPGRVAFVNLNLKF

SEQ ID NO: 10516 - protein, 200 aa, Bacteroides coprocola DSM 17136
MYYLRILILSMSFLNILNAENLSYMSSSYQIGTVFMRPLNTNKLLQGASILQGYEVNPKNDWAYSRYYFFIDYGNVLFNNDSTLQANMFTYGVGGDFMVAYAKNPINRWAFFFGLQLAANTWILNNKVKDLVVNTWDSLKDFNFHNTYFRAIGKFGVQFRTIVLYHKVDVEIGMKIFLTPERRSLFERSFLFFVSHSWHF

SEQ ID NO: 10517 - protein, 883 aa, Bacteroides coprocola DSM 17136
MKKYNALHRAVKLALTSTATAGLLLSQGVYAEEAEKTVVDKNVEKIAVVGSRAAPRSIGESPVPIDIIGGEELGKSGNTDMLEILKGSVPSLNVHTNPISDAASLVRPANLRGLPSDSTLILLNGKRRHRASVIAFLGGGINDGAQGPDISVIPSIAMKQVEVLRDGAAAQYGSDAIAGVMNFVLKDASEGGSLIVRHGEYYEGDGTSTEVAGNIGLPFTDDGFVNLSFQYKNADATSRSTQRPDAQAFIDAGVTGVGDPAQVWGSPEINDDISLFGNVGLDLTSDSEFYMFGNYSERDVRGGFYYRNPNTRPGVYGGNIRNVNGTNTYRPNDDDPAGQAAWDAATPTILVGSLDGYDQQLNCPLVEIQNGIPDQSALNSLTAANCFAFNQAIPGGFTPNFGGNITDTSLTIGTKGEITDGTFKGVYYDLSGNVGRSESRFFIYNTLNASLGPDSPRDFSPGKYIQLEKNFNVDLSKGFDAGYYSDVNVAGGLEWHEETFEVIAGDEASFKAGPLTDQGFGIGSNGFPGFQPSAAGEYTRRNYAAYVDIEAPFTEDFLMGFALRFEDYDTFGSTTNYKITAQYNATEDLSLRGSVSTGFRAPTVGQANVSNVQTNLSSGVLVDSALLPPTNPISVQLGGKELQPEESSSYTFGAVYSFDNFFFTADYYHIEVDDRISQSDKIELSDADKATLKAAGVPNVDGLAQVSFFTNDFNTTTEGVDIVANYTDELLGGSSTFSLAYNWNETTVTKWSDITGDFKVARLENDLPKHRATLTWAQDWEKFAMFTRVNYYGEYQGVHVDYDATAIMADTTVTVDAEVSYFVTESITLSLGAQNIFDQEAEKLNFTQQSGGIPNNNWGGKYYETSPYGFNGGFYYLKATYNF

SEQ ID NO: 10518 - protein, 611 aa, Bacteroides coprocola DSM 17136
MKNTALLFAILLIGAFQLNAQQEQTIIKVDTLNEVVVTSNRIDLPFKENSRTISIITAADIKNSSAVTVADLLQQVAGLDIRRRGTGGSQADLFIRGGGFDQTLLLIDGVKMDDAQTGHHTMNASLPLEVIERIEIIKGPAARVFGQNAFTGAINIVTKSTLNNSVSANLEAGSFGQLNASVTVGSELENSTHIFHAGKMTSEGYRNNSDYNNSNFFLKSVFNKKDQPIEMIATFFERKFGAENFYTPSSWGFNEYEETQNSLIAFTTTFKSEKLKMQPRVYWKRNQDMFLLQRDDPNFFRNFHISNKIGAEANAAYYSSLGITGFGIDMSKVYLRSNNLGSRSRFMTTLFLEHRFQFADDRLDITPGVAVTYFSDFKFNAFPGLDIGFDITSNLKAYGNIGYTYRIPTYTDLYYNGGGSAGNPDLEPEEAFAQEIGFKYVSPKIGASISVFNRDAENLIDYIRPNTDVETFTATNITKVNTKGLEIDAAYNFKLNDYNQTLAIGYAFLDDNILDQNEELSRYSLNTLKHHFTTRFSTQLLKNVRQNIVYKYAERTTGQTYNVWDASVALKLKQVELSMTASNIFDADYIESGFTPMPPSNVLFGLRYSFK

SEQ ID NO: 10519 - protein, 743 aa, Bacteroides coprocola DSM 17136
MLTILSSIIAYAEDTIELNQTTVKGSKTSDYTAPPKEQKNTFVITQERIREKNYKNVEDILRDAPGVVVQNTAFGPRIDMRGSGEKSLSRVKVLVDGVSINPTEETMASLPINAIPVESIKKIEIIPGGGATLYGSGSVGGVVSISTNSNVTKDNFFMDLNYGSYDNRNFGFAGGYNFNKNLYVNYGFSYLNSEDYREHEEKENKIYLLGFDYKINAKNRFRFQTRFSDIKQDSSNQIPVEELKNNRRKAGLNMDIDTKDRSYTFDYEYRPTQNVTLSTSLYKQEQDRDIDTESIDDIKIIASNRRFSHITQEKIFYDVKSEMQAKFEEDKKGLKIKAKFDYNLIGDNASETILGFDYQTSTNKRNSLVQSETLKSYYDSSFGGFGTLGIGDRLPIINKIDMKMTKKSSGIYAFNKWGLTDKVDMTFGGRIEKTQYNGYRENGPNIMPFISPEKKRIETDEKLTNYAGELGFLYKYNDTGRTYVRYERGFVTPFGNQLTDKIHDTELKNKDSGIIVPPAVNAASKYVANNLKSEKTDTFEIGFRDYIFGSSISTSFFLTDTTDEITLISSGVTNPAVNRWKYRNIGKTRRMGIEFEAEQNIGKFRFNQSLTLVNTKVLKSNDEARIEKGDRVPMVPRLKATLGVKYNFTDRLSGYLNYVYLAKQETRELRENTDITKDDVIVKHTIGGHGTLEAGLSYKPDNYSDIKIGAKNILSNKYNLRETSLEALPAPKRNYYLQLNVRF

SEQ ID NO: 10520 - protein, 742 aa, Bacteroides coprocola DSM 17136
MIKTLSTRKRLQLAGASAIALSAACLAPTAAMAQDTAPSSATVETIIVTTTRREENIQDVANSVTASSGEALAPFTEGGADILSLGARIPSVYAESSNGRVAPRFYIRGLGNTDFDLAASQPVSVIMDNVVMENVILKSFPLFDVAQVEIARGPQGTLFGRNTTAGTIKFDSVRPSQETDGYVSVTAGSYGTMNLEAAMGGAILEDVLSARLSLLSQHRDDWIDNGFTGENNALGGHDEMAGRAQLFFTPNDSFDALLNVHARSLTGTSAVFRANILSPGSNSLNGNFVRDEVYYDSTFNNPQAYDNWGTSATLNFYTGSGLTLTSITAFESADGYSLGDIDGGNLVTGPGFIPFPSETQDGIDTLEQFTQEFRLASDDSQATTWQVGAYYFESEFDITTVGPNGGFPPSTTVRHDNTLWSAFGQVSHQLNDNLELSGGIRFTHDAKDLIGVVTSIPVTPVSVSDDQISWDLSAYYDLDDRQAVFARLARGFRGPSIQARDVAFFSQPSVADSETSTSFELGYKSEPLDGRARFNATAFYYQVDDLQLSAVGGAGNLVQLINADRGVGYGFEIDSEIFVTDNLFVTAGFSWNETELQDNDLEVGVCAQCTVLDPDADIDGFHEVDGNPFPQAPDYILSFTARYSIPAGNGGEWFAYTDWYYQGRTNLFLYESEEFYSDGNFEGGLRVGYAGELSGGQDYEIALFARNITDEENLVGGIDFNNNTGFVNEPRIVGASFRASLN

SEQ ID NO: 10521 - protein, 191 aa, Bacteroides coprocola DSM 17136
MKYITNLSLSVWVVLLGLSAGTLSSNATANDATHHLVGASLGYGAQEFETKNGKYDAGDTVTVDLYYRYMLNEHFGVEAGYLAGSGGVASALVEAFSEIKDLSYQGGRIAAYGEYPLSTGNSLYAKLGAAYTQVSYEMDKQDRDSDDIGFYGAVGWQYRFKSGFGLNLEYQYIPMKELELQGINVGISYKF

SEQ ID NO: 10522 - protein, 866 aa, Bacteroides coprocola DSM 17136
MFCLFFLPNNLFAQNTAKVSGKVLDDSGVTIPGANVTLKETGKSTVTDENGGYSFSNVEAGTYTIMATNVGYKTFEKKIALKEGESIEVSLLLEGESQSLKEVVVTGSSAPRSKLESSVAITTMGAKAIEDRAPSSTAALLQTIPGFVVEASGGEIGNNLFARGIPSAGAYEYVQIQEDGLPVFEDGALQFANADTFYRLDETVSKMEAVRGGSASIFANNAPGGIINFISKTGQNDFQGRAKFTTSDYGMFRTDLNLSGALIQDKLFFNVGGFYRTDNGVRNTGFTANKGGQIKGNITYKFDDNDYLRINFKHLDDRNTFYLPIPLKSNNGKVEGIPGFNPNYGTLTSVNFSHLNVPQYGGGTFSADLEDGSHPIINSIGAEFKKKISEKVTFKNAFKQTSIDLNYNAIFPNGGPWTQDAYAADVQNTTAGNLAYTYVDNGAALDPNALIMRADLWHIEKKMSNFANNFSFSFDLDPVKLTAGYYYSNWKSNQYWNWNSYLVSVSDNPRLLNVKDNTTGVDHTWNGVERITWLERDAQTKGLLNDIYADAEIKATDNLTFNAGLRYNKDKYSGYRDNARFFAENLGILDNNTADDAVTTVKGNPYTYWRYDVSEWSYTAAGNYKFNDNMASYVRYSHGFRSPIEESFYDNAANLSKLENTEVNQFELGYKYSSSFFSVNANLFHMNLKNVAFTDILSDGSSENKFADVNNIGLEVETNARYKFAKLNFTFTVQKPEYDNFTGTNADGSTFDFNGNTARRIPKFFCNLRPEVDITKDFTAYVQFSYYDKKFTNQDNKQVLPAYKEVGAGLNYTYNNLRFAVDASNLFNEIGLTEGDPRQTTSAASDVFMARPILGRAFRFSVAINF

SEQ ID NO: 10523 - protein, 731 aa, Bacteroides coprocola DSM 17136
MIGVFAIIIKYRLELPNIQSMVEDYKPQMATIIYDKNNNVVDTLSVESREIAKLENISPYVKEAFLSIEDKQFYSHHGLNFRGITRAIVTTFLKGRPTQGGSSITQQLAKNAFLTPERTFSRKVKEAILTYQIERTYTKDEILERYLNEIYFGSGSYGIRNAAEQYFKKDVKDLNIAEAALLAGIPNRPTKYDPNRNLENALYRQKIILKEMYTDGRITKEQYDEALAYKFELENEENIKNVPKNTSIIYNKRTKNTYKNPELTTIVEDYLAEIYDEEQIYTSGLKIYTTIDLEYQKVAKETFNSYPYFKNKEINGAMITLDPFTGGIVSIVGGKNFKAGNFDRATMARRQLGSSFKPFVYLEALQNGFDPYSVVVNDFVAFGKWAPKNFDGRYTYNSTLVNSLNLSLNVPAVKLLDAVTVEAFKEAIGDNVKLTSEVKDLTAALGSVDSTPVNVAANFSIFVNGGYIVKPNIIREIRDNQDILIYVAEIEKTKAFDSVDVSVITAMLKTVVSNGTASKARVVDKTGKPIQQGGKTGTTNEHRTAWFVGITPEYVTACYIGRDDNKPMYGKATGGSAVAPMWAKYYQTLINKGLYTPGKFEFLENYLETGDLVKQNIDIYSGLLDGPNSKEFTVRKGRLQVESAGKYKNGIASVFGLDGNVTDGAGIDMSEGMIIDTEIEEGTVTEGGTGEGTTQTLNTNTTTSTEGNIPPVQNNTSNKDEDSLTDRLLGD

SEQ ID NO: 10524 - protein, 452 aa, Bacteroides coprocola DSM 17136
MESDLLSMTIDYDTGWGAIKSITAWNDYSYRVDQDPDRSELDILTLSNDKYSGDSFSQELRFTASPNDNVDYMLGVFYLEQNTKRGGDEPFVFIGDDIITIGSQQDLPFPLPFNFLVQPGDSLTIDMDQDAETIAFFGQGTWHIGDQWHVTGGLRWSDEEKKSDLFSQTYSTAFSYQILGASFLDSVSTPIDATLERSSDNVDWMLRAALDIGDDSMVYASAGTGTKSGGFQTVNGAADDREFDDEDTTTYELGVKSTLLDARLRINAAAFYSEIENFQAQRQLETGIGTYVSNESKVETSGVDLQVEAAPMPNLVLSAGLLYMHKYEITDGPEKGADLPFTAEFSGTLAATLVFPLGDGGVYWRTDYSYMDDHVTNVASAAQLRDADYDNRNLVNSKLGWRNDSWNVSIWGKNLTDDKYAMQTAAPFLVSGMDAYFLAPPRTFGATVRYTF

SEQ ID NO: 10525 - protein, 1051 aa, Bacteroides coprocola DSM 17136
MKRKLMLLMTCLMIGIGLVNAQVSKVTGNVTSEEDGLPVVGASVLVKGTTVGTVTDIDGNFTISGVPASAKTLVVSFIGLQSQEVAVKPVVNVVLKSDAQALEEVVVVAYGTQSARTVTASVASIRNDALKDVPNTSLDQMMQGRASGLNVTTPSGGVGQAPVVHIRGVNSITSGTSPLYVVDGMPIQSGDLGGGLGNANALADINPADILSIDVLKDAAAAALYGSRAANGVVLITTKQGSSGKAKVTYDASVGFSNRTKFIDMMNAQEYVDFKNMAVRNAYGTDVAAELAAMDKTFIANPAYGDKAFNLMPGVDSNWADAIFQNGFTQDQTVAVSGGTEKVKYYMSANYNTQKGIVVGDNYKRLGGKANIVANVTDWLKIGMNSSVNVSSTAQVDAARNGSNFAVGGFPRMALANSPNIPIYDENGKGYYDRSLGVLGYGPNAVMNTFSNPVALVELGNKTNVDVTRILSSFFAEVTPVKGLTLKTQYNIDDARIENSRFWSPNHGDGVNNGGYAFNAAVHSSIWTWTNTATYDFTANRHHFNFLVGMEATESSYNEWDAARTGLQDDKFTNFQGTFANATASGSISKSSMVSYFGRINYDFASKYMFSINFRRDGLSALSKDNRWGNFGGVSAAWRVSEETFFEPLKHVVEDFKIKGSYGVVGNTNIDDYASRSYYSPYYYGSQGSYRLSKIADPNLKWESSEKYDVGFSARVLDRFDIDFDYFYTKSSDLILDVPQAPSKGLPGNILTTNAGKMTNSGIELTISADILRDGAFKWNTSFNITTTRNKVVSLANGLDNIIKGDASGLEITNITVPGKSIGQLYLTPTGGVDPETGFRVFYGENGERVLYNHASEAKWILEDGTPYEGSLKPVICGNTLPTWYGGWSNNFSYKNFDLSLFFQFSGGNYIYNGTKATVSDMRYWNNSKEVLQNYWTPERKNAMFPKPVYGDNYSNGSAMPISEWVEKGDYLRLKNISLGYTFNTKNWASAIGISKLRVYAQVQNLFVITGYSGMDPEVMSNTTNATLAPGTDKNTLPQARTYTFGVNLAF

SEQ ID NO: 10526 - protein, 597 aa, Bacteroides coprocola DSM 17136
MVVSANRFEQPLSSILAPVTVVTREDIDHWQSNSVIDVLRRLPGVDVAQSGGMGQLSSLFIRGTESRHVLVLIDGVRLNQAGISGSSDMSQIPISLVQRIEYIRGARSAVYGSDAIGGVINIITRRDNDGTTLNAGIGSYGYQNYNGSTQQKIGENTTVTGAAAYTHTTGFDVEARGFSGDRVQPDKDGFLSKSLWLGVEHQFSSDIIAYARAYGYDNRTDYDAYYDKYADSQVDTRKLYSRTYETGLKYHNDKYSTMLMGSYGTTKDYNYDPKYGQYAKFSNLDESKQYNLQWGNSYRLEKGNISAGIDYQHQSIEPSGYTMISEKQTLNNTGVYLTGQYALIDSVVAEAAVRSDHHSEFNWHTTWQSGLSWEFYEGYKLVGSYATAYKAPNLSQLYAYSSSDWGTTKGNPNLKPEESKQWEIGIEGKTGPLFWQLNTYHNDINNLIDYKYGNPISTYENIGKAEIKGLEWVGEVNTGIFHHQITYQYTDPRDKEKDEVLLRRAKQQVKYQLDWTVYNLDMGLTYQYIGTRYDKMGNGLRTKVGGVSLWDITAAYPITSHLTIRGKIANMFDKDYESAYGYRTAGREYFLTGSYNF

SEQ ID NO: 10527 - protein, 1081 aa, Bacteroides coprocola DSM 17136
MKKNFILFIFLLCSIVAVAQKKSITGIITDTAGEAVIGASIVEVGTTNGTVSDVDGNFTLSVSENASIQVSFIGFSSQTLSVKGKTNFKIVLKEDSELLQEVVVTGYGGKVSRSKLTNSISTVNPQMLDKGIYTNPSQALSGSVPGLKVSLTSGNPTSSPKIILRGGTNFDGSGGPLVVVDGQLRDNFDDINPQDIASMDVLKDAGATAIYGARASNGVILITTKSGKAGHREINFRANVGLGYVNNPYDFLGAEDYIIALRTAYKNTPWAPQASLTGSTALGTGNQIGPKMVWNIMGKTDANAYLLDKGWREMPDPLDPSKTIIYKETKPEEYNLRNPVVTQDYTVSMSGGNDRGTYYASLGYNDSPGAPITTEYTRYNFTFNGSYKIADWLKTTSNATFSRANYVWLNNDWGTEADYFGRVMSSPPTVRFEDEDGNSTLGPSPGDGNQTYVARSYDQDNERTKLTLMQSVEANLFKGLVLRASASWYYFHTVEENMRKDYETVPGQWDRTRSTSASYSRQFSQTYNAVLDYTTTFATSHNLNVMLGSEFYDQYNNGFSASGFGASTDDFKKLGLTDAGEGKRSIDSSHSRYRILSYFGRLNYDYEGKYLFSGVFRYDGYSSLLGKNRWGFFPGVSGGWVFTKEDFVKESLPFLYYGKLRASYGLNGNASGIGPYTLQGSYNSNKYHGNNGFLIGALPNPSLRWEKTASFDIGLNVGLLDGRLNLDIDYYNRLTSDKYADLTLPSTTGFSSIRNNNGKLRNRGIELQLSGKIMETRDFTWDASLNITYNKNKIIALPYNKEPRNRQEGQQVYTGRKIANPETGVFEDEKVWVGGFQEGMEYGVLVGYQAEGIYQSMDDIPGDLVVKSGNAQGKYQYGPDAWKRLSAAEQAKGVEIKPGDMKWKDVNGDGMIDQYDQVVIGNTTPRWFGGFNTTMSWKGLSLYARFDFALDYWVYDNQTPWLLGCMQGTYNTTKDVFNTWNESNPNAKYPRYVYGDQLGTANYNRTSTLFASKGNYLGVRELSLSYTLPQELSKKLYMQKLQFSITGQNLGYLTSARTVSPEISSGYPLPRTVILGVNVTF

SEQ ID NO: 10528 - protein, 167 aa, Bacteroides coprocola DSM 17136 [sequence omitted]

SEQ ID NO: 10529 - protein, 665 aa, Cellvibrio japonicus
MNTKITVGAVCLAACGLLAPQHSVLAAQQGDEDTEAYNLGEIVVSGKTEGVQAAETVHTVTAEDIRSMNATTLDQAISLLPGVNVRIGPEGVPRIDVRGFRTRHVILLLNGVPLNSALDGQFDPTTIPTENIAMIKMTSGASSVLYGQGGLGGVINIITKKGSKDISGMVSAETGDHYPYLVRSSLAAKKDAFDFFISGSSTDVDGFPLSDSFDKTSVQDSDYRKNSDRERHNVLGTIGYNPNDDLSLGFTFTYNQGEYGKPPGTIDNNKDPFASTPKYERIESYEGLSLQLAGDYRFTDKLNLRGWAYRNQLHMQDYLYADADYDSFTKKSSFKERVRTTIHGISLQPRYDFGAAGTLTFSTINEWDQWKNDGLTSSANNKPLDTSRDESKQYSVHTLAAEYELSPLEGLGLVAGYGHHWQAREHSSDNDYSVNAGIHYDILKDTRLKFSFNRNIRFPTLGDLYGLSEGNPDLDTERSLTFEGGVEQKLPFNSRISLIGFHTEVKDLIQKDKTTDTNMNVSKVVYDGFEIAAATQFTKNILLRASYTYLDSKVKDDSEKEQLQYTPHDKFTFEGKYDFDCGFTPYVSVQYVANQYFYTKDTAATFDKGKLNDYVLLNVKLSQRFFDNRFTTYFGVNNIFDENYETSYGYPQAGRFIYGGIELRI

SEQ ID NO: 10530 - protein, 1010 aa, Cellvibrio japonicus
MYIVMKRNIIFSLVVFFFCLTANAQIKVRGTIVDDKNEPLIGVNIQEEGTTNGSISDVNGQYSITVAGIDSKLSFSFISYKTIVEKVGNRTVINVTLVEDSELLQEVVVVGYGVQKKSDLTSSISSVKGKEVRSMNVSNATESLQGKVAGVTIVGAGNPGGQPKVLIRGFSTINLSTDPLYVVDGVPMGEGINFLNPNEIESIEVLKDASASAIYGSRASNGVIMVTTRKGVEGKPSFYLDMHYGVQEMKNPYNMADAVEYAEILNTAARQAGYPEEFENPASFAGKTTNWWDAGIRQFTPQLNASLGVQGGTEKNKYSVSLNYFQQDSFYQKGGYKRFTARFTNDYKFNKYFSAGFSLNPRYESWGNPTNWSDFDRVDPITPIFKPEDELNGTENEYSVYSRSPSQIWNPVGYVHRWNQSNNSYALSSSAYLEIKPIRDLIFRSQFSIDLDTRISNTFAPDFVIDAAHEFQTNNKFTRNKPTYRNWSLQNTLTYLKTFANKHNFSFMVGNTLEEWNSTTLWGSYEKMPNNSDNLHELDAGTVNPQTGGNSSTTSILSYLGRLTYNYNDKYYLTATYRVDGSSKFLSKNKWASFPSASIAWRMSNEPFMESIKSVLNSLKLRIGWGRVGNQNLPSGVYMSQLGQGYYVLGDNVVNTVYPSLVKNEDVKWETVEDYNFGIDYGLFDNRLTGSFEYYIKNTKDMLFQKAYPSYSGYPGDAKIWTNVGSMRTKGFEMAISYNDRWGDFTFGTTLNLTTFNVNMTELTGDKDPLYGNGEKTKTIEGEEPAFFYGYVADGIFQNQTEVNRHTNNKGQFLQPNAQVGDIRFKDINGDGQLNADDRTKIGSPWAYMTMGLNLNLGYKNFDLVANFYASIGNDLVNQNIQELYNAAGSGGKVNKVSGLLDMAWHGEGTSNYVPRLSTQDHNENFTKFSSFYIEDGSYLRLKNLQLGYTFKKIPGVNKLRLYIAGQNLFTLTGYNGVEPEVSGSVLSFGFGGWTYPVQRIYSVGVNVTF

SEQ ID NO: 10531 - protein, 1069 aa, Cellvibrio japonicus
MTTNERVQLSERIPGTVRQVLLLVLFCLLAVPLFAQFDTGTITGTVTDSSGAAIPSVKVTVTNTGTNVQKTVTTNATGYYVASELPVGNYVVSANSTGFAETKSQSVVLNVGAVVHANLAMAVAGSEQKVEVTGTTTSVDTETAQSGTTLNATQVANLPINGRDVSNFLEIAPGSVASTTFFQGSVNGLENIFTGLNITVDGQNASRGDINGFLDTEGQELARVTRASVDSIQEIDFTNSGFSAEAGRSLGPQMNIITKSGTNDFHGTAFEFLRNDALDAKDYFNNGKAAPLRMNQFGGNIAGPIIRNKLFFFANYEGDRTHITNFNALYETPSAYMRSRPHDPRMDPVFAQLAPVPVGCTSIPAPASCAVPGTTDTTDATSTAGGAQLVYETASLPDILREDTGSVKVDWNISDKDRIFFRYNINDSLTDYTYGLNQGQVSPQSMRTQLLKVDETHTFSPTLLNQLSLALNRFYSNTDSNTPEPFVGFSGFFTNLGNLPGPNTFNQITPFNVFEVFDNVTKTSGRHTLHFGAQIRANQLNEWLRPQQVYQFGGANIFQPDMFHDFRTDNPFVLQKIGFPGFVGVTNSNWGLYLQDDWKVTRTLTLNIGVRYEYNTAWSERHNIEQNFDFATQAFLPQNQDIYNAPKGDVAPRLGFSWDPFGTGKTVVHGYYGLFYMPMQYGFGMIGNIPDYQSYSVNVFQAIFGNPPFSIAYPSPNPPLQPGTQNVNIFPSNPQDPFSENWMFGIEQEIAPNTVLALNYIGNHAMHMQAGVSFANVNLNPANPFTQARPLSGYASENYLCDCLFSKYNSLQAQVRHNIGKLNFEANYVWSHEIDDQMNFLSPGYTNPADPKADIASGDWDVRQNLTGSVVYAFGNLKGEAAWKRAILGGWQASTILQARSGLPVNITLVSGLFGNPTRPNRVAGQQGYLSDINWPNSSFNSAAYEINPNYTGDWGPVWGNTGRNDLRGPAFVQWDMSGMKNIPITERVNLQFRADIFNILNHPNFATPDGGICSSITGAFTDASGFHPATCAPNPNFGRTGQTVADSNTSQIGPGTNRQIQLSLKLVF

SEQ ID NO: 10532 - protein, 892 aa, Cellvibrio japonicus
MRNKLRSAIKAINYESITTAAVLGMAAPVFAQDAGPIEEVTVTGIRSSLTQSIDKKRDANAVVDAITAEDIGKFPDKNVADSLSRITGIGVSREFGEGEKITVRGASPSTNRTLLNGQSVASADWFILDVPSRSFNYTLLPSALVSSLEVYKSPVASMDEGSLGGTVVLTTRRPLDLPANAVSVKVEGQYSETSGETDPQLSAMYSWKNDDETIGLLVSGVSQQRKVVREGVEILGWRDTGGVKVPSHIGVPRFEQERDRQTVFASAQFAPSENLDFTLNVLKSKMDSNNHNQNWLIFPNNEATEALTDPTVWTSSTVEDGNLVAASVATGGSTEFDFINRRSSTETQSVDLDINYLSDSLNVHAQIGSTDAKGGTYREASYSALPINDIGYSFDLRGTPELETTVDSSDPSAFAPGWIWGGKKPTTDKETYAQVDFELPIEAGVFTAIKTGIKLRDAERTQERAVFSWHGPNTIDEDNVSGSYLDHVFATCTTFEVCGLGVGTPESIDVLASGNMTEQMYHDQAAFEEIAFVGLDGVPADYAVSLELAQNWEVSEKINALYVQGDFEGDGFRGNMGVRYVSTKQTSGGYEFSDDSWGFYTIDREWLTPSSLEWVTTDNSYSEILPSFNVAFDLNADQILRFSSARVMSRQNWNDISASESFGSLNQAAPAGTRSNPLLNPQIADQFDISWEWYFDDASLLSATYFFKDIKSYRSYVFDTSPRYNEETEEFVDVTFQQPVNGLGGTTDGLELSYQQGFGDFGVVANYTYTNATNEQERDETSPGSGLVEGTSDHMMNLTGYYENDVLSARLMYNYRTEWYKGLHFNGDELWNDAFGQWDASFSYNVTDNVSLSLEAINLLNEEVIEYNTDKARVMSLYQNGRRIVAGVSINF

SEQ ID NO: 10533 - protein, 763 aa, Cellvibrio japonicus
MKHRFNPIYAAVLAAFSTCAYAQEATDTVVKTLGTITVTSGQPTSLPTQIPTTIESITGKQIAETINATDAEDALKYFPSLLVRKRYIGDYDHAVLASRASGTGNSARSMVYADGILLSNLLGNGASFTPRWGMVTPEEIDRVDVLYGPFSAAYPGNSAGAVVDYVTRMPDKFEGHAKVSGFTQNYDLYGTHSTFSGHQESVSLGDRNGAWSWWINASHLDSDGQPIVIVSKTPCGSSCPVGAPTPVTGAVTGKDTKNNPTQILGTTGQTATTQDQGKIKLAYDFSPTLRASYLLGWWQNNTDRMPETYLRDAAGNPVYSGNVSIDGSTYNLKPTDFSATRSDQRHVMQALSLKSNTRGTWDWEVAASLYDYQKDLVRASGTAYPNAAVGGTGTLTDMSGTGWNTFALKGTWRPDGTEGAHIVDFGYQRDAYQLRTSTFNTSDWIAANAGTRSSSFNGDTNLQSLYAQDTWRIAKNWKTTLGGRLEQWQASNGSLSNSNTTVAFNDRNENYFSPKAAIAYQATPQWALKASLGRAIRFPTVSELYQGSLDPTTNILSKNDPNLKPEKSWTSELTAERDLGNGLLRATIFHEDTKDALYSQLNVATNVTNIQNVDHMRTTGLEVAYQANDIAIRGLDLSGSVTFADSKTVRNDNNPASVGKWQPRVPKWRASALASYRPDDRWTYTFGARYSGRQYGQLDNSDVNGFAYTGVSSFFVTDVRVRYRIAKQWTASLGIDNLNNKKYWNFHPYPQRTVLAELKFDLD

SEQ ID NO: 10534 - protein, 595 aa, Cellvibrio japonicus
MKLPLSYLPNIRFLSWCCLLAGIIAPATLLASPNPAEIRMQQDIQQRQREEQLRQTMQPESDVRLHQKNTGETVNQLMGDDSSQPCFAINEVVLEGEHHARFQFALKRALRETGFQAGKCLHAGNINQIMSLAQNALIGRGYTTTRILAAPQDLNSGKLQLTLIPSYLRSIRIDRSNDDQTHAGRIAAFQNKFPTRSNDLLNLRDLEQGLENLKRLPTAEADLQIVPVEGEPNQSDVVVQWRQRLLPYRVSVGMDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 10535 - protein, 669 aa, Cellvibrio japonicus
MNVNQPGAGRYAWGKSTSLWAALLVVTAPPANAQEELPAITVTANALSQSAESVPAAMSVFDGQTLEREHVQDLPSVLRRVPGFGFQPFGQSAIQPPVVRGISSNFASYSSSALMMVDGVPTFMAQGFDHDMLGIERVEVLRGPQSALYGRNAEAGVVNIYTRAPDNTPHARLSTELGSRNKRVARADLSGPLVEDRLFLGVTGNWSEQDGFIDDRYHGGQADDRKKHGGRMALRWTPNDTSEAILRYSRQDYDDGAAQWGASGTRRTRVSSGVRGWDHSSARSVSLDLSTELASGLKFRSVTGNSDFYDRVLQDTDFRPADALHIGRDNHFNTLSQQFTVEGTLGDSQWVTGVYFDRDRHDLGGEQKTPMRLLPYSAKLQGHSAALFSHWMIPVAERWTLTLGGRAERDFVRFTPQGGDSRDASWKRFSPKVALQYEWMDDAFVYASVADGFRAGSFNTFSPAANYPAYAPEKVRSWEIGLKGGALDRRLLYSVALYTMDIDDMQVQQMLTPGVVYIANAASARSSGLELQADYLLGEGWKLQGAVALNRTRFDTFTDAANDYSGNHNPFAPDLTGNLGLRYDAENRWYTQLNLSAVSRTYLDAANSNRRAGYGLIDLDVGRSFERFEVSAYVNNLANKRYDAVGYQNGFVDVYSPPRELGLRLTFDM

SEQ ID NO: 10536 - protein, 731 aa, Cellvibrio japonicus
MSNVVSKGRLLLLATAAACLPAAVQAQAPATGAAAQTEANAAASETALDVVVVTAQRRVQRGNDVGIAMNVVSGGELEAAGVRQVVDLATQTTNVQIKNTLGGSVPNVTIRGIGLNDYASNNNPAAGVYVDNVYLVSPAMLSFGLFDVDRVEVLKGPQGDLYGRNTTAGAINIISKRPTEAADAEFQVGYGTYDSWLLNGAVGGPLAPTLAGRFAFTTEQQASGWQRNYVTGERNGRIDRTAARLHLEWTPSEAVTALLSAHAGYDRSDQSLYKVDNVLTTDEDAFAGRPRIAGASNNPEVDLKSAGVSLTVDWALAEGLTLTSISAYERFTRVDVGDQDGTRLRQLDSTFRNRINQTSQELRLAYSREALTLIGGAYYSRDTVATQDSYDAPDLLPLLGLSGISTIGNRYHQRTKAYAVFLHGEWEIVPKLTLVSGIRYTKERKRLDDATTFLGPTGGGEVDVFAPVENFFRTSNVSGKLGVNYKLLDDTLLYASVSRGFKSGGFQGQLTFDPSALTPFDDEKLTAYEVGVKSRVLPNLQVNASAFNYDYEDSQFYGPLFDSPVGVLFGITNVGDARVRGVEGDVTWRPVAGLDLRVGAGYIDTEITRSIVPGVAKGSRLPNAPEFTLNGSVKYAWTVTDDAEADISLSAAYQSRVAFDIVRNPPEAREGGYTTVNGEAGLNLGENFRIAVWGKNLFNELHRTQALFTSAGWSEQYSAPRTFGVKLSWQN

SEQ ID NO: 10537 - protein, 532 aa, Cellvibrio japonicus
MKRLFSALLLAPAIAGVAAGAANANGLSTEQLQKIDAVTPNGITSGQITSITELSDVKPTDWAYQALQSLVERYGCIVGYPDRTYRGSRPLSRYEFAAGLNACLDKVIEFAASKEDLDTLKRLTEEFQAELATLRGRVDSLEARVKELEATRFSTTTKLQGEVIFSLDAVANTAGNERNQDGAVSFGNRVSLNLNTSFTGKDLLLTRLRARNIETIQQRLSPGFNPSGSRLDYDGTGSPGVPNSANTFFLDKLLYRFPVGDVSFTVGTGTAGVQPQDYGLSDATFFSGPANTKAFKYVGAGVYADTRDADTAGVGFNWKASKNFSFQAGYINRNSADVSTVNSGGVFGFTPTGTGTNSWDVNAQVKYQTDNNKFRVALAYALRNGPYATDFGTTNAFQPFGATNYNSNSLALSLGWAISDAVPLSAGYALALSEQGTSQNATVQNYAIGLTFPNLFADGNEFGVAAGQQPWVSSASNRSSEDTGSFGVETYYKFQVTDNISITPGIYVFNNTQWPAKRWNEYVPFLKTVFRF

SEQ ID NO: 10538 - protein, 712 aa, Cellvibrio japonicus
MGARNACGHDEKERPVIPTRRGISPHTPCACGRSGIVISEEIYRKTKQVASGTGVGGSTITREENWIFDKQTLDQAVNMVPGVVSTFDSNGRRNESDIFVRGFGRWQVPLMIDGVRVYLPADNRLDFSRFLTSDISEIQISKGYASVLDGPGAMGGAINLVSRKPVKPFEAEYSAGTAFDNRGSFQGWETYGRLGTRQENFYLQGSAGYLDRDFWSLSRDYKPFPAQGAYQGSLEDGGRRIGSDSRDWRINAKVGFTPNATDEYTINFIKQEGKKGAPLNVYTNPLQPPNSYWRWPVWNIQNLSFLSHTQVGDASYLKTKLYYNTFDNVLSAYDNISYTTQSADGRFDSYYKDNAKGGSVEVGTRLIPMNTLKGAFHYREDTHVEWNHNQPTLPSGGSVEPKQTQGQTTWSVAAENTFHVRPNFDLVGGISYDKYWVGRAEEWNSGGGFIYEYPKGGSDAFNWQTAAIWRYSEVAQLYASISDRARFPVLFELYSTRFGTATPNPNLGPERATNYELGWKGRVTPDLQGTAAIFYSDVRDMIQTVQLPDSTTQTQNVGDGHFYGFEVSAEKQLLPQLAIGGNYTFIRRTIKDPLQPNLQATGVPSHKAFLYASWQPIDRFTVTPSLELASDRWSDVNVGTNAANQAVRDVFPNGGYIRTGAYTLLNVNLNYKFNENFEVSGGVKNILDDNYELAWGLPQAGRTFYAKARATF

SEQ ID NO: 10539 - protein, 370 aa, Cellvibrio japonicus
MKPSLASVAQFVAPLASLAAALVTPAAYAQSSVTLYGIIDTAVQVANTGGQTVVREASSSVAPNRWGLFGKEDLGAGYSAIFKLENGFNLNNGAMASANTLFNREAWVGIRGPFGQIQAGNNYTPLFRTYVTYSIGELNALAWGNATNNYVFVPVARTANSILYTSNDLAGFTLRALYARGANGTSGVPASLGDTLSAGVNFKAGQFSADVDYLQQRFANTATPTTTTPVGTGRYYLIGASYDFGVVKTAALYQLHRNATGVSTSISSAYATPNHDFYEVNALVRHVLDGSLLVSFGQYFLKSGGDGHATSWALRYDYLLSKRTGFYVGVAGVRNHGTTAFTVTDAAGPGIAVAAGKNITTEILGIVHTF

SEQ ID NO: 10540 - protein, 444 aa, Cellvibrio japonicus
MRFQHYLICTAAVAALAANPLTGQSNMTLEECIDYARRHSSAVALSAAELEQSKADYLQAVGNFLPRVSAGTGASWNFGRGLDAETNTYTDINSFNNSYSIHATMTLFDGLQSVYRLRMAHARREASRLSVREQQELAALGTTEAYYDLVYARQMQELAMQKYEESSRLHRQTARVEELGMKSRPDVLEMQSRMAGDRLALTQADNQCIIALIRLKEKMNFPIDDELVVDDMPADSLSADMAESDSSAGVFARAAHHHPVLLRAKLDEQAATDRLRAARGAFLPSVSVSGGWNTGFSRFLNGSDYTPFSEQFRNRRGEYVSLNLSIPIFSGFSLVSHLRQARAERRAAIVRRGEAERRLYSEIAQAMADRDAALASYRQAKEHTDAMQTAYEAVLQRYEEGLNTAIDLTTQANRLLDARVQRLRAAMTYRLKCKLIAYYGCLSD

SEQ ID NO: 10541 - protein, 670 aa, Cellvibrio japonicus
MVFGSAATESISLKPIVVTADPLSGTQADIPKPVSILQRERIQTHDLRNIGEAVSQELGVSSSDFGPAVGRPIIRGLGGARVRVLEDGVGTMDVSTVSPDHAVAVEALFADQVEIFRGPSALLYGSGASGGVVNVVNQRIPDHIPDKTEGDLYGHYSSVADDFTGAFRLNTGGGHFAWHLDGMKRHTGNYSIPGFAQIEPEPSARKGVLENSDVRTENFSSGLSYIDERGFLGIAVSRFINHYGVPGHDHGHDEDLHDDDVAPGHEEGARIRQKQTRFDMKGALNRPLPGLQKIKLRWGYNDHAHRESGDDGSGTLLLNREWDGRLEMLHQPLNNWKGVLGLQYQNRNLATAGEEAFVPDSRLDSLGMFLLEKLNVGRWIVEVGGRFEHQWTERKNDAVAVSHNIFSISSGATWKFQEDYSLGGSLSYALRAPALEELYSNGPHLATNTFEVGKTTLSPEKTSSIDLSLSKQNGNLNWTLNLFAKRINDFIFLRESDLTGDRLPDRVDIKGALDKDGLLLLNYDQSNANFIGAEFETNIHLLNDRHGKLDLRLWTDYVRGRLSTGGYLPRITPLRFGGALDYVYGPWRGKVDVMQVYKQTDTASLETATAGYTMLNIQLDYGFDWGEMNCSLFVRGSNLLNEEARRHTSFLKDRAPLPGRSGLAGVRVNF

SEQ ID NO: 10542 - protein, 212 aa, Cellvibrio japonicus
MKKFTVAALVLTTLLSGSAFAHEAGEFFMRAGPATVRPTEGAGGTLGHLNGFDVSNNTQLGLTFTYMATDNIGVELLAATPFHHKVGTGATGDIATVHLLPPTLMAQWYFGDSSSKVRPYVGVGVNYTTFFDNDFNDNGKNAGLSDLSFKDSWGAAGQVGVDYLINRDWLIGASVWYMDIDTTANYKMGGVQHHDSVRLDPWVFMFSAGYRF

SEQ ID NO: 10543 - protein, 1117 aa, Cellvibrio japonicus
MKTAKQSIDLEYKGTKKRLNLRTALISLCMFAFVGTSAQTGTVTVKLRNASVKELFSAIEKQTSYRFSYRDAEIKGKGNVTISATNRELKQLLEGELSKLGLKYAVSGNKIIVTPAAVAPSAQPKKVTGKVVDANGEPVIGATVIEDGTSNGTVTDFDGNFTLNIPEGKFLTISYIGYKSQNMKAVSNKIMNIVLKEDSGLLDEVVVVGYGTQRKGNLTGSIANVKSDKLTTAPVSNVTNMLAGQLPGLTVKQTSGIPGSDGSSLKIRGYADDPLVIVDGVEGDLNNIDPTQIESITILKDGAASIYGARAGNGVILVTTKRGVDSKPIITLNTSYTLQGATKMAKPGSSGQRAEWDREAHLNAGLPESQVPYTEEQIQKFYEGTDPDYLNTDWFDAVIRKWAPQQNHNLSIRGGSDKIKYFGYAGFNKQETIMKTNGGDYTRFNVQSNVDAKVTDQISLTLDMMYTKEEQYLTGVGEGLGHYLLWEQLYKAEPRYPVSLPDPTKMSYAGIPYGNPLFATNTELGGYRSTDKDYFRITGALTYDVKQVKGLKLKALLHYNRYVQNFKQFRKQGDFYVYNSESGEYSLFRKSQDPTSLALSAQFNFDLTQQYSIYYENLFNEKHRVTALGLFESINYGDKYFETKRSDFMTSVLDQIFAGNPSTAQNSGWEDEMGRVSWVARLNYGYKDKYLIETIFRADASAKFPKGKRWGYFPSVSLGWVMSEEDFIKKLNFVDLLKFRFSYGQSGNDNVGSFKYLAGYAFDGSYIIGSNIMSGLYSTGLANYLLTWEKMSIYNGGVDFSLFNRKLYGTIEGFYRLRDGIPGNRASSLPSSFGAELPQENLNSIDTRGFEFTIGTAGKIGELSYDVSGNIAWSRSKWVNYDEPEYTDPDQERLYKLTGNWIDRRIGYVSDGLFTSMEEIEQLDYVYKDLNGNSTLRPGDVKYKDLNGDKVLDWRDQTEIGSGTMPHWTYGVNATFQYKGFDLSFLLQGAFDYTTYIDLETAPSVLKFENRWTIEENDPNSLVPRPGGASTNGLYSDYRNHNTSYLRLKNFTFGYEFPKLWLSKLGVERLRVYFAGTNLFTLSSLNKYGVDPEMPEGTPAYYYPQQRTLSFGLNLSF

SEQ ID NO: 10544 - protein, 657 aa, Cellvibrio japonicus
MIAKAETETSLNEENHAFEPMTVIVTRTARSLAELPASVSVLDSEQIMRRQAQSMDDLLQVLPNVDFTSGPRPIGETLTIRGLSSERILTTIDGARQDSSIGHLGRFFIEPDLLKRVDVLRGPASAIYGSGALGGVVTMTTREASDFLAPGQRFGARLKGGYQSVNNESSTSAALFGRASDWDFLGNFSYRDSDDITLASGQELDSSAAENFSGLARVSYKPGAHRLRIGGDYFSTEGIFPANPQTVSDGANENAATKIERRTYTFQYSYDDPAHPWFKPKFNAYRNELRDSRNRLESGRQTTSEFVTTGFNLQNSMDFGDPQDFLMQTITLGVNYFKDEEEGREDGNPRPSFPKANSDVWGFYIQDEISLGQYLSLIPAVRYDRYTLEIEERAGGSTTDEAISPRIGGMIHLASWLNLWGSYGKAFRAPTLPERFTEGLHFRGVPGRLPDNFFIPNPDLKPETVYTWEAGFKSAWEELLTATDRLNLEFTYFDTKADNFIDLKVNTLGGTTQNANLDKARLHGFETGVRYDSEYFFAGASFGRTYGENINTGLPLTNVQPAKGVVNLGGRFSPWGLVFGGRGRFVAKQDRVPPGVLEAAGYSVYDLYATWLPSSAGVKGLRMDFGIDNLTNKAYRRYLSVIEEAGRNFKVALTYQF

SEQ ID NO: 10545 - protein, 1120 aa, Cellvibrio japonicus
MIERNGTGRRRWLATASVIGLIAAAGTAAAEVPNDNFSPNAPPVLADPDAINGIGNIIVDTGGGSVGVCTGSLINPRTVLFAAHCVNDLPDVAYGSQGQGRPISIGFKGDAFDGILNWITSGDYATSYIDQHYNMSRVFYDPRSLEDAQGGGFYEGDVAIGVLDSPAKGVPTWAMLFSPLTGDEDRHVITGGYGRSGTGSLGSVQGIDFRRRAAENMIGALTSLDDINLFLFGDGAQGGLSQNLYMVDFDDPAGTATFDFNIFGDDVALENEGMTAGGDSGGPLILDRAFDTPVVVGVLSLGSRYFNGQGAASYGTTAGYQPLYLFTDWIVANNPYKYVTTTGGNGDWFDPTHWVQMMDPNYKIIDANGNLVTGLPATPAEGVDSRGGEWGSICFFGDCADAGQLADYNHDREDGLSGGAQPVKAEVTGGRTIVDMSGIVAGGAGGAGGAAGSSRGQTASGLAVRHEASAVGAAPGATLPFEIVPGGPGSTNFVPFNVQGDVLAGEKPLFYDVNLMSAGTTTLNAPAVIDRLTIGTSGAVLDIGADGLLFAQNDVGVWAGQLNVDGALLTFEMLLAGGVLSGSGVVDSTVLTSAMGSIAPGGQGEIGELTLLSDLVLASGSRLFIDIGGDQSDRLTVLADSFEGTAGIASLGGLLGLNFISAPKFGQTYTVLTAQGAIDGEFDAVTDISGVLYPVLDYTTTSVEVEIEAASYLDFINPNSRAQRTVGGMLDAARATDYAALGDIYAQTDLLEGEALEAGLESLSPFAAHSGVTLLSAQTEALRGVVDGRIARDRSGGASEGLTLIGSGVEVASLDPAATAAAAGMATRQAQERARWGGWKQGVSAYFGAGAIEGEAGQLRGTLADSRSDDQSAWYVVGGLERTIDALTVGASLAYAEGESDFAEGISTADSRQVQATLYGAVDLAYGAYLGAKVGYGAADLDTERAFAIGGASFRADGETDGKVVSGGAELGFNLTRGGLKLQPNIGLNAYSVDLDAYQETGGVAALSVADQSFDSLQHHIGLRVGGETSRGRWSIKPALDVRWVHELAGDNRNVEAAFVAADGFGGVFAGASNDSEWAEIGGSVAIEGDRFGVTLKAASMVDREDLDYQTYNATVTMKF

SEQ ID NO: 10546 - protein, 712 aa, Cellvibrio japonicus
MSSLTVATTAILASAAPADPPTELPPLEISAAPLAADDVTLRPYAVDRGLRSGRAIVTLKDALGLAPGVLIQDSFGGFEPPRLSIRGSGLQSAPSSRGVQFLLDGFPLTLADGSFNAALIDPQLVDHVEVFRGEAAARLAPAALGGAFNLRVAPLPRPTAGTDALAAQVTVEAGSFGGVRATFASDLPRGRASLLARGSFAALDGYREHSTQQRAAFLAKVVPNGNATLSSRLAPTFSVYHVRARYDVPGPLTLAAATAAPRSVAADVQRDQPRRESDATQLVAQTTVHRDLIQFDAGLSWLRTNDWFRQLRANGIADSQSDDVTFRSALTRRLVTKNGTHQIRLGTMLTRGWRELRRFRNDSGVTGPQFGANQFSATTAAVDLEAMLRFDPLFIATVGLNGLTHRREISDRFTGPTAATTTRSLRRSVWQPRAELLWTPRPRLTFFTAISRAVEPPTFDDLLIVAGTYPNLTQRSQPLLDQCTTTIELGARGAHGRFGWDISGYSARWDDEILRLADAQGLPRGAVNASPTRHAGLETAFHWQLLDGSHRLRLTTTATWSRFRFTDDPVFGRNRLAGAPPHLGSARLLYEHPRGFFAGSTIDWIAGATPVDHANRMHYGGHALTHIRLGWRAAPRPARAGESQLIGDTASKPVRGSARAAWTLFVEVRNVFDRSHVASTAGVLDIARNPAATAVFLPGPGRAFNVGLEWSR

SEQ ID NO: 10547 - protein, 590 aa, Cellvibrio japonicus
MNTIMKLIRYTGLIAALLTTAAGWGQDETDDLGTETVTVVRSYTPTVSDARKIQSLPSLQDSIALQKKPVQYEIHSVPVASTFTPAKGQAAAVERARPEKLFNSYAALGLGNYNNALADFYISRDFDRGNKRIDVGLNHLSSRGDIDGTPLDTDFYNSGLDVTYSQRDRDWEWNASAGMEHRRYNWYGVDTGLLEEGETSVAGIDETQDYFRGSLQGQVHMEDTYFTDAELQVSRFWDAVESAENRLRFTAAFEFPVTEESLGLGLEIDYLGGHFENAPQSQYINDTEIDYQYLIAGVRPGLLMLRDDLKLFLGARITAGLDLENSENNFYIYPSVEASYNLLEENVIAYGGVDGGLDQNSYYEFSRVNPFVSPTLAVMPTDRQYEAYLGLKGQLTPSVSYNLKGSYAAENFKPLFILNPINETRNDEKGYIYGNSFRVFYDDIRTLGVFGELQFSVNRNFSLGLNASVYEYDTETDNPAWNLPNLEGNLTLDYQHDSGWYLGANLFYVGEREDFVSRAQPATPPDQFPAQQLTLDGYFDANARVGYHINPQLSIFARGSNLAGNQYQRWANFRVQGLQILAGVSYKFDL

SEQ ID NO: 10548 - protein, 1652 aa, Cellvibrio japonicus
MNAAAPCTTMPFQTRAMRCAVSPLALMLGLLAYQPALAQEVTIAAGETRTDQVVLDQDGGSLTIEGEGIDDVTGDPLAPGTLAVADNDGVDASGDNVVIQNEGIVQSGDGNDGVNSLGANATITNDGEMTAVGGNSDGINSSGEAATITNNGTMTNDGASGRAISSSGDGAQIVNGATGTITSSGTFADGIFSTGDDANIRNEGEINAVGDGDAFGINAGGQNATVVNENLMSVETEEGHAINSFGNDATVTNLGTINVNELGRSAIQSRNANAEVTNSGVINVNTGSGEIAEGFGILSSGTNAVILNTDEINLNREGAIAIGSTGADADVRNDDGINAIAANTKGIASSGRNAEIANNEIINLGGSNAIGIESSGADANIANNDTINLDGTGTIGIVATGANAEIVNITDAEIEGGADGSNAVQILGANATFTNQGLIETRGANAAVVSVEEADDVTIINEEEAITEGDNSNVFDVVGDRADIDNAATGTIDTSGDNSAGVSVVGADADVDNAGLITTFGAGSNGVVVNGANGAVDNAVGAIIQANEGDAINVAGAGTTAMNAGIISETADLAAGGDNNGMVGAEDVESLINDGEITLTGNGAGMIANDIEGFERAADDPLIMTNTGTINIGGGSGKGMVTNVNGTVATNTGAIMTNGDGATAMQAQADDVVEINEGELITQDDNSNGIDVEGDRANVDNAATGTIDTLGDNSAGISVTGDNADVENDGRITTNGVGSAGIVVSGENGFVNNDGSITTSGSDADGISVSGVGIAIDNDGTISTTQDNAEGIVMNAGDGADAGLDLSDLDGVISNGGFVENDGSISTLGDGAEGILAEGGTIFVTNDDDANIETQGTDASGIVIDAAVGLAFNFGDITTTGDGAKGISVTTSFDGVVDVSDGFGSEIIAGAVNGAAITTSGTDADGMVVDGASALAFNVGIIATSGTDSDGVAVNGDNALIMNGFDLGEEDIELPEGFGITTQGDGSNGISLTGNDGMIMNDAQITTNGSFSSGISAEGNDNEIINNAAINVNGGDNQGIDAGGENAQIINNGAVTVAGLESVGLVSSGTNAMIMNNQTVSVSGDASIAIVSSGDATQIVNNNSIDTTGRDAIGILSVGNASAVINEGAIALAEQGGFGVQAIGANADVDNIGMIATEGFASAGIISSGADSTIDNTGMIATAGENSIGINVSGVGSNVTNTAAVMTTGEDADGIALAGGGLLSNTGNVVVSGIGSDAAALDEDGTTLVNSGMMLTAGDGLAAVVRGRDGDQDVTMAAGAQFIGIFDLGEGAGDSFALERDVLPDDISWRISTFETEEFDVDAAYDAQFVTFGDNQTDILRIEMTAASALNEATGTLADTARGAISNNAGQSGVWASVLGGQQTFGESGTALAYTADHAGVVAGYEGTFYGRDIGFVGGFANGQIATDVSASSVDSESIFGGAYFTEHRENGYYTFNVLAGTQSHDSSRVVLDTTITDGLETAEASFDSTFISAGVSAAGFFRQLGAFELRPSAALNYTLVQFDAFEETGTTGSNLSVDSRTAQTLNGRHQLALGYSSGAFDGELRAGVAGRLSSEDTFDAQITQTGAGGPVTSDPFSFDATDSDTFFGGFVGLGATFAQSGGLNLTGDVEYMFGSDDAEAISAGLSIRYTF

SEQ ID NO: 10549 - protein, 349 aa, Cellvibrio japonicus
MHKKRLAIAVSCIVAGLVSASAAAQSNVTVYGVADAFIGYGKTGDAKFTGVQSGGWAGSRLGFRGTEDLGNGLKAVFTLEYGIELDQNAGLGAAPNLSRQQFIGLQGGFGFIGLGRQYHPGYYVFKYDAIVPVPISPQFALAAAAGSNLVAGGPARVSNSINYKSPNFGGLTLNAIYGLNEVNQDDDRRKGDIAAIGADYANGPLAIGLIYSQVKEHVGDEDKREAYIGGSYDFGVFKLAGSYQRIEDATAAEDTDNVWHIGGTVPIGTSGKFSVAYGRLDADTNDSDADSWAVVYSHSLSKRTLAYAGYGHISNDDGRAVRSPSFVSAANTSPGDTSRNLMVGLNHLF

SEQ ID NO: 10550 - protein, 395 aa, Cellvibrio japonicus
MKKHIILGSGLLFSSLSHASALYFYEVATEDTALAGAGQAARAQDASTLLTNPAGMTRLPDHMVTGGLQAMGGDISYKLDDESGGRKSPGNVMKLFPNASMFYTQRLSDTVSAGIGLYGNYGLGIDFGNWAGDRLIKKSTMVAMTLSPGVAWKLSDRVSIGAATGLNYGFLSLTRNVDGGDENQSDHDWAMNYRLGLLMALTDQTRAGITWTSKTDYHFNIDGKARFPNLPNVEYDLPISAQVRAPQQLMMSLVHDIDKRWSVMGDLGWQDWSQFGSPQISVNGKTSDRTNRLKDTWHTAVGVQYRPDEQWRLNAGVAFDSTPYKSQSDIALSLPTGDEWRFATGAQYQMTQASNIGFAVEYLHMQSSRVKSAAFEGEYNNPWLWFASVNYSYQF

SEQ ID NO: 10551 - protein, 473 aa, Cellvibrio japonicus
MKHPMVKISALSASILAASSAMAGGFDNSSRAFNIIYGDNNVIDLSYGQTSVPMKARIDRLQRAQTSGAAPTQDKISGSGEIIDDFSRPQVGIRYNIMENVTCAAQVEQPFAAQVDYADDSLAYVVTNDSGVPLDSAGNPTGDPASMAFRTAPISTKYESESFTVACGYDFALGTGNLKVFAGPKIQSVNGFFSEDLSPQDVGNNDNLNVTLDGGTEVGYIAGVAYEIPEYALRASILYHNQIDYSATGQNKTFLPLSAVTGNAADDRIYTFDAATKTFTPQTIELAFQSGIAENTLAFLKMRWSEYGKLTNLDVRGSNETAVGALTYQQLATANDQLDALINPNVSMFSNDTLDYSLGLGHRFNDKLTMGASFSGGIKLGGKSDDTPLGADSTTLRLPGDTSHTLSIGAEYSVLPNLKVSGGLGYTFINDYVVQTTFREDDAGNTIDDSSSFRAEFSKTEATSFQFGLTYEI

SEQ ID NO: 10552 - protein, 844 aa, Cellvibrio japonicus
MASSHLFITLASGICLLCSISAFARDSLFNPRLLELDHPADNIDIHQFNRSNTLPAGTYKVDVMINGMLFERQEVKFAQDNPDAELHPCYVAIKNVLATYGIKVDAIKSLANVDDKTCVNPVPLIDGATWLLDASKLALNITIPQIYLNNAVNGYISPSRWDQGINAMMMNYDFSASHTIRSNYDDDDDSYYLNLRNGINLGAWRFRNYSTLNSYDGNVDYHSVSNYIQRDIMALRSQIMIGDTWTASDVFDSTQVRGVRLYTDDDMLPSSQNGFAPVVHGIAKTNATVIIKQNGYVIYQSAVPQGAFALTDLNTTSSGGDLDVTIKEEDGSEQHFIQPFTSLAILKREGQTDVDLSIGEVRDESGFTPEVLQLQAMHGFPLGITLYGGTQLANDYASAALGIGKDMGALGAISFDVTHARSQFDYDDNESGQSYRFLYSKRFEDTNTTFRLVGYRYSMEGFYTLNEWVSRQDNDSDFWVTGNRRSRFEGTWTQSFTPGWGNIYLTFSRQEYWQTDEVERLLQFGYNNNWRNISWNVSWNYTDSIKRSLGNHHDDNNDDFGKEQIFMFSMSIPLSCWMEDSYVNYSLTQNNHHESTMQVGLNGTMLEGRNLSYNVQESWMHSPDDSYSGNAGMTYDGTYGSVNGSYSWSRDSQHFDYGARGGVLVHSDGVTFSQELGETVALVKAPGAEGLSIENATGISTDWRGYTVKTQLSPYDENRVALNSDYFSKANIELENTVINLVPTRGAVVKAEFVTHVGYRVLFNVRQVNGKPIMFGAMATASLETGTVTGIVGDNGELYLSGMPEKGEFLLSWGQAADEKCKAAYHITHKPDDTSLVQMDAICR

SEQ ID NO: 10553 - protein, 1174 aa, Cellvibrio japonicus
MRKFNQNTFKGLALSASVLALVSGTQAFAQAADDGDCPVGQEEVDGECVIQSDGTDGVVNNDPGSQDVVDVTDTGATGQQNEGAIVVTGSRIRRDTYSSISPLQVLTSETEQEAGLFDPSQVLQRSESAAGQQIDATFQGFVLNNGPGSQTLNLRGLGADRTLLLLNGRRLAPAGVEGAPTNPSINLLPGSLIERTELLLDGASSVYGSDAVAGVANVILKKDFDGLELFARGEINPEGSGEDYTVSAAWGKNFDRGFFGIGAEYDFRDAIRLRDRDFFSGCDTHREIDQNGNIYTVGLADNATVLDDSDGLVSVSESECKIAGISGRIFNPFTRFGSVYFPANGNIANFPLDPATGRPFNFGDSTNAFGDQLDTDGDGIRDVDFQNVNTNGADLSQVFLSQQKLYNVMAYGEYTFPGAANITPFFEANYSRAEIFSDNTGAPQLFPSVPDLNQFNPCNFVTNPNGVDCRAVDNELNGLNGTPFALSTGIPTPVTPIVSIQGDRDNTDVVQEQYRAVAGVRGDLPFIAPSWAFEVAGVYSRSEGSSVRRGIREDRLALSLGLDPTADYNGDGIIDNDGDGIADDYNQNEDFFGFFGDPQVIGECNVDALANPELAAPDLAQGCVPVNLFAPSVLGSPVGEFASQAETDYLFGTRSFDTTYEQLIFNAYVTGDLFELPAGPVGAVLGAEYRRDEIASSPDFVASNGLLFGFFADQGAVGSKEIKEAFGELDIPLQAGKPLVQELNLKLAGRVTDDQYYGTNYTYSLGAGWRPIEPLLLKFTYGTSFRAPNLRENFLAGQSGFNTLFDPCAVPDDAFNSLGGGYDPTLDDRDPIILQNCRREGRDPTTVGIDNEGLNTDQFASVEITSGGSLEIDPETSRALTAGFSFEETFGAGFDVSLAMNYFDIKLKDSIIEPSAQFIVNDCFTRSDGQRSAFCDRLEYDTSATSRMLVSDVFAGFLNLNEESVRGIDINTTFGKEITLGGTIVDLGVNVRANHLIERSSLFVNDDGNTTFDDDAGEFGLPKWSGRTTFTADIDRFRLTYQIRYTGPVEQDPDGIDLFADVFGFGPDGEPAINEDGTQFFSDTCLGNGSPSGTVEGDGRFCRDVGFADEQFLHTASLRFREERFSILVGVDNIFNTAPPLVDSNEVLAIANTAIGNGYDYDGREFFASVSFEF

SEQ ID NO: 10554 - protein, 416 aa, Cellvibrio japonicus
MNQTPCVAIGLTLFSQPLLAAEGGFFEDAKASLSARNYYFSRDFSDIVGANQQSKAQEWAQGFILDFKSGYTPGTVGVGVDALGVLGIKLDSSPDRANTGLLPVHGDGRAADEYSRLAPTFKARVSKTELRVGELQPNLPVLTFSDIRLLPPTYQGVSLSMSELDGLTVQAGHLSSSHLRNEGGDGKMNAMLGHVPQRQVESDAFNYAGGDYAFNSNQSSASLWYGQLEDVYAQGFVGFKHSKPIGDWVLSANLGYFTAREQGDALLGTIDNQAFFSLLTARRGGHSFHAGYQAMYGDSPFPRVFANISPLGNEVPTYEFAYTDERSYQLRYDYNFAAMGIPGLTATVRYLTGNNVDTGQGYEGKDRERDIDLGYAVQSGVLKGLGIRVRNAMARSNYRSDIDENRLILVYTWQLF

SEQ ID NO: 10555 - protein, 764 aa, Cellvibrio japonicus
MSDKHNKRAPFPQRHLLASAVGLALLSGFAVAKESAVELGDVTVQGQQENGLKVDKASSPKQTAALLDTPQTVNVIPETLFRQQNARTLTDVLKNTPGISFNAGENGFASGTNNFSLRGFDTSGSIFVDGARDNGSYTRDVFNVEQVEVFKGPAADNGRGGAGGYVNQVTKTPTLESFIAGGASFGFDQYDSEPRRRATLDTNQIINDSTALRLNLLVEDSGVAGREHAEKNSWGFAPSLAFGLGTETRAILAYEHVEMNDRPDWGVSGASVKGMKGDTPYNPALSGVDRDEFYGLKSDFDDTTSDALLVRLEHDLSTGMTLSNQTRWARVDRQARYTVPFQYLGGTQLRTDTQFYDRVNTSLSNLTNLSAQFATGSIKHNLAAGLELTREEAEAGTYAEVNPGNTNIFDPDWERSGPVSKRSRLRERSDVNVDTVALYVYDTLEFTPQWQLTGGLRLEQYDVDIRSRNVQTGAAVGADGFDDREFSIGGKLGLVYKPAQNGSVYAAYGVSTQPPGSYLSNPDISRVNGQAFPGFVDGADPVRAHNYEIGTKWDFFDKRLSTTAALFYTEKKKVAITGRDVGETSDSLKGYGEQVVKGLELGASGKITDSWDVFAGIVFMDSERKHSAYLDEVRRRANPGDYGTAQRTDGDELAFTPKVSGNLWTTYRLPVGLTLGLGAQHVGSSYLGRPDDASRIVANGLYGKLQSYTTFAAMASYEVNQNVDVRLNIDNLTNEEYAVSSNWNGRRVMLGDPRTFTLSTNFHF

SEQ ID NO: 10556 - protein, 467 aa, Cellvibrio japonicus
MNTRQLLSVGIDIGTTTTQVIFSRLELVNRAAVSQVPRYEFIKREISWQSPVFFTPVDKQGGLKEAELKTLILEQYHAAGIEPESVDSGAIIITGESAKTRNARPAVMALSQSLGDFVVASAGPHLESVIAGHGAGAQTLSEQRLCRVLNIDIGGGTANYALFDAGKISGTACLNVGGRLLETDSHGRVVYAHKPGQMIVDECFGAGTDARSLTGAQLVQVTRRMAELIVEVIDGTLSPLAQALMQTGLLPAGVTPEIITLSGGVGECYRHQPADPFCFADIGPLLATALHDHPRLREMNVQFPAQTVRATVIGAGAHTLSLSGSTIWLEGVQLPLRNLPVAIPIDETDLVGAWQQALIQLDLDPKTDAYVLALPASLPVRYAAVLTVINALVDFVARFPNPHPLLVVAGQDFGKALGMLLRPQLQQLPLAVIDEVIVRAGDYIDIGTPLFGGSVVPVTVKSLAFPS

SEQ ID NO: 10557 - protein, 412 aa, Cellvibrio japonicus
MYKTPLASGLTATALLGMAFPPPAKADFLEDSKASLELRNFYFNSDYRQDGANQSKRDEWAQGFLLRYESGFTEGTVGFGVDMLGLLGLKLDSGPERQNSGLLPVGDDKAPDSYSRLGATAKVRISDSVLRIGTLDPRLPTVLPNDSRLLPQTFQGSQLTFKEIDGLTIDAGRLTRNNLRNESNREDLAVTGKGITGERSSDRFDFATLSYRWDNQLTTTYSYARLDENYRQHIVNLVHVLPIDKRQSFRSDLRFARSREDGDTNVDNDAFGARFTYRLDGHGFGAAYQKMSGETGFPRIDGTDPFLVNYVMLSPDFANPDEKSWQLRYDFDFASVGIPGLTFMTRYLRGDNFDRGAKEGREWERNTDIAYVFQSGSLKNLGLKWRNGTYRSNGGSDIDQNRVIVSYTIPLL

SEQ ID NO: 10558 - protein, 180 aa, Cellvibrio japonicus
MNKHLVACAASLLLVAGSASAVSFNAETGRHYTNLGFGLGTNTGGLAISGNWARSDHDGDVLGLGLGFNLPVGPMTATVGAKGIYMSPEDGSSGGAVAIGGGLSYPINKSFSVYGEGYFAPEELTSGMKSYSEANGGVRWNVFRPLTVDVGYRYINMEGKEGRRDNRLADGVYIGAGLNF

SEQ ID NO: 10559 - protein, 746 aa, Cellvibrio japonicus
MYPRFRLAHLPLALLAVSSPFLEAAEETTTEEGAAGDGSYRAEEGALELDDVLVTAERELKQAPGVSIITADDIKKRPPVNDLSDIIRKMPGVNLTGNSASGQYGNNRQIDIRGMGPENTLILIDGKPVRSRNSVRMGRSGERNTRGDTNWVPAELVERIEVLRGPAAARYGSGAMGGVVNIITKAPTEKTHGSVSTYYNSPESEYEGLSKRYNFSLTGPLVQGLSYRIHGNLNKTEADRPGLNSAYTADGGITPPAGKEGVRNRDLNGMLRWDLNSQQTIEIEGSYSRQGNIYAGDRAVSTTGSELLNQLFGRETNIMYRRAGSLTHRGNWDWGTSQLVFSYENTRNRRLNEGLAGSSEGSINAGDMSTSEYDNYALSGEVNIPFNFGFSQVATLGFEYTKEVLDDPFSMSQSATAIPGTATTGRDSEATNENIAFFVENNIHLTDRWTLTPGVRFDNHTQFGSNWSPSLNTSYQLTDAVSIKGGLSRAFKAPNLYQSNSNYIYYTMGNGCPADSPNMGGGCYVQGSDDLDAEKSWNFELGVAYAQNGWNAGVTYFRNEYEDKIVAGLTPTSITTADGQILQWENASKAVVAGWEGTLNIPLMGVDGDVLSWNTNFTYMIENKNKRTGEPLSVIPKFTINSILDWQATEALNLNLSMTLYGYQDPRNLSGTGAQESGEALKQQGGYTLWAVNGNYELTKNWSFGAGINNLLDKEIKREGNASGSGGASTYNDPGRAYYASAKFTF

SEQ ID NO: 10560 - protein, 243 aa, Cellvibrio japonicus
MKQKMAITGAVALAFAATATAAHAQSAGSFYVTTGWFHLAPQDSSDPLKVMNVGGTPVNHEVPNTGAGIDNADTIGLAAGYFLTDHIVTELVAGIPPRFNLNGKGSLEQFGVLGHAYQWSPAVLLKYYFNDAKAKFRPYVGIGASYIWFTGAKITNSAFERGALGGPTSVQTSNQWAPVINAGFTYNFTDHWFGGLSVSYIPVSLTATLTTQRPTPIGTLTQTSQAKIALNPIVTYLNIGYRF

SEQ ID NO: 10561 - protein, 965 aa, Cellvibrio japonicus
MKTFLNALLFCLIIVPASLMAQSTVTGTVTDKANAMPIPSANILIKGTTRGTVTDFDGKFSIEVSQGETIVISYVGYTTQEIVFNSQSSINVALEEDAAQLDEVVLIGYGSTSKQDATGAVEKVDDKEFNRGAIVAPQQLIAGKAAGVRITSGGGAAGEGGEIRIRGGASLSASNNPLIVIDGLPIDQRGGSQGSRNALNAINPADIADFVVLKDASATAIYGSRASNGVILITTKKGSANQPFKLEYGLQASTRRITNTVDVLNASQYKELAEANGITPSSFGNANTDWQDKIFTTGIGAIHNITATKGYENFNFRVNFNHVSQEGPLLGDLYERNGLNTSFVHRFLDNDLKLTLVARAIQDEYNYAPDGAIGEAVRFDPTQSVFDDNGNFTQLGANLAPANPVWRLENTNNRQTIKRVISNFNIDYNLPFLEGLKFNVNAGIDYAENEGANYGPANPNNTDAFPFTGFSSGLNRNTALDFFFNYKTDVESINTKLDITAGHAFQEFYVRSNIDESSGPNVTIDTDINRNALESYFARASFDIADKYLISASFRRDGSSRFSEDNRWGSFPGVSVGWKVMNEDFMEDSFFSNLKLRGGWGVTGQQEIGPNYGYLGLYTPSRNNQANIQFGTTLNGEPIFIQTLRPEGFDEELKWEETTQYNVALDFGFFNNRLTGTVDAYYRETEDLLATVPVPAGSNLTDLITTNVGAITSKGIEFSLNGVIAQKEDFGWDTNFNITFQEQEITKLSLSDDPNFFIQTGGISGGVGNNIQLWKPGYDPSTFFVFRQVYDNSGNPIEGAYVDVNGDNQITEADRQAYKKATPDVFIGFTNNFRYKKLDLNFTFRGSFGNYVYNNNASSNGNINAITGQAGYLANAHSDVLNTRFVNQNLFSDAYIERADFVRLDNVSLGYTIPFSKMTLRASLTATNLFVITEYSGLDPEIGNGIENNFYPRTRDVVLGLNFTF

SEQ ID NO: 10562 - protein, 727 aa, Cellvibrio japonicus
MIPFQRKTVAILAALISHTVFAQTSNDPSLPAISVTADKIDSAAQSAHEARHQSINQKTIIDAEQLNQFGDQPLGDAMRRLPGVSFAGANRAREIQLRNIGREYTQVTINGRRILDGSAERTVQVDRIPSSMVERIEIVHTPLASQDAQGAAGTVNIILKQGSKALPNEVSVGAGALQHNGPVGDATIYYSTGGEKIRLTLTGGVQQQRRSESRDTFLNNASGAAIAGGTLNINKRRFEQANITPRIDININRDNSLVFEPSYLRTTEYRKDTTHRLAADQQGVTRLDDEDRKRTRENKGLYGAWKHQFTTNTEINASFDRQDASESTTRDSRRFDAGVFKEDRQRSDAIDLDLFKTKISATTSLDKHTFEYGVSRSTEERSEDNADRINGTVATPSMNRRYNIKEDITSFYIQDSMRLLPGNLLTMGVRQERASTRTRDFLGTASIKDDNSLLPSISLRQALSASTDLRAGVAKTMRRPSLRNLSPTVSTVGGNSFLRPDSGGNPHAGPESIVGYDVAIDHFIAGRQGLLSAKAFRRNFSDKLENMTALEGTRYVSRPQNSGDGNMYGVELEARLPFNLVGGSRNLSLWSNLTAVKTSLVSKQTGEKRRFLDQPDRIANLGMDWFLPSIKTTLGASTNFSSGYDQHYRLANNTYVRDKVASLKRFDMSARAQLTPQTSINLSALNLFAPKEKRIKQTFNTANALTQTSHVSEPTYRSVYIRLSHLF

SEQ ID NO: 10563 - protein, 98 aa, Cellvibrio japonicus [sequence omitted]

SEQ ID NO: 10564 - protein, 182 aa, Cellvibrio japonicus
MKGYPHLTFYGERSLTRWEFVAGLNACLNTIERLLQNNVAVLREDIEIFKRLAKAFDEDLQVIGTRLSNLENRTAYLEDHQFSTTTKLAGSVVFSASDVYGTDNRKNNAILDYRTNFNFITSFTGNDLLISSFYAGNTPLDISFNLATTDVPTPSGITLPLPTAEGTLSSQFAGNTNNQLKL

SEQ ID NO: 10565 - protein, 620 aa, Cellvibrio japonicus
MKHVLTSASVLALSTTPLLAQDAEYYQLPTLTLYANSTPFELGRTGTSVSVLTERDLDDSPETTLADTLDTLPGVNVVTNGGPGTSSAVSIRGLPSYYAPVYINGIEVTDSSSTQSSFNFGNILPGGVSRVEVLKGAQSALYGADAVAGIVAIDLARAPEEPGQTTKVGAEAGTYNTKSAALSYGAATERAGVAFSATRFVTDGFSAVEADDYDEDDGFAATQLAFDSYFQATPDLRVGLSGFRFDAEGDYDSNDWTAPESGTTDTESYGLRAYAQLQTGAVAHELAYSRYQIDRDTDAAGWSDSFGSTRDKWTYSGTWEFAAGRSLSFGADHSLEEADFSAPVYDAFFSRVGTAENSESIDNTGAYAELAWAFTPDVDAVVTVRHDDHSEFGGEWSGRATVSWRATEALTLRGALAKGYRAPSLYELYSPSYGNDGLEPETSRGGEIGADYAFANGATLGATWFYTEIDDLIQYEGTGYAQVSGTSVSKGLELAGSVPLGDRFTLSGSYTYTDARDDDDDPLARVPRYDLAMRLDADITDQLRAGLSVVHKADYAETWGVTVQDESDDHTVVNAQASYDFGNGFEGYVRIENLFDEDYQIVPDYQTTGRAYYAGIRARF

SEQ ID NO: 10566 - protein, 981 aa, Cellvibrio japonicus
MNTGLFTTRHALVASAAVLAITAAAPAWAQPATRDYDLAAQPLGQALGQVARLSGRQIVAPTALVAGKTAPALKGRYTADQAYEILLAGSGLKLTPVGDMLVVQSGAANAQGEPSPADAERVTEVVVTGTRIRGAAPVGSNVISIGRAEIDRGGYATAQQILQAVPQNFGGGPNETTSGYSSRNGAPNNTSFGSGINLRGLGANSTLVLINGSRPAGGGVAGIFADISIIPASALERVEVLPDGASALYGSDAVGGVVNFVMRDDFDGLETRLRYTSADGDAREAQASALWGKRWASGSITAAYEFYDRDALAATHRGFATEDLRSFGGADYRRAFAAPGTLMVSGQAFAIPRGQNGRGLTAGQLIPGQQNKADEQRDTDLLPAQQRQSLYLSVKQDLRTDARLFGQVLIAGRNFDRRVTGSSQRTVIVPAANPFYLNPLGGTAPVSMQYDFRGDLGTPRTSGRVRAYNGLAGVSQDFGAWSATGQLGYGLQRELYRTDNGVNTYRLNQALADTNPVTAYNVFGDPGSTNRATIDAVRGYSGARTRFETWSAAVRADGPLMSLPAGDLKLAAGAEWRSERFEQQFVTYLSAASRLRTDASYPGTRNITAGYAELRVPLIAATMNVPAIRQLDLSLAGRVERYSDVGTTANPKVGVDWRPTSTLTLRGSFGTSFRAPSFQDLQTGPAVTGYQPIVVTDPKSPTGSSTVLAILGNSPDMGPEKATTWTGGLTYQPRAVPGLTVTAGYFDVRYKDRIANVNANAYNLLIQRDVYADVITEAPSAAVVAAYYASPLFYNPTNIPASAITALIDLENRNLSEVRQRGVDFDIGYEMRSDLGLFTIGLGGTRILALDQKVTARSAPVDVVGTVGNPAALRLRARTTWSQGPWSAAAFANFISDYQNQLVTPRQRVKSWTTADVQIAYRVSDSAPRLAGVRLALTVSNLFDRAPPFVEYRTVTSALGYDGEKADPTGRRIGLEVVKSW

SEQ ID NO: 10567 - protein, 738 aa, Cellvibrio japonicus
MHSGKTGRPSQGRPGYQPFALTALALAVSMQCAQAQESGTAQAGARAEVQLPTVSVRADSVENYGPANKKSVSATKSDVPIADTPQSISVITADQMRAQGAQRVEEALRYAAGVRTEPIVDTRRSTYMIRGFTVSQNSQYWDGLKLPASGGYGGWELEPYSLERVDVVRGPSSVLYGQTSPGGLINQISKRPQAETANEINLSFGNYDRKEISGDFTGALDNDGKVLYRLTALARDSGTQTNMAGDDRFFISPQITWRPTDATSFTAYAQIYHDNAGNSANFLPALGTVTPLANGSKIPTDLFTGEPGFDRFKREQYLAGYEFSHRLNDTVTLRQNLRYGHMYVSYENIGGNGGLVANPPNGPYLLRRIGLRSNESFDLFTVDNQAQIKVRHGIFDHTILTGIDYSRSTFNRLRGLTGNTPAAQPPLNIFNPVYGNFVAPNYQTDEDTTRSQIGFYLQDMLRISERFMLQLAGRYDKAKVDTDTRNLSTNAISRTGSDDGKFTGRAGLLWEGPYGLSPYVSYSTSFEPATAVPLFGGGTPQPTTGKQYEAGLKWQPVGSRSFAQLSLFDLTQANVLTTSPVSGFSSQLGEVRSRGVELEGTWSVTPNFNILASYTYTDAEVTKAGPNAPNAGKTPQYVPRHMASLWADYRLASGFLAGVWLGGGVRYVSKTYDQTNVTEVPGFTLVDLAASYSFARHYTLRLNVNNLFDKTYVAACDSATNCYYGRRRTIIGTVTYRW

SEQ ID NO: 10568 - protein, 916 aa, Cellvibrio japonicus
MSAITKGRNTGSRLALAIHLGLFASACQVQAAEAPVGESQPVTLTFDIAAQPLGLAVLTFADQAGLQVLFDSARLQGLTSTALKGRYSAQEGLGRLVGSAPVEYRFTGDRQVTLTRVSADHDGALTVGTTTITGNTNGKPSDWVYDTPRSVAVISREQIDKRPPRHAADMLEETAGVYTAVNQRDPGLSVNIRGVQDYGRVNMNIDGMRQNFNVNGHQQRNGTMLIDPEFISSIEIDKGSQSGQGGAAVLGGIASFKTLEASEFLADGKDYGGRLRAGSGIGELGNGTYFNGSGVFAFGDERGDVLLGYSERHFGDYRAGTHNDQKLGTHLRARDSQPAAFDDWLNSEVGDTGSVTRSQIVKFGLNLPNDQRVQLSYLESDSDSNDAWAYTAPDNQSVYYQRVSKNNLNAKNVGLDYRYTPDNPMIDFKAKVYYVTTQMDRENAPNAATLTSGNYVAGYTDHFQTDTWGVQGDNTSRFDFDALGHVSRNYGVEVYQDKFKPSTNKVEATNLSGLLPYVEGGTPGGKRTIASLFNNLQYEYGDWLTLEAGLRYDRYRLEGVTGMTLYRRDRFYSSTVGAKRVEEVFDIDREEGQFSPTFGIGIKPGLDWMQLYARWGKGWRPPAVTETFMTGRPHGGSSSERVFPNPFLKPEESRDWEVGVNVFKEGLLFGDDRLGMKVAYFDTRIENFSFLNHSVSLPETSVGGFLGTMAYVNNTNPTRFRGVEYQLNYDMGRAYANLSYTHMIGSNEFCSKNYYMGGAKKNGPSTTRYERYTRPNGTIGLRPVTTYEVLDDDAANNKESCGRIMGNATYMPADRGSLTLGARFLEKRLDMGVRVRYSSGNGENLDSQGYDFMDQALWPQYTLYDLYASYWMTDQLNIALALENATDEAYFVAMGDANNLSLARGRTLSGMLEYKF

SEQ ID NO: 10569 - protein, 202 aa, Cellvibrio japonicus
MIIKYFSGILCITLVLFSSFPLLAGSPYAGLTVGLAYLNDSSLKGSKSGDLSYEDGEAFSYAHGLDFGCFRMEGEIGYQKNDFATYEPGGLDASGDLSILSLLANGYYYCEIPNTSVVPIISAGVGAASVELEEKTDDFSEDDIVLAYQVGAGLGVKVSPSVTVNAMYRYFSTQDASFQEGGNDIKIDISSHNVLLGLKVNF

SEQ ID NO: 10570 - protein, 510 aa, Cellvibrio japonicus
MGKHRGQHRRWAALAFCAAAVTAGPAVAQVEATAPDGGPSLVNPGPEASPAQKARYRANRARRRVIREARSFSGASSAAASLDVQGSSATPPSLPPGTFDLGNGISMILNYTGEFAANPSGGIRQGSAYAGQIAFGLDADLGRLAGIDGGSVHTIVTQRHGRSLAQDDIGFNGSVQEIYGGGQTAHLTLLSYEQKLLDNRLDIEVGRLLANPNFLASPLYCNFQNNATCGAPKSIFKLTNFTYWPIATWGGHAKAWVTDTVFLHAGIYEVNPRDQLPTRNGVDWSTSGATGYLVPVEVGYSTNFGNDPLPRNYSLGAVFDRSDYADPVRDRRGGAQVFSGLDPLTRFGRSAVYARFDQMVWRPDPNGVQGLSVFGVAIGGTGGRQTQDYFLEGGAVLTGTFPGRPYDTLGLVFAMEKLSSLGTANIRAARASLGLGTRNVESLQTILELSYGIQLTPAVRLMPNLQYVIDPDQTRFPFRPKPIPDAFVIGAKLSVDLFTLAGLAKGPGSQ

SEQ ID NO: 10571 - protein, 427 aa, Cellvibrio japonicus
MSTSLPQAARSVRSSRSTTLTTTAVVLASIAPLGNAAGFLEDSKASLETRNFYMNRDFRDGPGQSKREEWAQGFILNLQSGYTQGTVGFGLDAMGMLGVKLDSGRGRSGTGLLPKDSDGRAPDTYSKLGLTAKVKVSQSELKVGTLIPKLPSVQPNNGRIFPQIFEGALLTSKEVKNLGFTAGRLEKTKIRDSSDSEDLALNDKNGRFAGVSADHFDLGGLDYKLSDNLTASYHYSNLQDVYRQHFVGLLHTWPIGPGELTSDLRFARSTDSGSAKAGGIDNKSLNGMFTYSLGNHAVGAAWQRMNGDDAFPYLEGSNPYLVNFVQVNDFAGPRERSWQLRYDYDFVGLGIPGLTFMTRYIKGDNIELAGQRGEGREWERDTELQYVFQSGALKNLGIRWRNASFRSNFTRNVDENRLIVSYTLPIW

SEQ ID NO: 10572 - protein, 263 aa, Cellvibrio japonicus
MSSNFRHQLLSLSLLVGIAAPWAAFAQAPISSVGSGSVEDRVTQLERISNAHSQLLTQLQQQLSDNQSDIDSLRGQIQENQYQLNQVVERQKQILLQIDSLSSGGAAAQSTSGDQSGAAASTTPTADAGTANAGAPVKSGNANTDYNAAIALVQDKSRQDDAMVAFQNFIKNYPDSTYLPNANYWLGQLNYNKGKKDDAAYYFASVVKNYPKSPKAADAMFKVGVIMQDKGDTAKAKAVYQQVISKYPGTDGAKQAQKRLNAM

SEQ ID NO: 10573 - protein, 383 aa, Cellvibrio japonicus
MPFKKLKKNALANPAYVMGVAASAALLGLPAKSNAQSSVTLYGIVDVGIEHLNNTTSGGAVTREVSGNSSGSRWGMRGVEDLGGGLKALFVLESGFNVNDGTLGQSTKGLGANATTTSRLFGRQAWVGLAYNNHQLTFGRQNSLLFEEAIAFDPFGAATRYSTLSVDSAFAGRIDNSAKYTGKFGPLTATAMYSTRYDTGYGTEVPGAELTGRYFGGTLTYATGPFAATAVYEQRNSNTAATNTATERRASAAASYQFGQVKAYAGYRYLRAASAFLPASPIAVANGSQANAANMYWFGAQYYVTPAFALTASAYYQDVHSTSADPWLAVLSADYFLSKRTDLYATAAFAHNKGGSTLGVGGYGTTLANDNQTGVVVGIRHKF

SEQ ID NO: 10574 - protein, 842 aa, Cellvibrio japonicus
MKQRLGLAIVLFCLMPALFAQQKAKQNAREDNASFMFTESQLNEDDDAAQSTSALVTSNNDVYLSNVGYLFSPMRFRVRGYDSQYSDMYINGVQFNDAETGRFSYGLIGGLNDATRNKEGIGPFEINNFTFGAIGGASNINLRASQYAAGSKLTLSGSNRNYILRGMYTYSTGLMNNGWAFTGSLGYRWGNEGNIEGIKYNSFSYFLGAEKVFNDRHSLSLATWGTPTERGQQMAATEEAYYLANSHYYNPNWGYQNGEKRNARIVRQFEPSAIASWNFTIDDNKKLVTSAGFKYSNYGKSALGWNGNAADPRPDYYKKLPSSIFDVWESVPTADELQQFNEVTDNWKNNKAYRQLDWDALYFANKQANALGKETLYYVEERHDDQLAFNLSSVFNHQWNERNSYVAGIAVNTTKGMHYKKMKDLLGGQLYTDVDKFAVRDHGASSSMVQNDLDNPNRRIGEGDKFGYDYNIYVNKQSAWVRYQGNNGGSLNYFASGKIGSTQMFRDGLMRNGRAPLKSLGSSGTAKFLEGGIKAGLNWAINGNHSFTLNAGYEERAPLAYNSFIAPRIKNDFVRDLKTERIIGGDLTYNFNTPWVMGRLTGYYTRFQNQVEMDAFYNDSEARFTYLSMNGIEKEHWGIEAAATFKLTSELSLTAIGTWSEAKYTNNPDAVLTYESENESNLDRVYAKGMRANGTPLSAYSLALDYNVKGWFFNLTGNYYDRVYIDFSSYRRLGSVLDKNGAGVDANGNPVLNVPGQEKLDGGFMLDASIGKYIRLRNGKSISLNLSLTNILNNTDLRTGGFEQNRDDNYKDGDARVYKFSKNSKYFYAFPFNAFLNIGYRF

SEQ ID NO: 10575 - protein, 734 aa, Cellvibrio japonicus
MPDPAHFSPAHSRRLRFFAHVLHLLGALFTQHALAQEARTGNDIAQLPAISVTGREISDLTEGTNAYTTEAMSTATGLTLSPRETPQSVSVVTRQQIEDQGLTDTGAILATAPGISVTRSDSNRYSFSARGFTIDNFQFDGLVSPILSQWNYGSTDMDAAIYDHVEIVRGATGLMTGSGNPSAAVNFVRKRPLREFAATFNASVGSWDYVRGDADISVPITEDGRIRSRLVAAYSQGDSYVHFLDTRRRTFYGVVSADLTPDTVLTTSVEYQHNHSNGFGSGFPLFYSDGSRTDFNRSVANNAPWARQDTEATTYFVDLTHRFTNDWKLRAAYSHTDGRYLMKHVYRGGYPDRHTGIIAAPPAFSNYDGNLDRDDIHLSLSAPFEAFGLRHEVALGWMSIDNHSDIQRYTMVGPAPAIGSFFDWRRAHIQEPSWADTLSPADDVRTKQTGAYLVGRFALAEPLHLIVGGRWSDWKTKQMYFGSRREYRIKNQFTPYAGLTYDINDTYTAYASYTEIFQPQNARDTSGGILPPIKGKSYELGLKAAYLEGRLNTSAALFQTRQDNLAQVIPGSSIPGFPNMQASRAASGAKVEGIDLEASGQILPDWNIGASYTHFTTKDASGNPINTNHPRSLFKLYTTYRLPGALHRLTVGGGVDWQSRMYQAAASPRGNVEVEQDSYALVSLMARFDFNKKLSATLNVNNLFDKKYYDQIGFYSQGWWGAPRNVMLNLRAQY

SEQ ID NO: 10576 - protein, 576 aa, Cellvibrio japonicus
MRQQQLFWLTTLIVGGNIFQAATPLQAQEINLTTSLSSPTLQDSRYLASASMGQMASVSRLRDVKPTDWAYEALQSLVERYGCIVGYPDQTFRGDRPLSRYEFAAGLNACLNALERQIQGNNADVSSSDLATLRRLTNEFQAELATLGTRVDDLEARTSELENQQFSTTTKLNGEAIFSISGATGGEPEGNDAQITFNNRLRLNLTTSFTGKDALITGLQAYNFSAGKSITGTGNVAETLFPNDASILGDSMTNLAWEPQFAGLNPQNLQPSCGNNSLCLYKLLYVRPITDKLTAFIGPKAEVTDAFPAILPFASEGQGALSRFATLNPVLRMSGGTSGTGLASAAGFIYKPNDVIDWRALYGSVNAAIPGNEGFPGTPLGAGLFNGSFIAATQLTLHPNDKLDLGLNYAYSYHQINIAGTGLTGAETRILGDLPLTTPVRFNSFGATVNWRVSPKVNLTGYGAYIMTDQANSGSAYTNLSSWMAGLYFPDAFAKGNAAGILFGQPLYRVDAGNGASLSPANIGDRQTPYQLEAFYRHQINDHISITPGAFVIFNPEGDAQNETTSVFALRTTYTF

SEQ ID NO: 10577 - protein, 858 aa, Cellvibrio japonicus
MPAAYAPAFNTLAVLIAAVLAASPSHAAEADADPATTATTANVAASTLDAVVVTGSRTSTRTVKNSSTPIDVISAEDLAATGQGNLLEALQRSLPSLSQIGGYQSDQESLIRGYQLRNLSPGYTLVLVNGKRRNASAYVSGANGGGFPGHAWADLALIPVSAIDHVEVLRDGASAIYGSDAITGVVNVILKSQAHGGDVSVESGQSTDGDGSRTSVRANVGLPWGEDGFINLSGETTRQHHAIRTRRYIDGYLSYPAVDGSGNLVALRPNNRLPAGAAPNPAEASRNAEANTILSSPSYALKAFAVNVGHGLGESAQFYANATASDRTAQAIQNFRLPATIFTTYKAPGVLSVFPDGFLPVLETKEKQYTGTAGVKGQIAGWDYDASLTGNRSTVRTYTRNSVNYSLPYPGSPTDFYDGKLDYQQGIANLDLRRGFEVAAFASPLEVSAGAEYQHEQYERGAGQWESYTGFGAAAFVGYSTADAVKATRNSKAVYVGAATNITSRWYLDAAARWEDHSDFGSVSTGRLTTRFDFTDALGVRATVSNGFHAPSLGAQFYQATGSCPCGTTLVAQVSSPAAIALGATPLKPEKATNYSLGVTWDPSPAFHLAVDAYQIDIRGQLGQSSQIGYNAQDPARITDNSGTVLSAAQKNTIDALLGSAGISILPGDAFYASYFTNVGNTRTRGVELTLEANQETAWGKLRWSYAANVGRTTIQKVSDIPAALQGLPNINLLTKSSEYALRFRTPSYTQVAGLGWQNGRWRSNVDFTYYGPIKRLNNGVEYKQPPVLVTNLSGGVELGAGWSAALGINNVFDKRTRKVPEYARSATDVASIETTWDSGDVLGNVGAYWFGRVSYRF

SEQ ID NO: 10578 - protein, 429 aa, Cellvibrio japonicus
MTTSSKLMFRASLVAASVAAASSAYSAGFALNDHSATASGKALGGVAASNEDISASFWNPALFVNAKETTVYVSGAYVMPSMDVTNISATDAAATSIPGSSTNNDSVDNTFVPSFYFAKPLSDKTIFGVSLNVPFGLSGDYGDDWKGRFHATETGIQDIALSFALAHRVNDWISAGASVQVHRAEVVLESSVGRVGGEAIGRIEADDTSYGYSLGVALEPRKGTRVGLGYRSEVDFDFKGDVKYTGNSGVLSALAASNIINANVSDSITFPSVITLGLEQDLTPKLMLGLTAIRTGWGSMDGIDINFESNQSNSRLTFGFEDQWMYSAGLTYAYSDKLTLRTGLAMDNSPVTDKYRSARTPDGDRKWISIGGTYDFNDMTSATFAFTHVMIEDVSVDRARTGEDTLRGSLKADYESSANVISLAMNMAF

SEQ ID NO: 10579 - protein, 1053 aa, Cellvibrio japonicus
MRFSHPLRPLPLVIALQAALCSPLWAASFTIPTDSGTTTKTLTAGDTGTVSNGSSLSLGGSTIAVTVTGTSGTATLNNAGTIEQTGTERTIDVTGNGVKLILNNAAGATISAAANDVIRTNKANIVIEINNQGTIWQKSTGSAAGGQAIDSRGITSSSGSLITNGSATNTGATIRADADDAIRAGANTTIKNYGTIISNGIVNTKCPDYLGSACDSAISASDAIDIGGNTGVVIENYGTISGPRHGITADNGVTVTNQRGGQIIGRNGSGVGSDGTGTVINYGTISGQYAGDGKVFQQPGTGGISTTSNGDGDGVDIDGVAYIENYGRIQGLGAGGVDSGGAPNGADGIAAGGGTIINHAGATIYGQSKGILIDDGSDGTAVASGRGTATAAAAAISIVNEGTIIGDKKVAVGLVGTFDDTLINGATGVITGGADATRLGENNSTVAGAAVQMGAGDDVLVNYGRIEGKNGLAIDMGTGNDTLRLLGGVVVGSIDGGTGVNLLETNGTQTFNAGQLSNFQNITVLGGNTTFNYAVTDANNIQVDAGGNLRINGDVTASGNLTVNGTLQAASGETFRNVTVAGDYTQGASGVLEARIGANNISDKITVTGNATFADGATIRPLITGAVADGSNYTLVSAGTLNATTGNLQVNNGSGAFYTYSLQGSGNDLQLVAHRQNGLANAVPQNLGGLANSLNQLASGAFSNSEQGLKLLNSLQSLPNARALSEATSQLAPETNAAAQSTATAAQGSVFSAFDNRMDAARGGEQVAMNKTGLAGGDASGNRFWVQGLASIAKQKARKGANGFDLDAQGLAVGYETDLNKSDMVGISGGYTQAGSDGRDAGVGDDNDVKSLHIGGYFSRTESNYTLDASLAISANRYTTQRLVSIPGFNETLRGKFNGNQIGARFEYGLPFVLDATWSGRWLMGARVSRLDNGSYTETGGASAQTVASTSANSVQSVLGVEFSNKLSASSSATLRARYLHEFADTPAIEATFASGGPAFKIDGVQPGREALQLGLGYRKITASGTTIAVGYDMEVRDKYLGHQLTAKALWNF

SEQ ID NO: 10580 - protein, 616 aa, Cellvibrio japonicus
MNRVFLTPAAVALCGASSLSLAEPVSLVDQVVTATRTAQTASQSLAAVSVIDREDIERSQARSVPELLRQVPGVSLANNGGFGKNTTLFLRGTESDHVLVLIDGIKVGSASAGLTAFQDLPVELIERIEVVRGPRSSLYGSEAIGGVIQIFTRRGDGQGAKPFFSAGYGTHQTLEGSAGVSGGAGNGWYSLGVSSFDTAGINTKRAGTAGYEPDRDGYRNLSGNLRGGYRFDNGLELDGTLLRAKSHNDYDQVFGNSGFNANADGEQNLVGGRARFTPFDPWLVTLQAGRSEDKADAYQDGRFYSRFDTRRDSLSWQNDLTLAEGHVLTLGYDWQKDEISSSEAFSVDSRLNKGWFAQYLGRYGRQDWQLSLRRDDNQQFGVHDTGSAAWGYALSDALRFTVSYGTAFKAPTFNELYYPDYGNPDLDAETSRSLEVGLSGTHGWGHWAVNAFRTNVDDLIGNDPRPAPGRPWGQPNNIDEARIRGVELVLGSQWLGWDWNANATFLDPQNRSGGVNDGNELPRRARRMFNLELDRRFERLSLGASVHAEGRRYDDPANKVRLGGYATLDLRSEYRLNDEWRLQGRIANLFGADYETAYGYNQPGQAVYLSVRYQAL

SEQ ID NO: 10581 - protein, 392 aa, Cellvibrio japonicus
MKKSLLALAVLGTFAGVAQAQSSVTLYGVVDANIEYVNHAQAVTAAGVVIPGSSGSRLAMQAGGLSSNRWGLRGVEDIGGGLKSLFVLESGFAMDTGTLQQGGRLFGRQAFVGLQGNWGKITLGRQYTTIFDMMANFSPTGYATQYEPVVGQLGPNFREDNMIKYTGAFGPVTVEGHWAFGERAGSQTANSAYGVGANYFGGPFGLGIAYDEVKVLTAAEALGGPGNEYAKDKRAAIAASYTMGPVKLMGGYRYGKTDTASSGATLALLPHRDDYYWAGVNYQVTPALGLTLAYYYDKIKEATIGGATVNPRNPQQWQFIADYNFSKRTDVYLSAAYARNASLNWDSIGYVTNPATGAQTSVGYLPAASQTYFITPNSDNQVGVAIGLRHKF

SEQ ID NO: 10582 - protein, 317 aa, Cellvibrio japonicus
MRKLITFLMTLLVGSSVSYANADFGQLTFEVGYRHDDISWNQKAPSYNPNYKLHRKFKDLDIVQIGLKGRTMLGYNFYGRASVNWGWIVDGDYKRTFSTYKSPVIAGFGSEDFVVTDTRRDVIDENFVYDLSIGVGYPFYFSDCTLALSPVVGYALDSQHISVEQGGLGFDSTGAVNPNSYGSYTHKFNSRWYGPFVGVDFNYRPYGETWNLYAEVEYHFARFKGRYHDELLSQHHIHRSKHAHAWTFALGADYDFSNDWTAGLCVKFQDWTASRRHGHHGHVSSNSSDEIINLSGNERTSHKWNSYAINLTFGKQF

SEQ ID NO: 10583 - protein, 568 aa, Cellvibrio japonicus
MCEDFVKLFHQLLVAPAALGLLAPVAANATELNINGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLDVQASFVVGANNFGGDLNYSAKQINEIDQRFPDDGEGNSGSNLLLAAGDAGQVDLTKSDYVNYAKKNFGATVFNYDTQMILNTSFTGKDLLTTTIRSGNFGSSSFGGGPTTLSTLEVASESEGGPNDVFIDKIFYNTPIGEDFTFFIGANVGQDDMLPIWPSVYPQGDASTVLDVLTLNGAPAAYNKNQGPGVALNWEKNGWTIGLQYVANLDKGPDSNPQKGGIATDNSAATGTVQIGYQSEQWAIAAIYSYVQDASVVPYSTSFTQLSYLQDIDQSVNAFGLSGYWQPISSGFIPAISVGWGINTTNFDGNSAPDGYVSTSQSWQVSLQWQDAFVKGNTAGLAVGQATFATDLTGSESPDDGNYAWEGWYSFQVTDNITVTPAVFYLSRPLGQLTPSNESFTQLGGLLRTTFTF

SEQ ID NO: 10584 - protein, 681 aa, Cellvibrio japonicus
MLVTHISILPRTVLFLAVYNLLLTPALAMADVGPPPTDSRHFKTTEVTRHLKDLDAVVVTAIPLRDSYSDLSRPVALLAGERLDEVRASSLGETVAVLPGVQSSNFGPGVGRPIIRGLDGPRIAVLNNGLSSQDVSTVSQDHSPAVEPFLANQIEVLKGPSTLLYGSGAIGGVVNIVDGRIAEAPVGGFNGRAEMRLDGGDKHGNNNMFRIDAGNGSALSVHADGVYRNEKDYDTPKGRQVNSFIDTKSGSMGASFSGDFGFFGLSVARFHDSYGNPGEPGDPIAGDRGSWLLLHQDRYDLKAGLTDPWGEASALRFSLGHTQYDHIEFEGNEVGTTFGKRASEGRVEASFAFGGGWRTAFGVQGGDSTFQALGEESFVPKTNNKSIGVFGLAHNTFGLFQVEFGARGDQVKYDTDNGVTRNYHPGSFSFSGDLALSKQWRLTLNVDHAERAPVEEELFAKGPHIATLAYEVGRADLNKEKANQAELGLVFRNDWSDAKVSTYYSRYGNFIYLVDTGSTWFWDDGQRDLPVRQWSQANAIFHGIEGEATFHLAKNTSGSWDLRVFGDGVRGRLKDGGNLPRIVPARYGAELRWEDVGWRTSLGAKRYEKQNRVAVNETPTTGYTMVDAHLAYHIDVDNIAWEVFFDGNNLTNCDARVHTSFLKDDVMLAGRNYTVGLRMFF

SEQ ID NO: 10585 - protein, 925 aa, Cellvibrio japonicus
MYSFIGFKTQEQLVGSKTNINVTLAESTAELDEVVVVAFGQQNKRKLIQSVSVVDEEALRDIPANSPQELIQGQAAGVQVVQSSGVLGAAPTIKIRGVASVSSGARPLFVVDGVPLNDTDLTSNQGANQGLNPLANINPNDIASISVLKDASATAVYGSRGSNGVVLITTKTGKKGQDTRVTLNMNTAFSESTDTFDMMTADEFRQYAVDAGYFAGVTSPDDLPQGDFDWVDGVTRTGISKNIDASVSGGSEKTSFFISTNFKNEEGFIIGNGLKRTAGRININHEANDWLDVGANIGVSLNEFDRVGAENSTFAPLTSAYLIRPWVEPRDENGQFVNTGFIANTIAIESLDINKSDQSRLTGNFFATAGITDYLSFTSKFGVDRVLIEEQQRSFDINTPGGSASNSYAQDNRVLLTNSLNFDKTFNDVHSVGAVVGISYEENKIRTSTVAGTGFVSDASINVVSAAEKTTTTSGATENRLVGYFGRVNYAYDNKYVVEGSLRRDGSSRFGANEQFGTFYAVAGGWNISEEAFLEDVDWLNNLKLRASYGTTGNDRIGNFSSLALYQGGVIGQYNGSAGLAPDSPGNPDLRWEESKSYDLGFATSLFNNRISLTVDYYNKVTSDLILNVPLSVAAFPGQNSRPENIGEIENTGFDISLTTDNVRNDNFTWTTSINVGINENKVNSLPGAAVDDQGREFVAGSASQRAIVGESVNTFYLIRYVGVNPQTGDAEWLDRDGNVTTTPTASDRVVVGDANPDFVGGITNTFRYKNFDLNLLANFSVGNDIYIDGLRFTDNAASGSFNNRRALLDVWQQPGDNAYVPAFDSPTFSTFDQRSTLQLRDGSYFRMKNVTLGYSIPETFMEKIGLVKSVRLYATATNLFTIKADNLEGIDPEVTDTSSALGQGETFFTPPQSKSFLFGATLTF

SEQ ID NO: 10586 - protein, 201 aa, Cellvibrio japonicus
MKHTLKAILLSSALAIVAGPVVAQSQGDWTVAFGFGNVNPKSGNGTLAGGEADIDDDTRPIFTVEYFIANNIGLELLVATPFEHDISIDGIGGAGSTKHLPPTLSLNYHFPTNSAWKPYVGAGLNYTFFFEEDSGLGDLELDNSFGLSLQAGLDYMISDTGAVRLNVRWFDIDADAELNGSKIGTAEIDPVLIGVSYVHRF

SEQ ID NO: 10587 - protein, 1090 aa, Cellvibrio japonicus
MNVKLKSFFMKKRVLFTLTCLFLWTGMAMAQVSRITGVVVSAEDNEPIVGASVLVKGTTLGTITDMNGRYSINNVPVNAKSLVISFVGMKTQELAIKGGEQRVVMQSDTELIDEVVVVAYGTQKKSSFTGAASTVGAKSIEKRAITNVTAALEGNASGVQVTAATGQPGESSSIRIRGFGSVNASNAPLYVVDGTIYNGSIGDINPADIESMTILKDAASTSLYGSSAGNGVILITTKKGKESGGTGVNLTINQGWSNRAYKDYKKVGIYDYYPLQWEMLKNSYITSGKDVATAASLATSKIGSTLKYNPFVGVADDAIVGTDGKLNSSADALKWGDDLDWEDAAFKTGYRQEYNLSYNTKTEKSDTYASVGYLNDDGYMIKTDFERYSGRLNYNVYPTKWFKTGLNLGVTRTVSNYSTSDSGNSSSYSNLTRFIRTMAPIYPVHKHDLETGAYLDANGKATTDPGEYIYDYEGTRLSNNGRDAIAETEFNQRELVRVNQTGHTYLTLTPVEGLNLTANYSINNIDYRRKVYENPYVGDGTAGPGRLNQMSTRTLTQTFNQLITYNKSIGNHNFDVLLGHENYSYKYEYLYGMKTQETVSGMYEFGNFVNISSLSSYTNTYKKEGYFGRINYDYAHKYYASLSYRHDGSSRFAKENRWGDFWSFGAGWRISEEAFMKDVKWVNNLKLRASYGETGNDNILDSDGDPDYYPYQTLYGLGYKNGSEAGAYFTVIANPSLKWETQISTDIALEFGLFDCLTGTIEYFKKDSKDLLFDVSQPASVGVTSIIQNIGKVTNSGVEIELDYNAFKNKDWSVSVGANATFVKNKIKNLPATMKENGYISGSKKWLEGKSIYEFWLRQWHGVDPQTGDGLYVADVSKYNQGNIGTGDGNITQSQFDEYKKTVVTIDGKELTNSYTYAKYDFSGSSIPDVFGGFNVRVSYKNFDLAAVFSYQLGGQVLDTNYATMMSMTEFGYAQSPDLLKAWKQAGDITEVPRIDNSAAHTTNIGQSYSTRWLTSSDYLNLRSVTIGYQFPKAWLSKVMLKSARLNLTAENLFMLKARQGLNPMANYSGVTYNEYMPSRNITLGLNVSF

SEQ ID NO: 10588 - protein, 726 aa, Cellvibrio japonicus
MTHDYHQIAMDSSQKNKPSPCHIALFISLQFSTFVVPISIAQAEEVVDESMTVYGEANRVYAAGKVSHASNMGMLGDKNFMETPFNTIGYTEKHIQDQQARDISDVISASDPSVFTSGETGLNKESFKVRGFNSDISDVMFNGLYGIAPYYRTSPEMYQRIDVLKGPASLLNGMPPNGSVGGTINLVTKRAQETPITSFTGSYLSDTQFGGHIDIGRRFGTNEEFGIRFNGAFKDGDTAINNQSKKTQLASLSLDWRNDIAFLEADFYYSTERVEGANRGLSIASGLKIPSPPPSDTLLTPSWAYNDSEDKGMMIRGELNVSDSVTVYSALGGSRTDFHSNVPQRIKIIDNEGNLEVSLGSVKLENKRTSGEIGVRSNFDIGPVEHHLVLNSTYFREDKNDSPTGNNNPAPWNSNIYDPVWGPENSVYDNYYGLPVDSTQVSYGIADTLSFVDGKYQITLGLRYQSIDYESGIIMNGMSLPTTKFKESTYTPALAALYKVSSSVSLYGNYTEGLTNGKTAGSSAANAGEAFEPQKTKQTEAGVKLDLDGFAHTFSLFEIKKPNGYQDPDTNIFSFGGEQRNRGIEWGFYGTLSKDYTLIGGIAYTDAEITKATDVTEEGKQATKLPDLQAKLALEWNLPAMRDLTLIGQANYMSEQYIDAQNTQALPAQTILDLGARYNSKIAETSVVWRLSVNNVLDEDYWTTTHYADLALGAPRTVMLSATADF

SEQ ID NO: 10589 - protein, 720 aa, Cellvibrio japonicus
MRAGFALRRALVALALSTGVGVAQPGAAGRGDEAGDRDRTAAHPERGAVANAADSRDDEPPPDVGETVVSATRLPRPVADLPTTVLVVRSDELDRSAATTVDATLRTLPSFATLRRSTSLVADPSSQGLNLRGVAPSAVARALLLDDGVPVNDPFGGWISWRAVPRLGLERVEVAPGGASALYGSFALGGVVALVPRAIEGAAARAEAYGGSLGTRGAAVWAADRAAALGGSLEAEHAATDGYVVVAPWDRGAVDGRASARHTTVSARVLAERATGARLTLGGTFFDEEQDGGTRYTQAAQRTATARLGLAARVGEVRLDAALYGGARRFTQDRARFSADRGSEALAASQEVPSNDVGGWAVAALPPLGAHVVSAGLDLRRVSGTSRERLYPPDPAPSSPVAREASGRQWTGGLFAQDAWSPSAALELAGAARVDLWRDEEGRSGVTRADGALEEVHHAARTRAVFSPRLAARWSPSSAITVRASAYRAFRAPTLNELYRPFQVGTVLTASNPALGPETLAGGEAGPEVRLAGGLSLRATGYWNALLDPLTIVTLDAPLPDGSTRRRVNLGRARVRGLETEVAWHPSGPLALSAAWTLADSRVTSAPGYPELVGKALVHAPAHRVSGRAVLAGGRIGSAALEVRWLGRAFEDDRNTLELPGFATLDAFASRPLVGGLELFAAIENALDRRYLVGRAGVDTIGAPRAIRAGLRFAAGASGR

SEQ ID NO: 10590 - protein, 104 aa, Cellvibrio japonicus
MSAIQGIEGVISQLQATAMSARAQESLPQPTISFAGQLHAALDRISDTQTAARTQAEKFTLGEPGVALNDVMTDMQKASVSMQMGIQVRNKLVAAYQEVMSMQV

SEQ ID NO: 10591 - protein, 685 aa, Rhizobium etli
MALAEEAAGAHELGQITVSATRAHSTVDETPQKVLIISREEIEEQLAISNDPGQVLSNLIPSYSPSRQKLSNAGESFRGRSPLFMIDGVPQSNPLRDSARDSYTIDLSMVERIEVIYGASAEHGLGATGGIINYITRRADTGTINQEASVSLTSDDDFDSDGQGHKVDYSISGQKGDWDYLGAISQQKRGVFYDGDDQLVGIAYPGELQNSTSYDVMGRVGYWIDDNQNIELMLNHFELEGEGDYVPVPGDRDEGIPTRARPGDPVGDPGFNKVTTASFSYSHADWFGNKADVQVYGQQFRAQFATTPFFPYVDSAGNSQLDQTRNESDKVGAKFTLTRNGLLNNRLGITTGLDLLQDETNQDLVHTGRTYVPETQYRNYAPFLQGRFKLTDKLNLNAGARYEKAKLKVDTYSTIDRANVVNDNVVVEGGSPDFSETLYNAGLVYQLTNWAQLYGSYSEGFGMPDVGRVLRGINTPGQDVDTLLQLQPIVTDNREIGGRFNWARYGFEVSYYESNSDLGERLTFNSATGTFEGSREKTEIQGVELSGHMQINDAHRVKLSYSHEDGESDTDGNGVVDTELSGLTIAPDTVQMSWNAGWSRTVSSYLQVSHFFSRGFDDPDLDFDGYSLVDAMVSYKLPAGKLDLGIENLTDEDYFTYYSQAARVSDEYNFKGRGRTYTLGYSLDF

SEQ ID NO: 10592 - protein, 749 aa, Rhizobium etli
MIVRHWRSVLLVCTAATVVLPVSQSFAQSAPATAPQAATEESTVLQKIVVKGKRVAPGSVADTPLATEITAKQLEEKQVTNFDDIGRSVDAGVNYSRGDAGFNLRGLSGARILTTVDGIPIPYISNSSRQGAFALSNANGGGDTFDFDSLSSLDIVRGADSSKGGSGMLGGAIVLNTLEPEDLIPEGRDWGAIVKSTYDSEDRSISGSAAAAKKIGGTSILFQGGYRKGHERDNMGDNDSYGRFRTEADPADFDQHNLLFKLRQELEGGHRIGLTAERFRRDLQTDLREQQGTGRTYMIDNYDGRELRDRDRVSLDYDYEAQSSDAFFSSARATLYWQDLKKESGSKGRTAANVAYGRNNEIENETWGFSGTATKDFEYSGLSHSVRIGLDVGVSSWSQYSWALCPTPTTCPSLNNQAEVPNVDSQNLGLVVEDKIEIGNTGFALTPGFRFDWFNYNPSTGGSFASNTGLARFGDLSDRTEAGLSPKILATYDLTPDVQLYLQLAVGFRAPTVDELYSRFYNPTGRYAQLGNPDLQPEIGRGVEIGANFDTGDFTGRVAAFHTRYQNFIETVTSVDATGFTAFNYTNVSAATISGIEASAAKTFNNGINLHTSLAYAYGRNEETAQRLRSVAPFKAIVGGGWSNETFGFDLSSTLSAGMLTDHLDTPVTNTTDTTFDAPGYAIVDLTGWWTPDQVPGLRVQAGVYNIFDQEYFNALAVRDVNLISTASQPRDWYSEPGRTFKISLTKTF

SEQ ID NO: 10593 - protein, 211 aa, Rhizobium etli
MRVLIAGLMASAFAIAGVSAAQAADAVDQVPEAPVAQDAPVKPAGNWEGFYLGGAGTYNMGDFGSDRHTYGFGGQVFTGYNWQAGQIVYGVESDLGYSGDDVSSGGVKNKYGWNGSVRGRVGYDMNPFLLYGTAGLALGNVKVSDGTSDESKTNYGYTVGAGVEAFVTNNITTRLEYRYTDYQSKDYDLDSGSFSRGYDENSVKLGIGVKF

SEQ ID NO: 10594 - protein, 733 aa, Rhizobium etli
MASRLSKLMASAAIVMGSAGGAMAQVSTTEAGFEPGEIVVTAQKRTQSAQAIGVAVSALGADNLAALGRQDISALAAQVPGLQVNQYSPTVTVFNIRGVSQNDFADSQEAPIAFYNDEVYISALGAIAGMTYDLERVEVLRGPQGTLFGRNATGGLIQIVSAKPTDHLDGFVTATVGSYGQVATEGAVGGPLSDRLRARLSFTTNHGGGYFKNRIGRDLGAAKFYAGRIQLAGDVGEGGKFNIKVQALRNDRDRQAGIYSHRSAFPNALGLGVYFDPSENAWGNCNGCDALGYAEPDRDPFTGALNGPNYFSRTFWAVTARYEQDLGGATLTSITDYQDLRKRYGEDSDMSPATNFVYTTAQDLYQLSQELRLSGEGDRLTWLAGLYGIKIHTKNGYVTDTTGAFGLLERYDSVLNTESVAAFGQLEYKLDDRFTLIGGLRYSRDWKRFDYVHSENGVQDFAFDRRLFPDLAKRRFSDYSGKIELDFKPSRNAFLYASVNRGTKSGGFGTQAFGPFDPATIAFDGEVLTNVEGGVKLTLLNRTTNFNVAGFHYKYSGYQSFELVGVTQIIRNKPARIKGLEFEFTTRPVAGLYLQAFLTLLDGEVRNVTVPSGDVLDRDMPQAPSLSAGGLIRYEFAAGPGRLALQTNWKHDSRQYFSTFNAPVDREPARWVGDARVSYAFDDLPIEAAFFVNNLTDRKYRLYTLDLSGPFGFTQQNYARPRWFGGSLTYRIQ

SEQ ID NO: 10595 - protein, 407 aa, Rhizobium etli
MKRSLRGIDVALFGAALAASVPAFAQSSVTLYGIVDNGLSYTSNQTSTLGSTSGGKSAVKFTPGVWAGSRFGLKGGEDLGGGTKVIFQLESGFNSGTGAQQYSNAMFGRQAWVGVTNPAYGTFTAGRQYASYYQMLSPYSPTTWLTGYYGAHPGDVDGLDTIYRANNTLEYTSPKLYGLTVSGSYSLGGVAGSTNRGSTWSTAAQYALGPIGLAVGFSRINNSTLGGGTWGADSTTTNGGSQIGVSAVTNGYQTAQAQQRFAVGGGYTFNSAWDVTATYTNVQYIPGTGSKFHDTAIFNTGGLVLHWKPMVAWDFGAGYSYTRATRANGIEDSAQYHQFNLSQYYSLSKRTGLYALEAYQHAKGKTLGTNGAGQIIDATATLGDGYNTAPSTTGNQFAFGVGIIHRF

SEQ ID NO: 10596 - protein, 1112 aa, Rhizobium etli
MKLTFIILLATLLQVQARGYAQKVSITARNVSIEQIFKEIKKQTDYNIFYDMQMLQDTRPVSISVKNAPIETVLEQCFEGQQLTFDIEQRTITVKKKPTAAQTISSYANQTSISGKVTDESGLPIPSVSIRVKGSTAGASTDSEGRFKLSVSDKNATLVFAFIGYTTKEIPLNGQTSVNVQLLPEQKNLDEVVVIAYGTQRRASVVGAIDQVRAKQIEDRPVGNLTQALQGASPSLVIQQRSMNPNDNNMNINLRGVGTFGNNSPLLVIDGIISEDVNNMNNLNPNDIESISILKDAGSSAIYGSRSSNGVILVTTKKGKLNMKPVVRFSGILGTQTPEVLVKPLKGYQNALLRNDSYINVGANPIYSSEQISQFATGDSEYFLKGILKDGKQQNYNVDVQGGSTNTAYMVSFGYYDQKSNFKGPDFGTKRYNLRSNFTTDIGKLKLTTILWYDRNEGKAYQGDTGFLIADASRLPVYNNYILKGDNGRYYTNDVLTAGNPLAGLEHGGYTNNINDHFQGSLNAEVEIISGLKAKGLISLDLRPDSRLIRRFYWPVYNLSGDDTPININDNKNYSIEDFSQKSTLQNIQLMLDYNKTFGKSHNVSLLGGFSNESYRRVAQELKKKFVDPDLGIPVEGTIIDPTSSNTVDNTTERTLYSYFGRAGYSYDNRYFAEASFRYDASSRFGVNNRWGFFPSMSLGWRITEEGFFNFWKEKVGDMKIRGSYGSLGNQNVADYQTYTTYDIYNNQYGFNNVAVPGTGYTFGNPDLKWESTNAFNIGADASFFRGKMNVIFDYFHKTTNDILLQPKTPATLGGAVAKANLGAMVNRGWEVSINYRLNHGDFNHNFGFNVGDSWNKVTRFEGDEQIDKSDEIERIIRVGLPLYSYYGYKMAGLFQNEEDIKNSALPVGVAAQPGDVKYVDRNNDGIIDDNDRFVLGHAFPRLNFGFTYDIQWKGFDLSMLWQGVGKREMALRGETIEPFHGGYSFVMFEHQLDYWTPANPDAKWPRLTPPSTASTANNYGKGSDLNIFDAAYLRLKNIQIGYTIPKNVTAKIGMSKVRVFVNGQNLLTFSKNSFVDPESTEFGGSMNASGANSVRNYPLLKYVGGGFNVEF

SEQ ID NO: 10597 - protein, 1105 aa, Rhizobium etli
MPHTPTPLTLKSLLVASTAIVGIAAATPAFAQEEAPTVIPIDSVTPEDLVDSATDVTGVGMFFRNDGFVCSGTLINPRTVLFAAHCVNDRAASDYGDSIAAAWSFGSNSLPGFIDWINNSFGSNPDLAVFNVAQVIYNAESLARPDGFGFLEGDVALSVLDTPAGNIPTWALLFSALPAPTSYTQETGSGYHVNLVGYGRTGSGTTGASIGIDWRRRAAENYIGALASIDDRNIFLFGNAFGDLPQNLYHIDFDDPTRTNPFDFDLFRGDAAPNEGATAGGDSGGPLILDAAGNAGVDEDLVIGVLSGGSRFFGPQVFSSYGTNGFYQPLYLFWDWIVENNPYRYVSTSGADGDWEDPDHWVTMLDPAFRVIDSNGDIVNGLPTDPGEGINDTSDPWGEICFAPTQCLTLETGVLAPYTGEGAAPGATVAADGTSNSLGTITLDGGPLPTRLPVSEDNPEYAVTGGSGSGAEPGPASALPPATLDNGLPGATGFVADNINATSTSIGRYFDVTLSDGTTRLSSAVEIDRLTLAGSQAGLNIAASGNLTSLIEIMHQSGTMNVDGTLSSWGDYLLMSGLLTGSGTINTPYLTNIMGLIAPGGLGEIGNLTVNGNVVLASASGLAIDVSPTSNDRFTVSGTVSLGGMLMINPVDGYTPRYGDTRSFIFAGASADGFTNIHDLPGALRPTFSQANGVVSFAIEADPLVDQAEFTNYFQYNLAAALDGGRAASYDDLAEIYGLVDLLEDGYLTAAFDSFSPYETVMFDRSARAQVNALSAALRGEIGGRFTQAGAMADVLASAELHANGMASSVNLSGAKSLFRQPAAESGSRPDAGWRAFGQIGLIQGDAGLIAGAGRFDIDGGFTLMGIEGFSDSGWSAGAAIGLAQSDGGAPSSVGYVATDVSTTQFSAFAGYQTENWTLAGYVSHSSLESDGQRRLATGSTSRLQQDGDATGGGAEVTYRGWTDQPLRIEPTASLEYTDFSFDAATSTGGAASLTVGSRSVSSLLARVGATGSWNAFGVEPHVYLGAAQDLGDGDGVYSASFTNAPSVAFAAPGALTLDHMWFETAIGFEKTLSNGAVFSFNHQREISRNYINQAVTSIGFSLPF

SEQ ID NO: 10598 - protein, 238 aa, Rhodopseudomonas palustris
MKKFLLGTVALVALGAAPALAADLAARPYNKAPVYAPPAPIYNWTGFYIGGHIGGAFAGDNSIGTGVTAGSDGKFLGGVQVGYDWQFAPSWVLGVEGQYSWLSGTNDAVSFTVPGVAGTYTYADNQRGLASVTGRLGYTWGPALLYVKGGWAYADYTSSLTLSGVGTVSSTSSQDGYTVGGGLEYLFAQNWSGKIEYQYYDFGNVDLGAGFTAKNDQHVVKAGLNYRFNWGGPVVAKY

SEQ ID NO: 10599 - protein, 566 aa, Rhodopseudomonas palustris
MRTSIICVSAVLAVSCGAAEAADLSRAPATKAITAWNWTGFYLGGHLGAGFGTAKVDNPFGPSIYGDTVRAPKALAGLQAGYNWQAHGSPWVLGVEVDASAIDADGTNTCLAYSGQFVSANCRVREHVVGTLTGRLGHAFGPDGRSLMYVKGGGAFLFGNFRMTTNAPDYLNQPSAELDTTRWGWTVGAGIEHALSSRWAVRAEYDYANFGHRGIDGPGGGFLQTPFNPRTLVDTAGAPTQVHQDMHLIKLGLNYYFGRGDGAFDSVARLPVKAPAGTSWSAWQFDVGARYWYSHGRYQNDLTLNTINAQQEHLVSRLTYESEGHSGEVFWRIDSPQKLFLKGFAGGGGLVAGKMNDEDWFPTDPQNATAYSNTDHNKVTGTIAYATLDVGIDLFGDAFGKLGVFAGYNFYRDRKDAFNCRQIALAIPTAFCGSSEGISISQYEDWHSLRIGANGTLAVAPNTKLLIDAAYLPYTHISALDIHHARTDVASKDSSAWGTGRGVQIEAILTYDITPTFNVGVGGRYWAMWATDVETAGFGSPVPTQLLPIRVERYGTFVQASYKFDR

SEQ ID NO: 10600 - protein, 1118 aa, Rhodopseudomonas palustris
MGFGLLFGTRIFAQESGEDREVYELSPFVVDASEDDRYWSSNSVSGTSLNTRIQDLPMSIEVINGQFIEDLGATNLEEALAYSSGIFQSDLSDEIRTLGANRYGSADVSPSSLGGVNGHYDKALVIRGFNVPFQNRDGFRYGGLVAQYGTILGGISDASNIDRLEVVRGPNSLLYGVGVLSGIVNVIPKRPLSAQSREFSVGVGSEGYWRTTIGATGPLSKDLWGGRLNYRFGATLENGDHWTDWRSKDLEYYVGQLEWYTDRVSFLVEGQFADQVEWGIGDQHIHDDVTGAYDKGYRNEYGEQVNWTKSLGGLSESFRITGPDTYHSRREGNLLANLDFTPIDDLTISVGAFLTGSDEETFDVNVSTIVNSGDDYFDEFDLAPLVQRGENTATEDWGKIQAWSDAVVTIRSNDHLKVLQKEWDPRDIRDFRTVRYWWEKRPESTDTEQYRIRLSYDFESRLWGDSMAKHRFLVGRHDIKDDVDVVVGDAEIDWQYAIGKELADSDPLHFRSIDDHSVFRYQGEQLSIPGREFRNVEMWFTGHYALYQGQLLDDKLGLVFGARRDRYQARDRLYDRFDDEAYYGDSYTGQNTAVAPDAWTGVVENPGNETFGFYPAIEGVSEYIPHPDRAEKTTTKMFAVDYELREGLSLYALSSEGLMPNTGVRDGNLEGFPSEKSTSEEVGVKFDLMEGKLSGSVSTYRIERENALWDFYFAPAPARWVGGVVHPTDELAAGEGYDPSLVLSGTLPASYGGSVYFYPEGVELGEVARDVFDDEGNLVGSVSEYPDGLLAVGYGVGGPPNPFNFAFYDYNKLDLPAIDKYGNEIGHTWRYFLEKAFADGGRAERAFTGEFGSENFYPVHYFRIPNQDYLMNPSDRLGAIVSYTDEAKGVDMQLVYSPSRRLQLVFNYAHTEREAITPFLMAEANDPDTGEALGSEYDVWVFRFGREAFGLEEHDVDGDGVVDQVTKNGQPVSMGDVSPNDSIAGLQGVSLYTGSEDSASLWANYDFLEGRLRGLNSSFGLIYTGPAETSIPIGGIAVGENSFGTPATEERYRIDLGLGYRWKFSEADLKLQLNVYNMLDDRKGQSIVYYRNGEEGVQRRTDVYYSRRSLRLTLSARF

SEQ ID NO: 10601 - protein, 291 aa, Rhodopseudomonas palustris
MRSVKILMAAGAASLVASAAMAADMPIAPPPAYAPPPTEDFGGWYLRGDIGFSNQQVKDVRHSDPTRYTQLTSFDQTTTFDTAGIFGLGVGYQFNNWFRADLTGQYRGKSNFKGTDTFTATNTGFPYSGVDNYSASKSELLFLANAYVDLGTWWCITPFIGAGVGAARVTISNFTDVGSNNLFVGAGPTAIYGTYPSYALAGSGSQWNFAWAAHAGLAYKLSPNMTMELAYSYVDLGKGTTASDLRAYDSATRGNSFKFNNITSHDLKLGVRWNLDAGPFYAAPPPLMRKG

SEQ ID NO: 10602 - protein, 721 aa, Rhodopseudomonas palustris
MSSRLALLLSSALISGALASPALARQADTTRVDEVVITGSQVRLPPAYAGDQVAKGARVGLLGALDTMDTPFAVTSYTEALIRNQQARSVADVLQNDPTVRVTKGFGNFQELYVVRGFPVYSDDMTYNGLYGVLPRQFVAAELIERVDVFRGANAFLNGAAPGGSGVGGAFNLMPKRAPTAPLTRFTAGWDGGEQVYGSADIARRFGQNDAYGARVNLGLRGGETAVDGEKRDLTVLGLGLDRRGDRARFSADLGWQDHRIEGARPTVTPLGAIPKAPSADKNFAQPWTHTDERQLFGAARGEFDLTDTVSAWAALGGRQGKEDNVLANPTALANGTLSAYRFDNVRKDSILSTDAGLRAKFTTGAVGHALVASVAQVNLKSKNAYAFSNFAGFASNLYNPVAVAAPNPNFFVGGSKSDPNVTERVKNRSVAVADTLSFLNERLLVTVGVRYQDIQTRSYDYNTGARNGAYDGDATTPALAAVFKPSDKISLYANYAEALVPGKIAPAQVNGVAVANVGEILSPFRGEQTEIGAKYDAGTFGGSISLFRTTQPAEYFEASSRRYTAGGEQENQGVELTVFGQPAPGLRLLGGATWLDAQINRALSATLQGKTPIGVPEFQANLNLEWDVATLEGLTLEGRAVHTGSQQANTANTVSLDAWTRFDLGARYAFEAGGKAVTLRARVENLTDRNQWVAVGGYPGANYLTLGAPRTLRLSISTDF

SEQ ID NO: 10603 - protein, 757 aa, Rhodopseudomonas palustris
MFCHIKRGLAASSSATLLFAALSSPSLAQSAAPASHGATPLPEIDVIQPQRAPHPARRPKTQTAARARRGAATASPQHDAQTTAQTAAQAVAAKHAGFDAARQTIFAPNGASAFDVNHEAILALPQGANATLDKVLLQAPGVSQDSAASGDLHVRNEHANVQYRINGIALPDGVSGFGQMLDTSLVGRLTLLTGALPAQYGLRTAGVVDITTRTDAFNNGGTVSVYGGSRQTITPSVEYGGTAGETQYFVSGRYFGTGLGLENPTSSPNAIHDDSQQGRGFAYLSTVIDDTTRLTFIGGGSANNYQIPNNPGQTPGFTAFGVSNFNSAQLNETQQERNSFGVLALQKSINGLDLQLSAFSRYSTLHFMPDTVGDLVFNGVASDVYRRSVASGIQADGSYRLSDAHTLRGGFQVTAEQSRVTNSSVVLPLDDSGNPLDAPFSVVDSSSKLGWLFSTYLQDEWRVTNTVTLNSGLRFDQMNEYTNANQLSPRISLTWKPTEDTTFHAGYSRNFTPPAQVLAAPTNLALVQNTTQQPAVNASSPVLPERSNVFDVGVTQKLLPGLEVGIDTYYKTARDLLDDGQFGAAYVLSAFNYDRAENVGIEFKGAYTNGNFRVYGNLALARQIATKVVSNQYLFDPDELAYIASNYIYTDHAQLVTASAGASYRWHDTNFSASMIYGSGLRSGFANIGSLPSYTQVNLGVSHDFYLVSATKPTTVRFDVVNLFDSVYEIRDGSGIGVFAPQYGPRRGFYVGVAQKF

SEQ ID NO: 10604 - protein, 1366 aa, Rhodopseudomonas palustris
MAYKRTRSTDIQVLLAGGSRVGARSIAALLRAITVMTTLTVPAMADGGAGGQGGDSSAAGGIGGSGYVGASGGSSGPSTTAGSGGGGGGAAGGGSGGSSGNTDSVGGAAGGTTPGQDGSNGTTAASPSGGGGGAGGNNGNVATAPFSNAANSTGQNGGKGGNGGAGTDSGSTGGGGGGGGAGGVGFVFSDSSSFTNFNVTIQGGAGGAGGAGGSAAAANGNGGAGGDGGTGLLLTSPGATVTNRGTIKGGTGGVAGAAGAGTGTAGAAGAAGAGGAGIVGSGLTIINSGSIQGGVAGDGTQANSITFTGGDNTLKFMSAGAGVRGAIGLATSSTTLTIEQSANSTLDQMITGAGSVAKTGSGVLTLTGSNSYLGGTTISAGTLQIGNGGNTGSITGDIINNASLAFNRSGTYTFDGAISGTGGVSKTSNGTTVLTGTNTYTGGTTISAGILQVGGGGSTGSITGDIINRGSLRFKRSDAYTFGGAISGTGAILQDGDGVTILTGTNTYTGNTAISRGKLQIGDGGTTGSITGGVTNNSELWFNRSDTYTFGGVISGSGRVSQLGPGTTVLTGKSTYTGGTTISAGTLQIGNGGTTGSIANNVNNAGTLAFNRSDAYTFGGAISGTGSVSQLGSGNLTLSGANTYIGGTTISGGTVTVGNNSAFGTGDVKTTQGATVAFGAADYTLANNFVVSGTSIFDIQTGTTQTITGAVSDGDTAGIIEKNGGGKLILNGRNTFSGGTIINAGTLQLANSNMLSATTAATVASGTTLDLGGFNQTIGSLAGAGSVALGAALLTTGADNSSTNFSGTMSGTGGLTKQGTGNLILSGTNDYTGPTTVNAGTLSVNGSIASAVTAASGGRLGGSGSVGSTTIASGGTLAPGNSIGTLTVNGDLTLAAGSSYAVEVSPTASDRTNVTGRATLAGTVQASYATGSYISKRYTIVNAGGGVAGTFGALVDTNLPANFRSALAYDANNAYLDLMLAFVPPTAPDYGNGLSRNQQQVVGALVNSFNVAGGIPTTLGTLRPDGLSQASGEAGAALQQSLFGSADLFMRSVFSNALDPTDGSAGRECAAPGSQAGPRDACAALPPAAASASRWSAGYGGTLRVGGDASTGSHDTTSRVAGAAAGASYQVSPQARVGFALGGSGSSFSLAQGLGSGSSDSFNAALYGRYQLGPSYLAAALGYVWQDATVDRTVTVAGGEALRARMHPQALTARVEGGQRLQVSGIGVTPYAALQTTTMFLPTFGETGTSVFALDYAGRQSTVTRSELGARFDDEVFIDGRPLALRARAAWAHGWNTDWQAAATLRQIPAAQFNVYGAALPGDSVQVSLGASLGLGRGWTVSAAFDGEFWKHAESYAGRALVSYQW

SEQ ID NO: 10605 - protein, 776 aa, Rhodopseudomonas palustris
MPDRSDARRRAHQAFLTTSCGVAVRVAVGSAVCWTALAQQIAAAQSQSQQLPSVTVDAPKRAVATRSAPAPQRSTNAPIRRQARRTPVAAPPSPAERAAAAAAQLNEAKLGYRAMPSPTTLRSGASPLDTSQVVAVVPEQVLKDQLPRNLDDALANVSGVTQTNTLAGSFDAVIRRGFGENRDGSIMRNGMPLVQGRSLGPTVESVEVLKGPASLLYGIQSPGGVVNTISKRPELYQHGSLTVIGSTFGGGHNGANAIFDLTGPLGTQGLAYRVIGSGLDEDYWRNFGANRERLLAPSLAWYGESTTVQFSYEHRDFSYPFDRGTAFVKGAPLAIPATRRLDESFNRTWGQSDLLQASVEQRLGDTWKLTTAYSYNREIYEANQLRITAVDPVTGIEKRSNDGTHGALAYVGYGTSYLRGDLWLGGLRHEVLIGGEAQRRLIYRQDLIRQATPTFNFYNPVYGLVGPGTTVSASDSDQTDRLETRAVFAQDTLHLTDRFSLIGGVRWMDYEQLAGRGRPFTANTDLSGNKLLPLGGAVFKLTDQISLYASYTQSLQPTSSIAPLTGGFVIGSNIAPEEGTQYEAGLKFDLNKRLSGTLAVYDIDKKNVLVSQFNAATGLNEYRAAGKVRSRGVEFDVTGRLTDHWSTIASYGYTDAIVTDDPALSGKRLQNVAMNTASLFLVYDFGTALPGRLRLGGGARYVGDRPGDSDNSFVLPSYTVADLFATYEVKYGRTPVIYQFNVKNLFDKVYYPSAVNTLNVALGDARRFSLAATVKF

SEQ ID NO: 10606 - protein, 229 aa, Rhodopseudomonas palustris
MTKFLTAVSALALAAAFNLVSANADAADLATRPIYKAPVVAESSPWMIRLRALGVVPRDSGYVDQIAGSSLKTSDAIVPELDITYFFTKNIAAELILGVTRHSVSGAGSLTGIDVGKAWLLPPTLTLQYHFTDFGAFKPYVGAGVNYTFFFSQSAACCTVIDSHLKDAFAPAVQIGFDYMIDQHWGINVDVKKLWLRPEWSGTLANGTPITGKVNLDPWLIGTGITYRF

SEQ ID NO: 10607 - protein, 758 aa, Rhodopseudomonas palustris
MTPAVLPLGRNRRLLSSVALVPLLWPVDGLAQTASANPRGLDPIVVEGQTVRAAKPRATANAGSSRQRRAAARPVATPAPAPTQPTTTAATAPTFNLGTPSSTGSRLGLTPLQTPASVEVIRAETIAERGQHNVIDAVTQNATGFTASPRPGNGGLAFTTRGFTGNGTVMSLYDGTRLYVGSGTMTFPFDTWTAQSIEVLRGPASVMYGEGAIGGAINVISKKPLDVARNEAEISLDTNMSRRLAVDSGGPINPNVSYRLAAIGNMSDGWVDRDKNSNVAVSGSVRVQAADNLAFTLSEDYADRSPSGYFGTPLVNGRLDEALRFQNYNVDDASIRYRDNWTQLKTEWDVAEGVSVKNVTYYLSTHRHWKDVESYAYNPLRGNIGRSSYIEIFHDQEQIGNRFDTTFKGHVFGLANEFVAGFDVNRIAFTHTNNSPYAGTSSVPAYNFDPGYFLPVSPTRPSFHTLTTQYGVFAENRLSLTDQLSLIGGIRSDNPTVQRTDFLSPSNSFEKTYSAPSWRVGAVYNPIENLSIYGQYSTAVDPVTNLITMTGVNRDFSLSTGKQVEVGIKQQLAGGRAEWTLAAYHIVKNNLLARDPQNPANTNPLQIGQQSSRGIEASAGLKVTETIRLDANVAWLRAKYDDFTQVVGGRAVNYAGNVPNNVPQIVSNIWATWAFAPGWSANAGVQLVGDTWADDANTLVRPAYNVVNAGLMWKPDTRQTLALRVYNLFDTVYTTSGNTTMWQLGMPRTAELSYNVKF

SEQ ID NO: 10608 - protein, 707 aa, Rhodopseudomonas palustris
MIVRPVLRPVRPRRVAALLACFAASVAQADDTPADAAMLPALNITAAHDSPQHLTDEISAGALGTRRQLDTPFSTTIVTSEELEARRPYKLGDVFANDASVSDNSGAYGAWASYMTVRGMQLDWQNGYKIDGLPFVAYGITMPYEQLERVELLKGLGGFLYGFVTPGGVVNYVTKQPGAEPVRSVDVGYRSTNIWTEHFDLSQRFGPNKMFGARVNATHEEGTAYNDGNIRRDSVSLALQANLTRDLSVTFGALYQERRTTGQTPSIFTGGYAGGVLPATISGGTTDLGGKDQYLNTNLQLYTAGLQYELAPDWRVDVAYSYSKAARRRNESTLSLLNQAGDYTDSRYVGMEDHRFSQWRAMVEGKVRTGPFSHQIVLGASWQKQANDYSANSEFVPLGSGNLYSPNPYRYESPHGFVQYRTSEIVQKSLFASDTVQLTERWSALAGVRYMNYEQRSFQPSGAEDPGYRQNGVVTPTFAVMYKLAPTTTAYASYAESLEPGSRVNDIYANGGQLLKPLRSKQYEVGIKSEHARWSGTAALFRIERSAEYANAANVYVQDGKSVIQGLEFGARAKFGARWNAGVDAMLLDAWYANGVGNNGNRVAGAPRFVLAGELGYAVPGVPGLTLGVDAKFTGATPLRAAGGIDAPGFLVVNAGARYLTRIGRHDVTLRASIDNVLNRRYWEFQYADYVKPGDPRTVSVSAKFDF

SEQ ID NO: 10609 - protein, 742 aa, Rhodopseudomonas palustris
MSSAFPRSRRHLLVHATALVSTCLVVLPAAAQSRSSDSPLPPVTVQAPDQAARPAPVRPKPRAASQSTRAVRSAAPAAQPSAAPAASEVARGPALTVLTVQQALRDIEQTPGGVALVPANAYRNSTVSNTIKDILDYVPGVFAQPKWGDDTRLSIRGSGLSRNFHLRGVQLYMDGIPINTADGYGDFQEIDPTAYNYVSVYKGANALQFGANSLGGAINFVTKTGRDPFPNGVSVDAGAFGYRRLQANAGGVNGAWDGYVTASAQAADGFRNHSDGQAYRLSGNVGYQITPDIETRFYLNANSVRQKIPGSVTKDVALNSPQTAAANNIALDQQRNIDTVRLANKTTIRFEDTVVDFGAFGVDRHLMHPIFQWLDYRYQDYGGFAKVTDDRIIGGYRNRLVAGVNLLNGRIDNKQYVNVAGNKGALASSSLDKSTNTSVYIEDSFYFLQNVALVGGTQFLHATRDRRDRFLSDGDQSGSTEFNLWSPKGGLLWQIDPNWQAFANISRSAEVPSFGESASGPGIPFIPFTSIRPQRATTYEIGTRGRRPDVTWDLSLYRAEIKDELLCLYSAFGNCNVTNADRTMHQGVEAGLGVTLFKHLFERAGAPDRLWLNMAYTLNDFRFDGDAKFGNNLLPGAPRHYLRAELLYKNPNGFYMGPNVEWVPQAYYVDSANTLQTEPYALLGLKAGIDNGGPYSIYIEGRNLLDKSYIASASIIDKANANSPLFEPGTGRAVYAGFKARW

SEQ ID NO: 10610 - protein, 809 aa, Rhodopseudomonas palustris
MSSTRLALICAASLAWSTASPREARAEDVGSLLEILEESVVSGASRSAERESDAPAMSSVITGAQLKLFGIRRLADALTFLASGVFAHDRMSVPEVGARGVALTRDSNSHVLIVLDGMVVNEQGGGAVFLHDIPIEIVDHIEVVLGPGSVLYGAQAMLGVINVVTKKAADHQGIRATLTFGASPPLDESGDIRAPSVEGVGGEGTATLGFGRRFTLLGQPAGVVAAVDVHRFEGPEVSFPKQRLPVLADGVSVMDLGSHAEPGFWGGTVEEQWFRRKAGAFVRLDVGDLSAVAQATRSSWAAPFMDLHENRVGAFDDARNDNTQSLVLASVRYRARLSERIEGVARGYFGYSRIERSRYVVGHDPLVPHVPLDVLDPEQCPRGPSGPCRKEALFLSRWVGLELQARYDWAGDGAFTTMAGLDGRLRTSAYEFVAFDELTGKSYGSDPARTRWHGGGHRLEDEAALGAYVQQTLRLFRPLSLNAGIRVDLDSRIPLEYVANAISPRAALILTPDERVSLKLIYSSAFRAPSFVELYTVSGRLLPNPDGLKPEKVSSLEAVSSFRSGAYSFTAGGFYSDWRDVIELQLLRAKAPSVSRYNNVPGIENYGANLGFETSFLERKLRVGVNSTFAATRRRMSAEQITRNARFGTGDDVPITVAPQVYGNARVSYEVGAGAVSLAAAYMGRRIADQAYYGGDPSNIAPRPEVPPQVELRAAVTGAIPGVKGAGYTLGGQYAFSAHEPYVVGPNQGQPRYLVESGPTADFALKNRLTLFAGIELHLDDDAAAGSPAAAARPSSIATVGRASHGASP

SEQ ID NO: 10611 - protein, 283 aa, Rhodopseudomonas palustris
MSNFFHRDATKLQKGFRHISSGYVVGASTQPISDKVVDFAFCQMFGKSKDYHLTELSSHIYAASVHTKYEKLLHRFKFSNKKGFILTKLPEQIPVILDAQLSYSSSRNSMTTKHAPNPSSRGKWNNHCVAGEVGGYVPMVIDNPMLDEFSPFMKLCLVFVQQEDFKETKGGDENRNFQSAHFVNLSLPIGVKFEKTNKYNIYNVSLVYQPDIYRDAPKSRVFLPSKDTTWSTGATNLARQALILDGSNHHHLTDSFEVFCHGAFELRGSSRNYNIDLGGKYKF

SEQ ID NO: 10612 - protein, 428 aa, Rhodopseudomonas palustris
MKLGKVIALMLVLLPFSMGAQEVDQSVEKHIDSLATEVTTLDKVVQKLSKFKVSAYIQGQYQYGQEDATLKVGDKNENLDKGFNRIGIRRGRMKFEYNDGIGTGAVQIEVNDKGVSFRDLYIGIKDPWTKRSQLMAGVFNRPFGYEVCYSTSSLESPERATIIQYFFPDERDLGAMLTLRTKTTSPLSFLRLDAGLFAGNSINRETDSRKDFIGRLGAEKAIGDWGKWGAGFSYYHGFVYNPTTEAYEMRGNHFVKRDMGETGTYMKRQYLGLDGQFSFLSSLGKTTLRAEGLIGTQPGIAGSSKSPNYSTRPENLPENSLFKRPFLGYFFYLVQDIGASPFSAVLKYDVYDPNTKVSGNEVGAENSFTSKTDLAQSTIGIGGIYNFNKHIRLQAYYEFNFNEKSNLVKGYENDRKDNVLTVRLQYKF

SEQ ID NO: 10613 - protein, 1015 aa, Rhodopseudomonas palustris
MSAVAIALGLAGIGQAAASNYIEQGKAGDAASWRSSEFNAEWGLGAIHADEAYAAGYTGKGIKLGIFDQPVYAKHPEFSGTDKVINLVTEGIREYTDPYIPVKKGDPFRYDGTPSVDSDGELGAHGTHVGGIAAGSRDGGPMHGVAFNAQIISAENGDPGPEDGIILGNDGAVYEAGWHALMDSGARIINNSWGIGITEKFDQGGKDPAYPHFTVSDAQAQFNQIKQILGTKPGGAYQGAIDAARSGIVTIFAAGNDYNLNNPDAMAGLAYFVPDIAPNWLSVASVMKDPASANSVPYTISTFSSRCGYTASFCVSAPGSRIYSSVIEGNSLETLTTDYANYSGTSMAAPHVAGSVAVLMERFPYMTGEQIAQVLKTTTVDMGDPGIDALYGWGMIDLSKAIHGPGMFYTVEDIPEEFRVPDPDGVAYGSSQFIADIPGIGEEVEAGTKLARTCSDIQCAMDVWSNDISGHGGLTKQGAGALWLTGTSTYSGPTLVNDGLLVVNGSVTSDVTVQQQGVLAGNGTVGSLTAARGGTVAPGNSIGTLNVNGDVTFQPGSRYAVEVSPDGRSDVINATGAIALNGGEVAVSLENSSNLLSLAEVRSLLGQQYNILSAADGITGQFDSVAPDYLFLGTSLGYTGGQVTLDVARNDTTFASIADTANGRAVAGALETLGAGNPLYESLLSTGSVAQARQAFRQLGGQIHADIASAQINDSRYLRDTLNERLRQAEGLTSVSPVAADDGGAWAKLLGAWDHASGDESATGYQASTYGVLLGLDSAYADDWRMGVATGYTRTSLDGGYGSSADSDNYHLAVYGGKQLGELALRAGAGYTWHRFDTSRSVRFGSQSDRADAKYNARTEQFFAEAGYQLAAGMVNVEPFANVSYVNFENNRINEQGGATALHGDKQHTDATFSTLGLRSGLEWDATAETTVALRGEVGWQHQYGELDRATGLKFRGSSTPFVTNSVSASRDGTVLKASAEVAVNRNAHLSLGYSGLISDNYQDNSVNAGFSWNF

SEQ ID NO: 10614 - protein, 167 aa, Rhodopseudomonas palustris
MSLDAFTGVDMSFGPVQEVYVASLFEWDGTDFKTNAFSVNNQKIGLGSDVMVPWFGKVGLNLYGTYDGNRKDWNGFQISTNWFKPFYFFENGSFISYQGYIDYQFGLKDEYSTASNGGAMFNGIYWHSDRFAVGYGLKGYKDVYGIKDTDGFKSTGFGHYVAVTYKF

SEQ ID NO: 10615 - protein, 770 aa, Rhodopseudomonas palustris
MRGASQDVTNFQLPSRSQTRLRQLQVFFFGAVSTFSLVAPFGSVQAQTQIPAVSVEAPAQRARPAAVASSRRSATTRSSRTNRHAPAQQAAPTQSASNGATGERANGPVRGFVATRSGTATKTDTPLIETPQSVSVVTTDQVRNQGAVSIGEALRYTAGVSGDVNGGSDTRFGALQIRGFDTTMSGLYVDGLRIPSSNYVHFNGLDPYGAERLEVLKGPSSAMYGGSGTGGILNYVTKLPTAQQFGEVSVSGGSFNRYQGQFDMGGSANKDGTVLWRLTGVVRDGETQVDFTKDNRVFIAPAITFKPNEDTTITILANYQRDRAGWGLQFLPASGTVWPNNGRTIPVSFFAGVPSFNAFNTEIATAGYQLSHNLTDNITFRQNLRYAYQHNEEKVFYGGGYTDEAAGQLARFGSYSNSYINSFAVDNQLQGKFTTGILSHTTLVGIDYRNTSFRDTAFGVTTSAPEINVFNPVYSYDWTIGAMSDNTGVKQSQVGLYAQDQIRLGRLSFQLGGRQDFVTTQVDSGIFDTSVSKDASAFTGRAAVMYNFNNGIAPYFSYSESFLPVLATGPGGQLLNPETGVQYEVGVKYQPIGWNALFTFAAFDLTRDNVVTYAPPLNVAEQTGQVKSRGIELEGTMSLADGWNLRAAYAYVDAMLTQDPVNVGKAPVTVPLNRASLWSDYTLQNGPLAGLQFGAGVRYVGATWGDDANTFKVGASTVLDALVAYTRDNWRLSLNVANLADTRYVAACYSLSGCFYAEGRKAIGKLTYRW

SEQ ID NO: 10616 - protein, 772 aa, Rhodopseudomonas palustris
MGGTHHAAAVASPDRVTPGEEIPPMKSRSDELKLGKFTTLCSVLAASPAFAQDAAPPAATADHDKELAPIQVKGAAERSYKADFSSSVKFTAPLVDTPKSVTVIPPELIHDSGAATLTEALRTVPGITFGAGEGGNPLGDRPFIRGYDTQGSLFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVTASYYHLSTDDLPDGGIPYFYTASNKPANVDTIYPANVDRHNFYGLVDRDFRKTTSDIGTLRIEHDITPSLTVRNTTRYTESTQDYIWTQPDDSQGNVINGRVWRRNNNRNSAINSIANQTELFGEFRTGPFKHSFTTGIELSREWGKRDSYSVATGTGKICQQGIGAASGYNCTSLWSPNPNDPWAGSIRRNNDYAHARTVTKSLYGFDTVELSKHWQVNAGVRIDDYSTRFTDTRANGGKTYTRDDTLVNWQLGLVFKPAPNGSIYASYATSSTPAGALLGEGAETQSLTPGRGGVGSNADQLAPEKNRSIELGTKWNVLDDKLALTAALFQIDTTNARVTLPNNQYAMVGSKRVQGLELGFSGRLTRAWQVFGGYTYLKSELRENGKNTADKGHQFPNTPKHSFTLWTNYDVTPKFTVGGGAFYMSKVFGDTANLRAVPSYWRFDAMAQYRINKKLDVRLNVNNLFNRTYFDQAYPAHYASIAPGRSAFVTLNARY

SEQ ID NO: 10617 - protein, 976 aa, Rhodopseudomonas palustris
MQSRIFALFGAVSTLALSLAHAGVANAQASRPTAAAATSVEEVVVTGSRIARQDYTAQSPIVTIGKQILQAQGPTSIENTLNQLPQFAATSGSTSASQAGGGRANANLRGLGTARTLVLLDGRRLQPSDPLGAIDLNTLAPSLIDSVEVITGGASAIYGSDAIAGVVNFKLKHDFEGLEIDAQYGQTERSDGETADLNATVGGAFADDKGHVMLSASYMDRQRVNRNSRAFFKDGGITSVLPSGLIYADAANLPTQAAINGVFAKYGVTINVPRNATYSQNLDGTLFTISSPILNYRFPADGPYTITSNGQVAVPLGEAAPLQQPLKRQTLFGQVNYQLNDAVEAYGQFNYAHYVSNQSGYGRNQAITRDVYLPVTNPFLPADLKAIAASRPNPTAPLLFYFNTGRYSPDIAQQTYNVAQALGGLNGRFDAIDGTWDVFASYGRTEQNALLGGYIDRASFLSLVNAADGGKSLCEGGLDPLALTAPSKSCLTYLLREMHETTTLQQTNAEANVQGRVLALPAGDLRFAAGLSYRKNSYAYSPDAARLTGTVLTTGLSKATEGETNSKEVFLELAVPLLKDLPFIRKLDLDLAYRYSDYDTVGGVHTYKASGAWEINDAVSLRGGYQHAIRAPSVGELFRPSEQSATTVGRISAGLGDPCDIASAYRTGPNAVQVRALCIANGIPLSVIDAHKFAGTSVQSDVAGNPDLKEESSDTYTAGLVWRSTFQQPLLRRLSASVDYYDIKLTDAIGLITGDVIAQRCFNGQGNANPTYDPANYYCKLIHRGSSGGFSSITTPLLNLAGYRTSGVDLQVDWGAELAAFGASEQAGSVSLNVLISHMDKYEIQTLAGAAYVNYAGTIGNAQISADAISHPKWKAITSLGYHVGPIDLSLRWRWVEAMGNAANVGSATATARGVKAMDYFDLTGRYQVNSTVELRAGALNLADRQPPAWTGESATDTALYDMLGRRYFLGVNFKF

SEQ ID NO: 10618 - protein, 561 aa, Rhodopseudomonas palustris
MSRILVTVATLATVISPAAAADMPRFPPLMPVAPVSWNWTGLYWGAHVGGSFGSSSFSDPAGPGLYGGSVRSPAALAGIQVGYNYQPNANWLIGVEADLSSMNAKGTNTCMASSGLFISSNCRVRQDALATLTGRAGFVTGPGGRTLLYAKGGAAYLSERLDIAVGYPLGNLTAANDGRWGWTVGAGIERALAPAWSVKLEYNYADFGSRDMATPDSERLVPGVGSFATPQGTSRVEQDLHAVKVGLNLKFGGDVDARFDDYHLRGTQAGVDVVERGAVEVGGRVWYSSGRFQKDLGGTFDQGNQNFLISRLTYQNTAVSGEAFGRIEGPYDTFLKGFAGGGTLLTGHMNDEDWIASDGIPYSNTLSDPVRGSIAYATVDVGYNLVHGPDYKFGGFVGYNYYRENKSAYGCVQTAGATSLVCAQPISDAVLAITQNDTWHSLRVGLNGEIGLGRGVKLSADAAYLPYVKTFGTDTHLLRTDVADKVSPSQGTGQGVQLEAVLSYQLNSAFSIGAGARYWAMWATTNAYTNIFGTECPCQTQPARTERYGTFLQAAYKFDSL

SEQ ID NO: 10619 - protein, 510 aa, Rhodopseudomonas palustris
MKTMKLAAALAVGTILTSGTAWAQDIIEFNGTNLGSEQANVHRNVGQSFVISEARRLDTFVLRNQTGNQSTGSFDVEVRQLNGLVASSQALFTRSLPAEIRNGDVTISGINTILPSAGTYIIILANASGSVIWAGEGGPRFPDGDALAANPSTPLMFDTSPGGDFYFTLNFSNVGPTPEELAALVAAEQARLAAAAAAQEAAEVNAFAQSSAATGTSARLLVIGADGVVRDAGQVSLATRDNQLVLTRVAGSSDVTASTSGAPGMMGGVYTWVEITGFTSDTFGSGDGSVTGRGLQIGADMAIGPDMVAGLSLGYSTVETGDTGISTEGTYTYLQPYFAYRSGAWAGNASLIYGVGDIEQTSTAGTGEADVTFTALTFEGGYDYALSDALTVTPTVGLVYGREQTEGTSGILAGRDSDVTFGQVSLGARMTYATDAGTLFAGLHAEYLSNETEFDLAQDFLADDGWTGRLELGADMALSGGLDLSTSVELSGLGGDMQTVSGALRVAFRF

SEQ ID NO: 10620 - protein, 753 aa, Rhodopseudomonas palustris
MGSENKIVVGVAIALSLSGGPEALAQSASEPSVALPPVTVQPAERRAVRRAQPAPAAQRAAPARTPVREQATPPARPVNASNTSDRYVARTSATATKTDTPVLETPQSISTVTRRQMDDQNVQTVANALRYSAGVLSDADTNSRFDSVFIRGFGAFGTATNYVSFLDGLKLPRGQAFANTAIDPFLLDRVEVLKGPSAVLYGQTSPGGLVNQISRMPSAVPYNEVRVEGGTYGRIQSGITSQGALDKDGHWLYSLSAIGRSSGTRYDNVDEQRFAVAPALTWAPDADTRFTVQSYYQKDPKGGYFNSLYPTSLAPLQYRPYLNSKLNVGDPGFDSFEREQYGIGYQFDKRLNEVVSVKSSLRYSHVDVDFKSLQMNAPLTATGTIPRWALRSIEDVGGLSTDNRVQFDFATGALQHKIITGVDYQNTLSNWTYQLGAATALNVVNPVYNQPVGSLASLIDNGQKLSQTGLYAQDQLSLGGWRATLGVRHDWAEQSTDSRLAGSRSNQSDDKTTYRAGLLYLFDSGVAPYVSYSTSFEPVTGVGVGGQPFIPTTAEQYEGGIKYQPTFLPMLFTASVFDIRQQNVLSPSSVPGFNVQQGEVRSKGVELEARGNVTDGLELIGALTFLDTRVARSSNALLVGNRPQAVPDFFGSMWANYTFQSGPVTGLTFGGGIRHVGASYGDDANTLRTPAYTVVDAALKYDLANVAPSLKGTTLTLNVNNLFDKEYYSSCSSGFYCQFGNRRTVLAGIRYRW

SEQ ID NO: 10621 - protein, 221 aa, Rhodopseudomonas palustris
MKACMTAAGVAALLLASALPAAAQVTGPTGFHAGDILVRLRADGVLPRNSSSDVSVIGGHVKASDTVIPEIDLSYFFTPHIAVEAIAGTSRHNVEVTGSALGTVKVGSVWVLPPTVTLQYHFGGMGDFVPYVGAGLSVLFYYGQSTASDLKSLGLDSVTYRTGIGPAIEAGFDWHVQGRWYANFVVKQIFAGTRASVGHGTIVAHAAINPTIVGAGIGYRF

SEQ ID NO: 10622 - protein, 383 aa, Rhodopseudomonas palustris
MKRICTTALLFSLAAAAHAQSSPGSGVTLYGVVMSGLIYSNNSLKGASIGTANGPSRWGFKGVEDLGGGTKTVFVLEGGFNPNTGTAAQGSREFGRQAFVGLTDGRYGTLTFGRQYDLTQDWLAQYSSPLMWNGYTATVGDNNNFNYQFRTNNAVKYLSPSYRGLQAGLMYSFGGVAGSFGNQSAVGFGVNYAQGPLKLSAAYMRMNHPASAASEGLWTTASFASISPNSPAVSYAIAPSSMEIYGAGGQYAFTKDTFAGIVVTHSRYDDLGVAQLGLAHGRASYTNVEANVSHYFAPDYQAAIDYTYTTGSIQPTDFKPQYHQVSLINNYFLSKRTALYLDGIFQLAAGDAQHANIEYASGSGGASSTKRQVSITAGIYHRF

SEQ ID NO: 10623 - protein, 779 aa, Rhodopseudomonas palustris
MVGLNSRAYALLLSVSVVALTIAPASAQTATGSSTSSAQTQVKRDRAARGAQPMAPTADPRNANAQAGSSTQSLDAITVVATKNEEKAIDALAPASAITLQQIQQFPPSRLQDVFVATPGVSFQDRGDEPSTSINIRGLQDFGRVAVVVDGARQNYQRSGHGAQGSFFLDPELIGGIDVVRGPSANIYGSGAIGGVVSFRTKDIDDVVRAGERWGVDLSGSYGSNNARGLGSVFGGVRVDPSVDVFGGAVYRTQGNYKDGAGTEIGNTGNDLAAGLMKFTVRPADGHEVKIGGIFQDFNYDVGQFNRGPSQQALYQGSSVYSTSLQNYTGTLSWKYSQPDDTWFDWSVNLYGNRTNSDQTKTYHYSTSGSGYCGAGNYGNNISGCIGDKRGYNLDTVGIDANNTSRFEYGNWRIAVTYGVDVFNDKVTTWDSRGNSNITTPGGERTVSGGFIQVKNNYAQWLEVIGAARYDHYELNSNSSTASGSRLSPKVTLGLTPIAGFTPYVAYAEGYRAPSITETLIAGAHATGGGPALFTCADGTSGLFCLIPNTALRPEVGKNKEVGINLKYNDVFISGDSFRGKINAFRNDVDNYIELLGSTPQAYRTVFMGFPVSGVASKYYQYQNIPHARIEGVEVETSYDAGMWFVGVNAAVIRGTNPDTGLGLVSVPARKVVTTGGLRLLDRQLTIAAQWASYAANTNLPTGYLPGTSYDLVNLNIAYRPTADVTLNFSIDNLLNNYYRPYAIPGSSSDGTTQNDILWTSPGPGVVYKGGIKVHFGGA

SEQ ID NO: 10624 - protein, 634 aa, Rhodopseudomonas palustris
MKKQLLIVSVLACSFVSTKVFSQEKKEKVEALDEVVVTATKFATNKKNVGKVVYQITQETIENSQGKTILDLLNDVPGVEINGNFSTKGQNLGYYIRGGRNRQVAILLDGVNVNDPSSFNGDFDLRQIDINQVEKIEVLKGASSTLYGTGAATGVINIILKKASKKGFRGSFSSSIGSNSSSENNSLSAEEFSTSFNFNGTLGKLDYLLALNANGSSGLSAAESSTATAFEEDNFARQNVLVKLNYALSDHFKIGLLTSYDEFSTDFDGFDFDPVTFASIPADRDNNLNSVQKRVGVNADYTYANGSLKIRTFLTDIDRTETPSENFFNGEVYGFDIYNNYMFNEEFSFLVGITSQYQDMTQRTSFSTIEEGSGKQHFYDPYLSVNYMSEKGLNVNVGGRLNIHSEYGNNFVYNINPSYNFRINEHNIKLFASYSTAFITPTLSEIFTKLPSIDELLPEETTTVEGGFDIALGDKLTFNATYFYREETNKIGYDPNTFQTINDLGTFSAKGFETEVIYSVSNSLKLLANYTYIDRDENLLLKIPQNKFFIKANYNLGKNTFTSLSYRWVDETQDFGNVALDSYNLFDFFINHSILENKVTFYGSLTNILNEDFQEIAGFTTRGRNYNLGVKIQL

SEQ ID NO: 10625 - protein, 793 aa, Rhodopseudomonas palustris
MNGAKAPRSLRAEASIRTFNDELDNHYGRKVSAVAGMIAVASIGGAEAQQSSLPAVTVDAPVARPRPAAKPTPDQVRARTALRRAARRAQPAQVAPVPFPNAGALSADRNPYADADAPYKVDRLSGTKFTEPLLNTPRTVTVLSKEILEDKNATSLRDIARSTAGVTLGTGEGGNAFGDRFFIRGFDARNDVFIDGIRDPAISIRENFFTEQVEILRGPASTMAGRGTAGGAINIVTKQATTAGNFTKAETTFGTDATKRVTVDVNQVISPTLAVRFDGLYQKANVAGRNYVYDDRWGTLAAVKWTPTDAVKVTANYVHTDLDGLPDFGVPYNTTLRKPSTSVNVPRDTYYGFINRDFQKAQQDFGTVIGEFAITPDLTLSNRSRAGRSVLDYIGTLPSNPTATTVQLASQSRYQVTNVLANQTDLTYKFDTGPVKHALIGGAEISRESVMRDTYAGLTSELTGFQTGGRITVPLLSPPNEFEFASTPQRAYNPTFITVDTKSAYLIETANWNDFVILNGGVRYDDYSITGHTASTSTGVQSGMWNYNVGGVVKPLPYASLYAAYATSSNPVGAELDASGTAYGGLVVNNTTFQALSPELNKAAEVGTKWELFDRHLLVTGALFQTEKSNARETQGSTILSTGVYRVRGIDLGVSGKLTERWSVFGGLVLMESEVLQSIDPTQVGAKLANIAHQSFNVLTKYRIGEQWEVGGQATYASKIYGGTFGAINGNVLPEHWRFDSFVEFKVDKHLTAKLSVNNIFNTTYYDAFYRSNSPFVFIAPGRSVWLSLRAAL

SEQ ID NO: 10626 - protein, 377 aa, Rhodopseudomonas palustris
MKKILLGTTALVSAGLIAGPALASDPLTVTVGGTVTAGFYAIDADDVFGVGFNDTAVKLVARNIDIKAEGTLDNGMVAGVLATLSLGDDWNTNYNNNDAVFRELFAYLEGGFGRFEIGGTDGSAFKMHYTSPWFVPGNGVDSPNILNGLTSYYGFGLRHSTFSLMAADANKVTYFTPRFAGFQLGLSYTPETTFNGPNPNGLGLVPNNTSIEDVFEVALNYAGSFGSVDFGVDGFYVTGDAPAGGASDPEEIGFGANLGLAGFTLGGAWYQSEDLGVFGVSTPLPGAFGVEEEVWTVGLSYATGPWTVGVAYLEDEITSGIGGADIKTWQAGGGYNLGSGVDIGLDLQMSDTDATGFFGPGAEQESKSAGLVLSVSF

SEQ ID NO: 10627 - protein, 734 aa, Rhodopseudomonas palustris
MIQQPSPCFGERTRRSSVRLRRRPHWVLAAAVAVGAPGSDAFAEESTIALEEVVVEGRGPGAPTAASGAISLIGPTPGFRADRAVSSTKTDTSQRDVPQVVTVAPREVITDLAATRVDRVFNYTPGVAQQNNFGGLTLFSYAVRGVATSEIYKNGFPLNRGYPPPPDTQNVERIEVLKGPGGGLFGRSDPGGLVNIITKQPTAERFVEMGGLWGSFEQVRGTLDAGGALNEEGTLLYRLNLAAGRQNSFRDFVDGDRLLVAPVLSWQVTPDTRITVETEFLRNRVVFDRGVIAINRQLGFLPISRFLGEPGQSVNQSSDAMQVRVDHRFDADWQMRLATYLNTGSLVGEAAEVRAIAADNRTVSRDRNFRDYRWDVAIGQAELVGRFDTGGIGHTLLLGFERESTDSRTVSPRSNFRQSPYALDIYAPVYGQARPPLTIPRNTLERVTNTALYAQDQIVLSPEWKALLGVRFDFFEQSFLERVPRGLTEQSRVAATPRAGLVYQPLPDLALYANVGTSFRPNIGVDAAAAARSGPFEPETGLGYEVGAKLDLFGGALNLTSAAFRVERENVLTPDPANSGFSLAAGAVRSQGFELTAAGQLSPELKILAGYVYADAVVTKDNVLPVGAALINVPRHSGSLLAVYEVQEGPWKGLGVGAGLRGVGARAGDAAGTGFTLPAYVAADALAYYRYENVRFGLNVENVFDTTYYESSLNVFRVYPGSPRRVTGTLTVRF

SEQ ID NO: 10628 - protein, 1082 aa, Rhodopseudomonas palustris
MQVRGIGEGLRSSVTGRPRGARRRMVLSSLLASTALVAVAMPALAQQVWVGADQIYNTPSNWSGPATVPDTGDTAVFRNNGASTAVVLSTTRNPNGFTFEAGAPGFLIGVASGGQLNFNGAGIVNNSGTTQQLLIGPSSQIDFRGSSTAADVTITNTGGTLIFSETSSGGTAAVVSNGGDLALRTTSGAISIGSLSGSGTVQATAVGGVPVQALTVGSLNTSTEFSGTFVDNGAQFALGKTGTGTLTLTGDNFYTGGTTISSGTLQLGNGGISGSITGDITNNATLTVNRSNGTSLGGEVSGTGQLIKLGGGILALLGNNTYTGGTIISAGTLRVGNGATSGSIVGDVVNNGVLQFNRFDSIGFNGVISGSGSVTKLGNNAMILGGDNTYTGGTTISGGYLQVGNGGTGGSIVGDVLNNGTLEFARSDAHTFSGAISGTGNLISFGGSAGSGVFTMTGTNTYTGGTTVSRGTLQIGDGGTSGSIVGDVTNNATLAFNRSDATSFGGAISGGGNLIKRGAGNLSLTGVSSYTGATTVEAGTLGVNGSIASSSLTTVNAGAALGGNGTVGTTLINGGALAPGNSIGTLNVSGNLTLTAASSYMVELSPSSADRVNVSGTATLGGATVNASFASGGYVERQYTLVNATGGVVGTFGTLVNTNLPSGFRSNLGYDSNNAYLNLVLDYTPGPSPDINSGLNRNQTEVANALSGYFARTGSIPILFGALNPSGLSAVSGETATGAQQSTFSAMTQFLGVLTDPSSNGRGARDAAPEPLGFADRTPRGSASDAYAMITKSAAERFVPHWNVWGAGFGGSQTTDGNASLGSATATSRLAGIAAGADYWLSPQTVAGFAMAGGATQFGLTSGLGSGTSDLIQVGGFIRHSFGASYLTAAAAYGWQDITTERTVAIGGLNQLRAKFNANAYSARVEAGHRWIAPEIGGVGLSPYAAAQVTAFDLPAYAEQAVGGTGVFALGYTAKTVTATRSELGVRTDKSFALDGALLTLRGRAAWAHDFDVERSIAATFQALPGASFAVNGARPARDAALTTVSAEVSWLNGFSVAASFEGEFSDVTRSYAGKGLLRYAW

SEQ ID NO: 10629 - protein, 344 aa, Rhodopseudomonas palustris
MRKIVWGLARACAVSVGMWSIPGVVHAQSSVSLYGLIDAFVGETHAPGAAGSAWQVGSGGMTTSYWGVSGSEDLGHGMKAVFTLESFFRVNAGQLGSFNGQSFFGRNAFVGLSGRFGEVTVGRNTAPLFVSTLLFNPFGNSFAFSPMISHGYLGSAMGAASVQSDTAIDSSVLYQTPEIGGLSGSLLYSNAGVAGHTGQANYSANVLYFAGAFSATAAVQSLHTASLFLNGATAQTAWLVGGAYRIHATKLMFQYERVSDNSNVTDDTVQVGASARFGMGSMLLSWAGTRRRPVTGSGIRWSTFALGYDYPLSKRTDIYAAWRYDTITHASSGNGIGAGVRMRF

SEQ ID NO: 10630 - protein, 743 aa, Rhodopseudomonas palustris
MRRFASVAGSRCGASLCALALLVTASEAQPQADATFDFRIEPKPRLSALADFTTTTGIQVVRLGGGAISGASPAVSAQLAAEAALREILAGSNLTYRFTSPRTVTIESSPDAAIALEPISVTEISIGRGGVSEIDITSADIERRNATDLRGVFRGEPSVVVGSSLPMSQKLYVQGIEETNLAISIDGSRQNNKVFHHNATTMIDPSLLRAVRVDAGVAPADAGPGALGGAIAYFTKDARDFLSVDGFGGLIKSTFNFNGNVSTTNLTSYSRQGGFEALGSFTYGKGSEFRAGNGEQVLGSATDVLSGLGKLAYQSADGHRLSISHEQIRDDAIRPFRANAVQIYGPQTTPLVRPYKLDRQNTVVSYSNVSPEGWWNPNVALGYNRTQVAVDQYAGATPDTYSYTSEGLTDSLNGKVENKFELSIADIVAGIDFYRDRARSIERTYRTAETADNVGAYAQARLKFADSAKLSFGLRGDHQQFGGINGFRSSDQGLSSNVSGEYALTSHLTAKAGYSNVWAGVPLAENYVQNPAWSYGTGPRSVTSDNATAALVALFTSFRIEGGVFRTRIWDARVPLWAADMALRAFDVQSQGFHVGGTYYWDDGFARLQFVRTDTSINGRPADSYLGKYLTAPIGDILTVQVAHSFASLSLTIGGDVEIAFEDDSLLNPVTGIGRLDGYEVVNIFAEHRPFALPSLTLRGEVRNLLNQTYAARGTYGLEYGSGVVRPLYDPGRSYLVSAKLTF

SEQ ID NO: 10631 - protein, 714 aa, Rhodopseudomonas palustris
MSVFRNLLIASSTFVAMGTCVAQADEPAKQAAPAKRSKPHVVQGGDQAGKSKPATTSSNVPARTSSPAVSTQTAELPELISVSAARRPTSVDDIGTSMTIVTEQQIQTQQRRGLADILERQPGLNVVQTGGPGGTTSIFMRGNNANEVKVRLDGMDVNDGSSAQGMFDAAQFMTDGMGRIEILRGPQSGLYGADAMAGVIDITTAQGEGRFKPFVRIEGGGYGTFNQVFGARGSKGRFHYNVEFSHYRMDGFNNIPSYIERAYNADWRQRHEGNRNDNRSANIRLGYDVARNFDLGLTTRLIQGNNHSYSLYDLQNEYFGYSGVREQNNTNEAIVRGTAHHVSFNGLFDQVIGLGYMTNRNRWTETGTSYGSPINPDPDYYRSDRLKIDWHGTFNFRQYGQFMVGAEHFHETFNTSQAGGISGPGYDTSAGMDTTAGYGQYQGNWNHILYGAANIRYDANSRYGNHVTWRVAPAIHVPGTGTIIKASAGSGFHGPSLYQLFANQGGYGYSEKGNPNLKAEQLIGYDAGVEQKLLHDSLNFGATWYDNRVRNLIQSTLSIDSSYNYNYSYANVDRARMYGVEAFLNWKARRDLQFNLSYTWTHARNETDDTELQRRPQHKFNFNTTWTPIQDLTFSGNILYTSAWRDLPVIGSESCSVCAKGHGYFTIDIAANYKINRYVSVYARADNLLNRQYEDPIGYLQPGRAGYGGFTLNY

SEQ ID NO: 10632 - protein, 1118 aa, Rhodopseudomonas palustris
MGKITKRILANIFFFLLIFQSLSAQNSQRIDLSLKEQTLKVFLEIVEQKTNYTFMYNNLDLEQKISVQVKQATIDELLKKALTPLHINFEIANAKIILTKQGQVNNGSVTVTVKGSIVDEAGEPLIGVNIAAMSTGKGTISDINGEFTVEAAKNEILNISYIGYVSQQIKVGTQSSIHVILKEDTQTLDEVVVTALGIKRAEKALSYNVQQVNTDAVTEHKDANFVNSLNGKVAGVTINASSSGVGGVSKVVMRGTKSIMQSSNALYVVDGVPMFAGSSKGGGKEFDSQGATEPIADINPDDIESMSVLTGAAAAALYGSEAANGAIIITTKKGKVGKVSISVNSSMEFNQPFVMPRFQTRYGTGVGGSFLDGSDRSWGEKLTVANYRGYDPKDDYFQTGIINTESVSFSTGTEKNQTYASAAAINSKGITPNNKYSRYNFSVRNTTSFLNDKMTLDIAASYILQNDRNMVNQGEYNNPLVGAYLYPRGNDWEDAKLYELYDPARKVYLQNWSIGDAAMTMQNPYWVNYRNLRENKKDRYMLSASLNYKILDWLTVSGRVSLDNANNDYTEKFYASTNTQLTEGSSRGLYGITKTSDKQLYADFLVSINKNFGEDWNLSANIGGSFTDVRSDLMTVRGGIADGSDAFPGEQVGLTNYFAIQNLSQKARRLQEGWREQTQSIYASAELGYKSTYYLTLTGRNDWPSQLAGPNSTSKSFFYPSVGLSVVLSELMPNLNKDYLSYLKLRGSFASVGSAFQRYLANPRYEWSTSANQWSVLTQYPMYSLKPERTNSFEIGFNARFLKYFELDATYYNAKTENQTFNPQLPINKYSKMYIQTGSVRNQGIELALNFENTWRNFTWMSGLTYSMNKNKIESLADNVINPITGQLFSIPSLDMGGYADLRFILREGGSMGDLYSRTDLRRDANGAIYMDESNNVYTQKIDNPDSYIKLGSVLPKGNLAWRNNFMWKNFHVGFMISARLGGVVFSRTQAILDKFGVSEASADARDNGFVLINGNDRVNPENWYTTVGSTAVPQYYTYSATNVRLQEASIGYTIPRKWLANVCDIKVSLIGRNLWMIYNKAPFDPEAVASTDNFYQGIDNFMMPSLRNVGFSLNFKF

SEQ ID NO: 10633 - protein, 670 aa, Rhodopseudomonas palustris
MRNTLFFPILAAATICAAPAGAADLARKAPEAPRAVFDWSGFYIGAHFSAVAGHSNWSSTPAGGSGSIDLFDAFQLFKGTGSYVIGLQAGYNWMLPSRWLIGIEADLNSPNTLGGNTGNTLPSGTVGGHDHQALLGGTVRGRVGYAFDGWLPYVTAGFAWSYDRLRWPPDPSLAQQETALLWRLGWAAGAGVDVPLSPAWSARAEYLATGFGSGTVSFPIAGQSVSSDVLTHAVRLGLNYRLGDDLTKSDVFTKGIDALELERFAVHGQSTFTWQYAPGFRSPYSGANSLAPNQARETFDATLYIGAKLWDGAEFWVNPEINQGFGLSGTFGIASFPSAESYKVGANYPYARVPRYFVRQTLDLGGAVETVQGGPNQFAGKQSAERIVITAGKFSVGDIFDVNKYAHDPRVDFLNWGLADALTFDYAADAWAFTYGTAVEWYTGAWTVRGGAFDLPQTPNSTDLDSSFGQFQLVGELEHRHELWGLAGKVLVTGFLNRARLGNFTDAVRAAQASGTTPNIADVRRYTSKTGLSASLEQQLTADIGMFARAGFSSPNLETNAFTDSDRTVSAGLSLSGRMWGRADDTIGIGGLLNHISASRIAYLDAGGLTAIIGDGRLPNPGDEKVFEAYYSLPVYSWRLTADYQFVANPAFNRDRGPVHLIATRLRTQF

SEQ ID NO: 10634 - protein, 1019 aa, Rhodopseudomonas palustris
MKNFNGADGLMKIIMRISLVFSIISVLFLNLVQASAVRGQSALDKQISINVKNAAFADLLKEIEKKTGVNFVYSNRELVQTKVSVYNESKTARIILAPLLKENNLYLIEEGMMVVLKKSAPAPRTVKPGTIVGYVKDVANKQTLPYATIIVKGSNQKVITDANGYFVLGNMKAGTVVLKVNYIGYTAAEFKVDVKEDKTVTLDLNLESQSNDMKGITISGIRRGEAVALSNMRNADNIKYVLSEEQIERFPDATVGEAMQRVPGIAMDYSYGLPRNIIIRGLDQSMGSVTLNGNRLPSTQTNSRDIDLNGILSTTVEAIEVNKTLTPDMEADGTSGSVNIISKTPKVGMRQLQVKGSFGHNFLLSKENFDGSFNFSQRQNKWAYLVGANYSNTFRGEDRVQKDYDTYEINGSEQVRLSNLELEGTDLHRQNLGLQGELSFFPNEKSQIYLRGSYNKFYELQTRGTKSYNIGEYTDDNNVADVSIGSAGSPRDYHRDLLSFSIGAKTNFNNWIANIDLTYASGKYDQPIYYDGYFTYGDLTAGLDISDPRAPQFNFTSGDPSNPANFTTSSYVNRHQFADDKDGQGSFNIQRTFDLSPKNKFMLKFGGRYKYKEDQHTRNYFQYTLAPGTTVSMDNFLSGYSRKKYFNGKYDLSGAIANGYLMETYYQNNRGLFSQDETYVRQNTDPDSYDGSETMGAGYVMGKLTLDKLDIITGIRYERTGFEYNGNVVNFDNTGKYINTNKVAVKSAFDGFYPSLNLKYALDQRTNLRAAVTRSLSRPGYYDLVPWQEVEPRRKRMKIGNPQLDQSTSTNYDFLFEHYLNSLGLISGGVFYKNIEDYIYESIYTQVGGDFSGYQVTQTVNGANARVYGYEIAWQQQLTFLPGFLNGFGVYGNFTQIQSKFKVPGIVSDRTVRLPSMRPKVGNASLSYEKYGFSGRLSLNFYETFISELAEEQKDDLMEKGRAQLDFSASQKISKRFTVFMGISNINNAQTILDFGDGRPNDHKYFSSWANVGFKYNPL

SEQ ID NO: 10635 - protein, 937 aa, Rhodopseudomonas palustris
MTTQEPAASIRIDDRRARGARRPAAAVLLSLLAALWPSQARAQQQRQDGQAAPQAPEGGAAVPRGPGGAIVTPPAPTAAPAVKATPPRALNYTPPEYPPEAEKQGREASVTLQLDIDRDGRVKHAVVVESAGHGFDESALAAAQKLEFEPARRADGTPAPARILYRYSFTLKTASPPPAAGEPARSAESLRGTVLASGGDVPLAGATVSVARVAGASAATPAAPPELTTDEGGAFAFAALPPGRYQVTIAAPGFEPLSVEEALAPGEQLEVKYRLLPQGDGLEVTVRGKRPPREVTKRTIEQREINRIPGTNGDALRSLQNLPGVARPPSIAGLLIVRGSGPQDTQTFVDGTQVPLIYHFGGLSSVVPTEMLDRIDFYPGNFSAKYGRVQGGIVDVALRSPKEDGKLHGLAQMDLIDARVLLEGPVPFLENTRFMVAGRRSYIGESFGPVLEAAGAGVTQAPVYYDYQVLLETEPTPSARLRLTFFGSDDALELLLSDPAPNEPALSGNVGLHTAFQRLQLRYDHELTDKDRLDGVLAIARDDADFGIGPIYFQLDLKTISGRLEYARRISKGTVFNAGLDVFAGLYAVNLRAPGPNRPGEPPNQPFSTRTLQEVSRDGEFFYPAAYAELELAPTPRAKIVPGLRLDYQDLNQQVTVSPRVNGRFDVVPGFPRTTVKGGLGVFHQPPQFQEVIPPLGNPGLKSTRALHYAAGVEQELTRHIEASAEGFYKQLDELVVGVNRPGSIQLDYQNVGSGRVIGGEFLLKYKPDDRFFGWAAYTLSRSTRVPEPGEPERLVSFDQTHILTVLGSYRLGDGWEFGARFRLVSGNLVTPNVCNVNEQSCDPYRTNALFYAPTGTYTPIPFSGPNSERLPAFHQLDLRLDKTWKFKTWRLSAYLDVQNVYNNANSEAIQYNYNYTARQYVTGLPILPSFGMRGEF

SEQ ID NO: 10636 - protein, 391 aa, Rhodopseudomonas palustris
MVAGSMCAGAHAQGTVTLYGIVDAGLGYTSEQRVAQTKGALGSPVGYRNESSYGFASGIWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFPTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 10637 - protein, 428 aa, Rhodopseudomonas palustris
MRKVSRWKKTIIIGATLLLPQQAYCAGFQLNVQSSAGLGRAFAGDAVIADNASSMARNSATMALFNETALSAGIVSITSMVEVKDALYTREVHSQGALVKTSVRSANYDDAGGNAIAPNIYLIVPINDKFAWGISAYTNFGTKTQYSDDYIASEYGGLSNVESYNLGLSASYRMSEHFSIGAGLDIIASTGKLNRSLQPTGAKLLTIDATGWGLGFNLGAVYELDDNNRFGLSYHYSPEMETEGEVDFAGYLAESGPIDDTVLIPLPDMVEFSGFHHLENSKIALHYSIQWIGWSVFDSLDAETSGTINPYEWQDGWHYAIGATYYLNNAWTLRAGYLYDTSAQDKLTSISVPDSDRQFFSTGFTYQLTSNSNMDFGFTYVLGEDVSVVESKPMLPIDIANGTYLATKINAVSHANAMLIGLQYNRTF

SEQ ID NO: 10638 - protein, 710 aa, Rhodopseudomonas palustris
MQGHHFGGDMSNSEAIDNTTAKLRLAQSSSLLALALLIGSAPAQAADTDWGWLAIGAPAATAQGWTGKGVVIGVVDTGIDFSHPALSGRAFDYNYGSFVAGSNHPHATHVAGIIGATDINRGMEGVAPDVRFSSMKIFTGAGGSYLGDAAVADAYDGAIGSGVRIFNNSWGSSDSIANFTSREELLAHEPLLVGAFTRAVNADAVLVWSTGNDGRSQPSWQAAAPYYIQELKANWIAVTSVGENGTIASYANACGVAKAWCLAAPGGDFNPGIYSTIPGKDYGYMSGTSMAAPYVTGATAIARQMFPKASGAQLAQIVLQTSRDIGAPGIDDVYGWGLLAVDNIVDTINPRGAALFASAAWGRFTTLSAIGNTVLDRISDLRNGRGDVVTAPLAFAGQNGAFSQSGSNPRNAYAADLAAAPQPSPLGFGSVWARGLAGRATLSGSASSPQTTADISGGLLGFDLVNNQNLLVGIAGGGSNTNLTASGISDKAGAQAWHVLGYAAAMYGPAFVNVAGGWNSFDQSYQRRVIPGTAGTVFASTISAAQSSSTDVAYFFQGRGGWTFQTEVGRIEPYVHGATRNQSFGGFSETNASIFSLSVPSASLSEAEYGAGVRWACAPIKTVDQRVAVAPTIDLAYVRFTNDGPIQVETNLLGTSVVGQTAALGADAIRVAAGLSLTSLAGISGSFGYTGTVRDAATAHTVSGGLSIKF

SEQ ID NO: 10639 - protein, 764 aa, Rhodopseudomonas palustris
MGMFQTTTKATARTLLLCTVGAVALTIQLPQGAHAQSNLPAVTVDAPRAERARTARPVASTRAGTTRRVAARRDARPPAPVAPVPYVTPSTGTLGALPASYAGGQVANGGQVGFLGNRSILDTPFSQTSYTSKLMQDQQARTIRDVVANDPSVRAVTSAGGGQDGYFIRGFYYDVGDLALNGMYGMAPFWSVGANFIERVEILKGPTALLTGIAPFGAVGGSINLVTKKAPDYDITQLTATYASRSQFGLQADVARRYGEHKEWGVRFNGSYSDGKTPFDRQSSEFGNAVLGLDYRGENVRVSADVGYQANNLTPPIRFFSFQPTVVPLPPAPAASSNAIPDWAYWKPKDTFAMVRAEVDVTPGLTVYGAAGYHQAKIDFKFLSPTIINQAGDYGSRPFGGEQTFTAKTGEVGLRGETDTGPINHKFVVNYGVFDRPNENSYLASPGLVGSNVYNYKAIPEPLFSIPSSSSVSLKQWSVGAADTMSILNGGVQAVVGVRRQHVSNSSTDLLTGVTTGQDGAAWSPAYALLIRPLSNVTLYANYIEGLQPGTTVGPGYANIGEVFPPFQTKQVETGVKVDFGKISVTGSLFEIKQPSAIASSANGVLTLSTDGKQRNRGAEINVFGEMAPGLRLLGGATFIDGVLEKTASGLNDGNRAPGVARVNVNLGAEVDVPGIDGFTLTGRVVHTGWTYANAANTQVLPAWTRFDLGARYTFLSPWNGKPIVVRAAIENVENVAYYASSYSGSAIGLGAPRTYLLSTTFNF

SEQ ID NO: 10640 - protein, 1066 aa, Chlorobaculum parvum
MIYTLKMVIKTRLYLLLLVVSGYSYALDANRAYDQPQQVITGTVYDGSDSNQPLIGVTVVEKGTQNGTSTDFDGNYSIRVSPGSTLVFSFVGFETKEVVVSDQETINVTMSLSSESLEETVVIAFGGKQLKESQVSSIATINPAELKGPTNNLTNMMAGRVPGMVSFQRSGEPGADNSDFFIRGLSTFGSGKRNPLILIDNIESTSTDLARLQPDDIDTFSVLKDAAAASVYGARGANGVILITTKSGKAGKAKFSARAASRVSTNTQNFEFADNITYMRLANEAALTRDPLAVLPYSQTKIDRTAAGDNPYLYPSNDWINQILKEYTINQSFNISASGGSERARYYVSGTYNIDNGILDVNPINNFNSNIKLQNYSLRSKLDIDLTPTTLATVNIYGQFDDYNGPISNGGDIIASTVNANPVAFTSIYPAELYPLAQHPLFGNAPLSLASNALYTNPYAEMVRGYRTTKNSTVQAQISIDQELDFITEGLKIGTMNYIRRYNTYSISRAYNPFYYQASRNPVDGGVQLRVLNDGTQSSIGLPGTEFLNLAGSNNQSSSRIYNQFTLNYDKTFNDIHAVSGFLINVLQSYETTDYDNLQESLQYRNHTFSGRFTYAFDKRYIAEFSFGYNGSERFDRSNRYGFFPSFGTSYVISNEKYFEGLKDTFSNLKLRFTYGKAGNDEIGNADEDRFFYLSRVNPNNGGFGATFGQEYNFGRPGISIDRYANPDIGWEVSEQFNIGIDIGLWRDLNFTAEIYQQNRTNILQRRTEIGDVIGLTANPQVNFAELESKGIDLSLDYNRQINQEWWTQARATLTFATNEVVQTNELNYPDELGYLSQVGNNASQMYGYIAERLFTDQEEVNNSPTQFGNYTGGDIKYRDVNGDGVITSLDRVPIGLPTTPELIYGFGGTVGYKDFDLSVFFQGSARSSFQINSAAISPFVLGTGNQLGQQNGLLKLIADSYWSEDNRDAYAFWPRLSPNVVENNAQSSSWWLQNNDFLRLKNVEIGYRASEKLVDALGIRSLRIYASGINLAVWSSFDLWDPEMGGNGLGYPIQAAYNLGLQFDF

SEQ ID NO: 10641 - protein, 229 aa, Chlorobaculum parvum
MKQITRMATLGVLLLAGASGTAFANGTSAPEPAPIRYTPPPPPPPAPAPAPVVDTCEPGPYISISAGIGIPEDIKAPVISQPTNGYPTDGKIDMENGLALNGAIGYDFGDARLEAAVGYQSHDIADSEDDIDISLLTVMANAYYDINTGSDVSPYIMAGAGWAHVGMPSDESDDVFAWQVGAGLGVKVSECTTLDLGYRYLKPNKFGPDGNDVYKWAVHNVMLGLRFNF

SEQ ID NO: 10642 - protein, 390 aa, Chlorobaculum parvum
MKQIRSFALLALPAALVAAGAHAQSSVTLYGIADAGIAYVHNAQNANGSNASSLVKFSSGNLSGSRWGLRGIEDLGSGLSALFQLENGFNIGTGALGQGGREFGRKAVVGLGSSTYGTVTLGRQYDPIVDLVQGLTQDNYFGGVFATPGDLDNYDNSLRVSNSVKYTSPLISGFQFEALYGFGGVAGATGSGRTYSFGASYANGPLSLGAGYFYANGGTTVANGVRTWSSSADTLFNTVINQGFSSAKSIQIVRVAGQYVAGPATFGLAYSNTQYGADTLSAFSQNAKFNNGSAFFNWQFSPALRAGVGYNYTSLTGPASAHYNQVNLGADYALSKRTDLYALFGYQKASGNTLDASGATVKAAASVGSYGVNSGTDTQELAIVGIRHKF

SEQ ID NO: 10643 - protein, 744 aa, Chlorobaculum parvum
MKKYAMTACLFMAALNVCAQTKEKDSLRVIDLQEVEIISTRATGTTPVAFTNINKEQLKKQNFGQDLPYLLSMTPSAITTSDAGAGIGYTTLRVRGTDGTRINVTANGIPINDAESHNVFWVNLPDFASSVKDMQIQRGAGTSTNGAGAFGASINMQTGDFSLKPYAELNGSYGSFNTHKETVKAGTGLINGHWSFDARLSNISSDGYIDRASVGLNSYYLQGGYYSDNTSIKLITFGGKERTYHAWNYASKEEMEKYGRRYNSCGYMYTDDNGTDHFYEDQTDNYVQKNYQLLFNHSFTSAWNVNVGLHYTKGDGYYQEYKGGRKLVEYGLLPYEHDGETVSKSDLIRKKAMDNWFGGGIFSVNHKGNRLHTSLGGGLNRYDGDHFGKVLWVKNYIGNLDPDKDYYRNNATKNDGNLYLKANYELCSGVNAYADLQYRHISYKMYGQNDKWNSVTNDGLQQLAIHEKFDFFNPKAGLSWQINRNNRIYGSFSVAHKEPTRNNYTDGKFTEHPKAERLFDYELGYTFANSWLTFGANLYYMDYKDQLVLTGELNEIGEAVAANVPDSYRMGIELMAGLKLPCGFQWDINATLSRNRVENFTETLYEDEDPTGDTWSTYLGDTHIAFSPDFLLNNRFGYIYKGFEASLQSQYVSKQYMSNLNCKDHILDAYFVSNLNLSYTFTLPKTKSITVGCTIYNLFNEEYENNGYAGSGFYYENGQKVRYNYAGYAAQAGTNVLGHISLSF

SEQ ID NO: 10644 - protein, 171 aa, Chlorobaculum parvum
MNKRPWLGALSAISLGLCSFTASADFYAGALVSYSNAEYHHSSTSSVTEGNPFLLQAQAGYFFNDYVALEARYGTSVQRESGLAVDSLASGFVKLNMPVSERFALYGLAGYSSVQIDQQNVGSNKDQGFSFGLGMHYALDKHNAVVFEFVDSTSEDQVRLSALTLGFQHRF

SEQ ID NO: 10645 - protein, 388 aa, Chlorobaculum parvum
MKKTRVTTLSRSALCLLPLLAVQPANAEITLYDDDGTSFSTDGYINAFYVNNDVDRAGDQFDRRQSRVKMGFLPNYIGFNMKREIGDLTLGARSSFWVTINDSETAATGTAIDVRQFYGTIGGSFGEVLIGKDFGLFARSNILRDELLTGFGHSSDVVGLVDGGGVSFGNIGTGYPYPFPSSQITWRSPEMGGLNIAIGILDPYDTNEVGAPGKAYQDTPRVESEISYQAEIAGMEVYTWVNGAYQNSENTDSTVADITSEGVGYGAQIKVANLTLTASGFDATGIHPLFTNNAGQLPLQEVDSNGHLMQAGYQIGKMRVAGTYGRTEDDGVTGGTAIDYENKGVIISYAANDYLNLVTNFSRVELDDEVVGEIETTDTLAVGATVAW

SEQ ID NO: 10646 - protein, 400 aa, Chlorobaculum parvum
MKKKLLAGAGVALIAGAAHAQSSVTLYGIIDEGLTYASNIATPGPHGAVSGKPALRMLGGVQQASRWGLRGSEDLGGGLAAVFTLENGFDPSTGRLGQGGLMFGKKAFVGLSGPFGTVTLGRQYDTNVDILGPLEAAALFGGYMVAHPGDLDNVNNANSTNNAIKFTSKDYGGARVAAMYGVGGVAGAATRNQVWSATVAYTRGPLAVAAGYLNARNPNVSFFGTTGSPAPSVGGVPGSNMLSPVYSGYASARTLQVAVVGGTYAIGAMTLGAMYTNTSFRQLGDLSSGPNPGGVSGNAVFNNAEASVRYQFMTSLFGGVAYDYTRGGGVNGRDGATYHQVAAGLDYFLSKRTDVYVSAVYQRASGTDSTGHLAVAAINGPGASANDRQLQARVGMRHKF

SEQ ID NO: 10647 - protein, 404 aa, Chlorobaculum parvum
MKKEIVCCTVTTLFSCVLATVAHAQSSVTLFGTADAGIIYSTNQQITHTDGHTDGHSNWQMGSGILEPSRWGLTGNEDIGGGTTVKFTLENGFFAQNGAQFQGGTLFNRNAWVGVANANYGTLTLGRQYDPFSDNMGAYVSSTNWSTLYGSHFGDVDNLNEAFNFNNSIKYLSPSFGGLTVGGLFSLGGVAGDFSQNRGWSIAANYTRGPLSLSAGYLQLRNPLQAALGERAAVYRISAVPMLMPPIANLQNAQKIDIWGAGGSYVLDQVTFALSYTHTRLSQSQYFASTAGPRGADISFDIAELNTVWQYAPALQFAFAYIFNNAKPDQGASTRIHQVNVGAMYNLSKRTAVYAVAIGQKSSGAGLGVNPAGGGTQNLAQIPTLVNSDTDKQLAIIAGIRHNF

SEQ ID NO: 10648 - protein, 645 aa, Chlorobaculum parvum
MIRKRALSVALSTALCLSPVLSSAALEVVVTPSRTAEKPQNTPGYVAVLDRQQLADSGARTIAEALRGIGSTIVRDLFGDGSRTSVGLRGFSETASHNTLVLIDGRELNNSDSSSPEWSTISLENVERIEVFEGSAGALYGDKAVGGVINIITRAPQDLSGRVQVGRGSYNRRMLQAEVQDRFDSGLNYRVFVEDRKADNYRDNNELEYGSYQGRLGFSGDRLEAYLEAGQVIENQETPGALTQADVAADRRQSLAPFVDDFSDTETQFTRGVLKYQVSDTWRFESDISVEKAESDFRISSSFGAATSDSFLKREQKSFSPRYIGKWETNRGTSRITLGGDFSMVDYSIRSPFGTTQTERESEAIFAQGLIPVVDRWSITAGARHADVDDVIDQGMGGQAYEYDSDVAELGVNFVASDQARLYLRADQNFRVATTDEASFTSPGVTQLNPQEGVSYEFGGDFLFDDIQYGVNLYQLDLEDEIAYDPTAPGLFGPGANVNLDETRRQGLIVSSTIPLTQMLQLSLNYHRVEAEFRSGGLKGNQVSGVPEESARLSLDIEPLEALTIYTEAVYTGQQYVSGDNTNTLAKRASYTLFNVAARYQMQEWAFGARINNVGDKEYNASENSFGGIQPAAGTNGWLTAEYRF

SEQ ID NO: 10649 - protein, 701 aa, Chloroherpeton thalassium
MLKNKKILFLSLFVSSFLFANETTKLDEIKVSETSENSQTIQNGQISRENNLGILGNKDFMETPFNTISYTAEYIENLQAQNIQTIISKIDPSVYSSGSIGMLTENYNIRGFSSLPNDNILNGLYGMSPHYRTSPEFLEKINVLKGPNALLNGMAPGGSIGGAVSLVTKKAQNTPTRSISTSYSSDSLWGTHLDLGQRFGEKNQFGARFNGVYRSGDTAVDNQEAKTKLAHIAFDYKADRGQLSAEYLHSYDHIDGINRGITLVNGLSVPNPPKNTTLFAPNDTYITTIDDMFMLMGDYDITDNIFIYGKYGHSETDMDALAGWKRQVVNKNGKYDDTFVHQRMEMDKDSADIGTRFNFNTFGINHELTTNLTYYHNNNHFEMKMYPTIYSTNIYNPNYSGLKLDKSFSNVKPKKSAETELFSYGFADNMSMFDDRLNIIFGLREQNVIQESFSIVTGQRTSKYDENELTPAVAVSYKFTDSVMAYANYIEGLTQGPTAPTTAANAGEMFSPYQTKQYETGIKLDFDHFTNALSIFQIEKPNGYTDPISNVYSVDGEQTNRGIEYNFFGDIFTDLRYMGGFSYIEAKNTKTAGGVNENKYATGVPKYQGKLGLEYDITNSFSVNANASAMSKQYINADNSLSISGRTIYDVGAKYKSKIGNFPTTFKADIYNVMDKDYWAGELGSGLGAPRTFMFSVKLDF

SEQ ID NO: 10650 - protein, 1042 aa, Chloroherpeton thalassium
MLENTGELTVVAKTSAKNTTIDAGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQVVNEGGLAENSVLNDGGTLDVREKGSATGIQQSSQGALVATTRATRVTGTRADGVAFSIEQGAANNILLANGGVLTVESDTSSDKTQVNTGGREIVKTKATATGTTLTGGEQIVEGVANETTINDGGIQTVSANGEAIKTKINEGGTLTVNDNGKATDIVQNSGAALQTSTANGIEISGTHQYGTFSISGNLATNMLLENGGNLLVLAGTEARDSTVGKGGAMQNLGQDSATKVNSGGQYTLGRSKDEFQPLARAEDLQVAGGTAIVYAGTLADASVSGATGSLSLMTPRDNVTPVKLEGAVRITDSATLTIGNGVDTTLADLTAASRGSVWLNSNNSCAGTSNCEYRVNSLLLNDGDVYLSAQTAAPATTNGIYNTLTTNELSGSGNFYLHTNVAGSRGDQLVVSNNATGNFKIFVQDTGVSPQSDDAMTLVKTGRGDASFSLGNTGGFVDLGTYEYVLKSDGNSNWNLTNDVKPNSDPNPNPKPDPKPDPKPDPKPNPTPDPTPTPVPEKRITLSTAAVLNMAATLPLVFDAELNSIRERLNIMKASPHNNNVWGATYNTRNNVTTDAGAGFEQTLTGMTVGIDSRNDIPEGIATLGAFMGYSHSHIGFDRGGHGSVGSYSLGGYASWEHESGFYLDGIVKLNRFESNVAGKMSSGGAANGSYHSNGLGGHIETGMRFTDGNWNLTPYASLTGLTADNPEYHLSNGMESKSVDTRSLYRELGATLSYNMRLGNGMEVEPWLKAAVRKEFVDDNRVKVNSDGNFVNDLSGRRGIYQAGIKASFSSTLSGHLGVGYSHGAGVESPWNGVAGVNWSF

SEQ ID NO: 10651 - protein, 393 aa, Chloroherpeton thalassium
MQRKYLAVAILCTGASVGHAQSTVTLYGVVDANLEFANHLGAVPVAANGFNPGPSNNVFRMDSGGVSGSRWGLRGSEGLGGGLKAVFVLESGFNLDTGTSQQSGRLFGRQAFVGLQSDYGQLSLGRQYTSMFEALANFAPAAYATQYEPVVVMAGANFREDNTIKYTGSFGPITALGHFSFGTGLALPPTVGAPFILGGNGEVPGQFRRDTAYGAALVYATGPLGVVVGYDQFNPTIAPTAQPTNAGTGTFKKASVGASYAIGPAKIMAGYRWGQNKNQQGAEFLRDDFYWIGGTYQITTAIGLTLEYNYDNVKNQFGDAHLANPWQISAISNYAFSKRTDVYVTAAYTKNAGLAMESAAIFYANSLSLGNSYALANGQSSMFGIAVGLRHKF

SEQ ID NO: 10652 - protein, 611 aa, Chloroherpeton thalassium
MEVRAGERLDEVRSSSLDETVASLPGVQSSNFGPGVGRPIIRGLDGPRVAVLRDGLSTQDVSTVSQDHSPAIEPFLANQIDVLKGPSTLLYGSGASGGVVNVVDGRIAETPVDGFSGRAEVRVDGDDKDGNKDGNTDMFRVDAGNGSGLSIHADGVYRNQNDYDTPKGRQLNSWVDSKVGSIGASLSGDWGFVGLSASRFRDNYGNPGEPGDPSIGERGVSLKLQQDRYDLKGGLTDPWGEGSALRYSVGHTDYALTEFEGAEVGTVFTKRANEGRVKASLTFGGGWQTAFGLLGSDSTFQAIGEESFVPKTDTRSLGAFAVARNNWERVTAEFGARVDTVKYQTDIGVDRDFTPTSFSASGGFRFNEQWRLTANLDHAERAPAEEELFANGPHIATLAFEIGGADLQTEKANQAELGLNFQNAWVDAKVAAYYNRYNDFIYIVDTGGQWFNEEDNDFLPIRQWTQADATFHGFEGEATFHLANNDNGAWDLRVFGDTVRARLNDGGNLPRIAPGRFGAQLRWNAQQWRASLGATRTMKQDKVAVNETPTDGYTFVDAHLAYHVDRGSTAWEVFLDGNNLTNQDARVHTFFLKDDVMLPGRNASFGVRLFF

SEQ ID NO: 10653 - protein, 356 aa, Chloroherpeton thalassium
MKKLYVAAIALAGAVPPSSYAQSSVTLYGVVDSGILYKTHAGPGGSAWSLGTGIDSTNRWGLTGREDLGNGLYATFELESAFRINTGGLINGGQPASSGTVLFDRGATVGISSNVAGALLLGKNRSPLLRTLARLDIEGYSNFGSLNNLLYQNLSGYTGYQYSWVDNSVEYMSPDIGGFQGSAMYSFGGVAGDIKARQVLSIGGTYHLGSFTGGAAYFSGHDVTGATDATAARAYTVGANYGWSQFKFMIDFANFKNPSRGTSDNFYTAEVAYMPTSFWTVTATYIYQNDRVTSDRNASLYKLGANYALSRSTSLYSFVGYVKNNKLAMLGLQNSAPTGVTGKNQFGAAIGVRHLF

SEQ ID NO: 10654 - protein, 1017 aa, Chloroherpeton thalassium
MKRIRLINLILIMFCCCNMLAQNITVTGQVVDVTSEPIIGASVVVKGTTNGTITDFDGNFTLSVQKGETLHISYIGYVAQDVKVMGNQPVKVVMAEDTETLDEVVVVGTSMKKSDLTGAVASVSSKVLEEKPVTNVNQALQGRVAGVFISQPTRPTDDASIKIRGINTINGSTDPIYVIDGMVMDNSFSGFNAVNLNDVASIEVLKDASATALYGSRGSNGVVVITTKKGKKGEGKVSYDGWIGFQTYANTPKTMNTRQLFELRKEAYTNGYMQTNPDGDVNAYVNDVIMGSNTVFADYEFDAYDNNKNYDWLDAVSRTGVQHNHVVSLSNGNDKGSYYISFGYTDNKGVIEKSEQEKYTGRINADQQIKSWLKVGTNTTFTRTENTLVDDGVMNRARCANPMLEISDEIETLNWQGIFDQNNFNPLHSLKVDNDLVYNRLLSSNYININPIEGLNLRSTFSIDYAQKQQNKYTPNDIYESERYGTQGEAKDDRDTRTVWQWDNSLSYEVSFGKHKLNAMVGTSATRTTYNYINATATGFGTNLFGYHSLGSGYKKDQRGLSTAWSEQTLLSYIARVNYNYAGKYLLTATARYDGSSKFAKGNQWGLFPSVSAAWNITEEKFMKNQTIFDQLKLRAGFGIVGNQNIDDFAYLSLYNVSYTGTSDTGYTNSFVSNGRRGTPDISWEKQKQWNLGVDMAFLQNRVRLSVDAFLIKNKDLLMSHSLPTTTGFSSTIENIGAIENKGLEFALNANLVRAKDFEWNFAATLSMDKNKVTRLYGDNDVVYNVDSDRNIQKEGNLFLGESRNTIYIWKTGGIAQEIDMDRLNKINWNGYNVNPGDLYPLDYDNNGQIDQNDRVVIGSTDPKFYGGFSTDFSWKGLSLNAVFSYSYGAKKLSPWYETLIGSTGSGVASTDLLDRWTPENTDAEFPRVLAGFDYNHYGASSMDFSVQKASFLRLSALTLAYTFPTKVINALKLTNLRVYATGSNLFCLTNYNGYDPETGDWYPPTRMYTFGLNLAF

SEQ ID NO: 10655 - protein, 923 aa, Chloroherpeton thalassium
MNFRILMTLVAISAAAQESIQFGSVGGRVADASGAVIPNAKVTARRVDTNISSTTLTDREGRFGFSALKVGPYEIRVQQAGFATAALTVKLGVGSAYELPVVLTVAAAQTDVMVTGEGDLLEAARTQVAGTVSQSEVRGLPLNGRSFMDLALLVPGVAPTNTGSNQLFAETSAVPGQGISVGSQRNVSNNFMVDGLSANDDAAGLSGAFFGLDVVQEFQVVTSGGQAELGRALGGYISMVTKSGTNQVHGDLYGYGRNQRLFAANPLSNTRLPLSQAQYGAGLGGPVVRDRTFYFVNFEERALNQSGLITISAANAAAINERLAATGYAGARIATGLFPNPVHNSNFLGKVDHQFSVEDQFSVRYSVYDAHSSNSRGAGGLNAASASASLDNTDQTIAISNVATLSAGTVNETRGQFTRGSLAAPPADPTGPAVTIQGVATFGTLSSSPTARFNNLYEVADNLTHRSGAHSLRAGVDFLYNDLTIAFPRAARGAYTFSSLANFLAGTYNNAGFTQTFGNTSVAQTNPNAGFYAQDESKVSSRLTLNLGARYDLQYLKSIATDTNNIAPRAGFAWSPFKARRTVIRGSFGLFYDRVPLRALANALLSSNNTTQITSATQINVSLSPGQAGAPVFPAILPGTALPPGVLAGFTTMDPRMQNAYSEQGSLEVEQQIGARSTLSVGYQHLRGLHLIASINQNAPACTAAGNNNGCRPNASYGNNSQYRAAGDSRYDGLHVSFMQRPAKWGSYRVSYTWSKSLDDVGEFFFSSPIDLTNIWRDYGRSDDDQRHRVVVDGALRKIGGFELSGMLQYYSALPLNITSGATTVQGTAGRPVVNGAFIGRNTGTGNDFFSVSARASRSFKIGEKLRLEALAESFNALNHRNNLAKNGVFGSGAYPASPASTFGQVTAVNDPRSMQVALRLRF

SEQ ID NO: 10656 - protein, 815 aa, Chloroherpeton thalassium
MKHFFVMLIMVTSTILSAQPNSNSDIKNGSISGRVMDAKLNEPLPYVNVVIKDAVNKIITGGITSDDGTFKIDKIPEGLVKVEISFIGYKTILKEVNIGKNGYKINVGDVLLEEDAANLDEVTVVADVSTIQQKVDRKVITIGKDLQTAGATASEIMNNLPSVSVDQQTGAISLRGNQNVRVMVDGKLSNIPAEQLLKQIPSTSIKSIELITNPSAKYNPEGMSGIINIVLHKNTMIGFNGNINVGLAYDIEPKFNSSIDANYRNGKFNLYGSYSNSIADNYNYGKINRVEQQVDQKFNILNNNKSHLFKVGLDYYLDEKNTISVFTNQNIFDGWTNVNTRINYLTDPSLDQSQAIRGENENDSQQYNFNYKHDFDEEGHNIELEVDHNIFEGFGGTNNTFFSAQRPNFIEDTNTDRNRTTINLDYVNPLSETVKLELGLQARLFENSIFYESDGRAQNEAGDYIPTTTRFDYTRDIYSAYATYGKKMEKWSYQVGLRAETVNVDSEAFRRDLAANEELTIPFENDYFELYPSAFFTYSPSEKNSYQLSYSRRIDRPGIGQVNPLPEFNTALISQFGNQELRPQFTNSMEVNYTRQLKKGSVTAGVFYRIIEDEIQQAILIDRADTNRLILTNLNFDNTTAYGVELSSSYRPTKWWSINASFDLFSQTQKSIAESFDTNGDIQLNTVEVDNIAYNVRAFNNFKVSKSLSFSAFGMYRGKNKNIQFEMGDMLMVNLGMRYSFLEGNRASFSLSYNDIFDTMYARFDGQRPFLQRGQFNWESQQISGRLSYRFGGGKYRAKSRKRRDNDEKEGGGIF

SEQ ID NO: 10657 - protein, 1055 aa, Chloroherpeton thalassium
MNLKVKLTTIVALLFSVMIFAQESYTLNGTVKSADNMPVPGANILVVGTTNGTSTDFDGKFQIEVTKGDVLQFSYVGYVTKTVVIDNQQNLNVVLDEDNALDEVVIVGYGTRKKSHNTGAIAQVKGRDVAAVQATRVDEALAGKLSGVLIQNQSGEPGADPKIQIRAASSVTGDSSPLIVVDGYPISGNLATVNPNDIESLEVLKDAASAAIYGSRGANGVILVTTKKGKLGKASFSYNTYFSTSRKYRDNILPTTREWDNTIERNVNNGNWDLSGLDQNVLALRRSLYRESPGVVAVEDWLFRNGNSSNHDFSASGGTENVRYFASLGYQNTEGVAITQGFERLNARLNVDAKLGKKFTAGLSFNGFTSKRDILAHDMRDLLRAYSVHPIYHTAESIAYVQQLDQQAQNIGLNPFDGGFSGGGADSESPMNSSIYTLQPGDYAHDWHYGRNGLFGGSSNQGPAAKLLERKAYENNYFGNVNGYLQYSIIDGLDIKTVLGGDMRDTKQYYHQLSQADRRGQISRTRLNETNTKRTSVLSETTLSFNKVIGKHDISAIAGVEFQNFYTTATSVNGINLPNDEILNYNLLNQEDITVTQRDETIARNSIFGRIQYAFDDRYLASVSVRRDGDSRFGANQRYATFPAVSLGWNVHNEAFWNSETVSLLKLRVSTGSLGTTAFLGAYNSLSLLNPSASAFGTAYLIPDDVENSDLTWQTNTETNFGIDLGFLNNRFRLGLDYYTSDIEDMLLSQSVSEVLGTDAINKNIGDLRSSGLELELSAALIQNEDFSWNMNANLSTVSTEIMNLGEESELPREQFGTSGRGPFFRNYVGGEIGEMWGYETSGEIPTGELVDPTLSPGNTSGYSYIVDQNGDGEINEDDLVKIGQNTPDFYWGMSHTFSYKNFDMALQFQGAQGGEVYNLDPLYYGSQWGRSLRSDFDSDTSDDVDNSGRTYGRNRDQTDHGIQDASYIALRNLTIGYTLDTDLTSKLGLGSVRAYVAATNLLYIMGDDYTSYNPEGIKNYDGGGDTYKGPTTYGVQNGASPLVRSFTFGLNVNF

SEQ ID NO: 10658 - protein, 725 aa, Chloroherpeton thalassium
MCKPNYGGIVLLPLLLASCIGGNFGVQPVVESTPTAYPVTFKSKDVPTPPPAKPSIEITPVNRPAVGAAMRLPRRNTAFHREDGTEIPNSKQAEEKLSFQEGDVLFLYGSKGNKLQQLKSEIHKRDSDVEIRTSEKENKKYDYKFVDAGYVYVKGKDEIKWTSDYKQFSNRLGYDGFVYYSGERPSQSLPSAGTVEYSGNWQYMTDAKRHRAGKAVGIDNLGYYTFYGNDVGATSYAAKDVDEREKHPAKYTVDFGNKTLTGELIKNQYVKPSEKQKPLTIYNITADLNGNRFTGSAKVNPDLAKSHANKEHLFFHADADQRLEGGFFGDKGEELAGRFISNDNSVFGVFAGKQNSPVPSGKHTKILDSLKISVDEASGENPRPFAISPMPDFGHPDKLLVEGHEIPLVSQEKTIELADGRKMTVSACCDFLTYVKLGRIKTERPAAKPKAQDEEDSDIDNGEESEDEIGDEEEGTEDAAAGDEGSEEDEATENEDGEEDEAEEPEEESSAEGNGSSNAILPVPEASKGRDIDLFLKGIRTAETNIPQTGEARYTGTWEARIGKPIQWDNHADKEAAKAVFTVDFGKKSISGTLTEKNGVEPAFRIENGVIEGNGFHATARTRDDGIDLSGQGSTKPQIFKANDLRVEGGFYGPKAEELGGIIFNNDGKSLGITEGTENKVEADVDVDVDVDVDADADVEQLKPEVKPQFGVVFGAKKDNKEVEK

SEQ ID NO: 10659 - protein, 823 aa, Chloroherpeton thalassium
MISTKKAFASILLLSISTLFAQLKTESKKITITGKIIEKATSLPLEYATITLKKPNTTQALFGGITDNKGNFSIEINPSIYDLKFEFISFKTIEIKEKLLKFNTNLGQISLEDDAQKLDAVEIRGEKTTIDIKLDKKVYNVGKDILVRGGTVSDVLDNVPSVAISAEGAVSLRGNENVRILIDGKPSSAINVNDALRLIPADAIDKVEVVTNPSARYDAEGGGGIINIILKKGKNQGVNGTLIVSAGEPENSSASANINLKSELFNFFTTIGYNKRKNPGTTKIDQENLNPSGSLKSYLEERRDSKKFGQGANINFGIELYLSKNTSWTNTLSYRNNDGGNKENVLYYNYNQNKSFTNTGQRFNDLIADNQNVEYTTNLITKFKKDGHKLSIDGAFSKEKENEFSDIEGTILETNTFVSSEKTKKTNTQTRNLLQADYVLPIGKNTQIEAGFRGNYVNLLADYLVQERTTPNSPFTNIKAFTNTLAYKENVNALYTQFGSKIGKFSYLFGMRYEDSHIEVNQLTSNIYKPKKYNNFFPSAFLTYQLSENSSISLNYSKRITRPRDRFINPFASYTSNINLFQGNPDINPALSDAYDIGYLHKWDKVTLSTSAYFNHTTNSFQIVRKERGDQINGVPVIINTPFNLAIEDKTGFEFTLNYNFKKWFKLNGNFNFFNNKTTGNYTYTNSQNTLKVQNFDFNTNTWFTRITSKISLPYKIDWQTNATYTAPQKYRQGTMNGVAAVNMGFSKDILKDMGTISINVNDIFNSRKRIQDLQLPTVNSYSEMQNRKRQITISFTYRFNKKKTDKDPKQKQNENGESENMG

SEQ ID NO: 10660 - protein, 552 aa, Chloroherpeton thalassium
MKLGRYSLFLLCPLLASCSGNGFYKDNLGVIDKNILHADTSLLKSKNKEHYKSSDMVSKTDSIYIGNSSFQTYHGEPLPGKLEGVHGIILRSSTPLGFDEVLSMIQDSSGIPIVKHTTKDVISGGVSSKSLAATVAEKMNSATGGKSTDQFDHLLLEVSSEHQLMDVNYQGALSTFLDKVAANYNLYWTYESGRIAFSNEETKRFSISILPGGKYTSKNSISSDSNSSSGSSGSSGSSSSDSGAELKFDSDVDFWKDIENSIKLILGSDGSYSISTSTSSVIVRTSSANMKKINEYINTLNAQLERQVTIDVAIYNVTTTDSSDLAMSLEALLKHNGGVLGSVSTSNFAATSGTPSFTGYLNGNGDSSNQVLLNLLAEKGKVSVVTSASVTTMSGQPVPLKVGNDRTYVSEIGTVLSQSSTSTTASTSTVTSGFLMNLLPQVADDGNILLQYGVTLSELVGSNNGFDQATVNGTVIQLPNVDSTTFVQSSMLRNGNTLVLAGYEKKRNESVDQGVGTTSFKLLGGALNGSASRTVTVICITPRIIDLKASGE

SEQ ID NO: 10661 - protein, 714 aa, Chloroherpeton thalassium
MTYLAFPKRVALLLGVFVAFNSPMVFAAKELQSNEQVTDSDIERLSIHYRQAYRGNVPAEALPQAISVLDEQLIKDAGLTRFQDVLDYSASVARQNNGGGLWDSFSLRGFPGNENMPSGYLINGFNGGRGFSGHRDLSNVAYVEILKGPGSALYGRSEPGGTVNIVTKKPQYESSGYLKASAGSFDQYRLEGDVTSGLTESVAFRINGAWQEYDSFRDYVFSDKKIVTPSVRWQVSDKASLLYELEYLKQEQLFDRGFIVLNNDIKTVPRSRYLGEPNDGATKVNATGHQLTYDYELNDDWSLTAGYNYRDSTLKGYSSDAELAKGRQSLFDDGRTLTRQHRYRDYASEDNSLRLELSGHLDTGFIRHNLLLGADAYHYNLKTGLYRYRGKKGEYAIDIFEPQYGSVQPEVSLLYENEETQKAWGSYLQDQMDLTEKWKLHLGLRFDSYQQDIRETAKETLSEQTDNRVSPKVGLVYLWSDALSFYSSYSEGFLPLSGTDYAGNPFEAEESQSVELGMKFNAAWLNDLAINGSLAVFDAKKSNILTSDPVNVGFSATLGEAKSTGLELDIAADLTESLQGRLSYAYLNTRTANDTLNLDFGVQIPAGSPLVNVPKQTASILLKQDLNDFSIDGHLGLSWRYIDSRLGDSADPSFQLPSYQLVGLFMNTHLSDNLSLGVNLDNLLDEHYIASSYSALWAVPGEPRSIKVSVSYEF

SEQ ID NO: 10662 - protein, 432 aa, Chloroherpeton thalassium
MLSSTSRAALLAALAFGAGVAGADRARAGAFGLREQSAEAQGLAFAGAAAGSGGLSSMFWNPAAVTMKPGWNSDYNATVIVPQATFTTQPGTFAPLRTLGESGDIGQAAVLPATYTNYQLGERLFLGLAGAAPFGLVTKPNQVWAGQTYSRSSRIFSLNFNPVIGYRVTDWLSVAAGPTIEYFKLKLRQAVGISPLAPSALLKGDDWGVGFTAGLLIQPTATTTLGVGFRSSIHHELDGVLSVVPGRVRSNLNTPEKLSVGLTQGITPEFRINLGFEWDNWSRLGTPAIVSQSLNIPVSALPLRYRDGFHYSVGGEYDVSPQWTLRAGFAYEVSPITDANRSTRLPDGDRYWGSIGASYRYSDKIQFDVAYSHLFAAGRNPVRIVPGDPLYVAPLAYLATTDTSADVVSVGIKYRWDTPAAPLSPAPIIRKY

SEQ ID NO: 10663 - protein, 352 aa, Chloroherpeton thalassium
MRKFAWMALLGALPGISVAQSSVTLYGQIGGGIRWTNGMQGGSAVGFNNNLISGNDFGIRGKEDLGGGFKALFVLDGAFSSGTGALKTSGTLFSQAAYVGVTGGFGRLTLGRQFNAATDFGIIVDPAGGRGQSLAIEPGVLWSGNPFTLDSRFNNTIKYIGELGGLRVAASYSPGGVAGNTRAGTNFSAAAMYQYQTVLGGASYSKTYSADATQSAQTWMAGGTWQIGAGRLYASYSALDISSANPSRPHRRDKIPSLGIVYQATPFLQFTAGMYDDIGRNLGNRRDADGHKLTTYAVVEYFLSKRTEIYAEFDRNGFSGAYRTDPTNIAAIGLRPGGGGMTGASIGLMTKF

SEQ ID NO: 10664 - protein, 785 aa, Chloroherpeton thalassium
MKRVTTILFLMLLICVHTAAQQKVKLEVLEKGTEQPIIAANVIYADNEALRNPQYAITNTSGQAELKLPSKGICYYKVTYIGYVPVTGKIGGTQDEKVIYMKEDNLGINEVVVTGSRTARPIKMSPVTTQVLGGKALVDAGYSNLQQALQQETPGLNIQKVGFGNEISMQGLDARHVLFLMDGERMTGDMAGNLDYERFNLHAIDRVEIVKGASSTLYGSRAAGAVINLITKKTDKPLSIDAGIRYGQMNERNYKHPQPKDFLYMFEQNADRPNLQSWVSAGFKAGKFTSQTDVWYSESDAFYMYQAENDKKVYTKEANPFLPHDIIVVSNAVRPPMGIEGKEHITVSQKLYYNPNPNLSVLVYGSSFFMNTYDLIQDMTFSQARDWTAGTKVTYHVKDWFSVTGSLHADFYDRFKRHERIDKRQKDYESSIYQPRLTVTSNYFNGHSLILGMEHTSDELTSDRFSGNANHDLKTRALKETEYFLQDEWTINPRWMISAGIRTNFSKAFGFMGMPKVAAKYSPDKHWSLRANYSMGYRSPSIKELFFNWDHLGMFMIRGNENMRPEKNNYFSLGAEYSNDRLFVSGTAYGNYFRDKIEGVWRIYDMQYNFEYTNLSQQRLLGLEVLARWSVLDCLTLNGTYSFVDVSKNKGIQVNTTSPHAATASMDYKYMKKNYRLNAVFSASYMGGKKFDVQDRVFVKEENKSYDAYFRCDLPQYVLCNLSVSQTFWNKVKLTLGMDNLFNYVPKTLGSGITMFNVPATAGARGWVQVEFMLDDVINSLKKKK

SEQ ID NO: 10665 - protein, 249 aa, Chloroherpeton thalassium
MKKLLLITAASTAILSSAAIFAATDPCEGVVMNAPMTDSAMNSSMPASAMENQWYLKLDAGAVIFDSQKDKVTGIKVKSNTGFTGEIGAGYYIMDNLRTDFTVGLVTSNHLKKSANDKYGDRVSVKHRPNIVSFLLNGYVDVVDLNMFKVFAGAGIGAAMVKEKISYTFPDPDIENGKVNIKNKTNFAYQLSLGASFEVAQGVKAELVYSWRDYGKTKTKTITEGSDSTRYGGTRYRGNNLMAGLRFDM

SEQ ID NO: 10666 - protein, 351 aa, Chloroherpeton thalassium
MKTWIRVLAIYGCGSAVPAFAQSSVTLYGSLDTGVTYTSNVASAPRGGRQLALQAGVARNDVWGLTGREDLGGASFAVFRLESQFQTSDGTLTVPGAAFSSQAYVGLGGDWGTVTLGRQFDFVGDLMPAFAIGANTPAGLLAWGLPANASAGGALDNRVWGVQVNNAVKYVSPTFGGVSFGGMWGFGNVPGTVARSSVQSAMVSYTHGAFSAALVYFGQHDVTSGGNLRNFSGGAGYDVGRLRVFGMVSDVRISAAAPLRATTYDAGLTYAVTPSLQLGGGFQFQQRGGDTGSANQLTLTADYSLSKRTGLYAVFARGHDSAYGAQVEAALGGAASGSTQSAVRVGLRHQF

SEQ ID NO: 10667 - protein, 189 aa, Chloroherpeton thalassium
MRKFILASLAIMSTSAFAANEMYVLGGVGINEDDTGAQFTVGSQVLDTNFYLESTMNYIDSDISDVTSDVNGDLTKHKGDYQHFKMSLAPMYKYSFDESFAIYGKVGLAYSNFNSKSTITDKDGSVNNKHSNSEWGATYGIGAEFKSVQPMFGNSKFMARVGFDWYDFSSGGLNLGSDGTLGLQAGFTF

SEQ ID NO: 10668 - protein, 344 aa, Chloroherpeton thalassium
MYRDGRGRWRKGLAALSLCITAGAAHAQSSVSLYGLADAFAGVVRTPGASGNTWQVGSGGLSTSYWGMSGAEDLGGGMKAIFTLESFYRIISGQLGAYNGQSFFGRRAFVGLSGPFGQLTLGRNDSLLFVSTLLFNPFGNSFVFSPIVVHSFLGSAMGAASVQSDTAIDDSIVYQTPEIGGLTGSLQYSNAGVAGHAGQANYSANVLYFAGPFSATAAVQSLHTASLFLNGATEQTAWLVGAAYRLQAVKLYLQYERVTNNNELTDDTVQVGASAQVGTGSILLSWAGTLRQPAQGADVRWSTVVLGYDYPLSKRTDVYAAWRYDTMTSVSSGNSLGAGIRMKF

SEQ ID NO: 10669 - protein, 779 aa, Chloroherpeton thalassium
MTKFKALGSTAIIGCMALALISPAHAQDAAAPAADGDEIIVTAQGREQNLQDVPVSVSAATGISLQKQAITTLEALSVRQPNFRISQSPASDYVVIRGIGSSANIGFEQSVGTFVDGVYRGRSRSTRAALFDLERVEILKGPQTTYFGNNSIAGALNITTRKPGRDLAVNGTASYFPNTGEYLVEGGITLPVTDRLSLRLAARQSGMDGYIKNIQTGKDGPHLNDRIGRVSMAWAPTDGIEIDARLDVGRMRDTSVFNVELLDCPTSAPFAGPAGPCARYLNASGGSVDSKLDRVSGANPSYFDYDMVEGVWGMKIAAGDNTLTLTTGYFHHKYHLLNDPVPVPGTRGGSAVGTTTALPIALFEKYDQVSQELRFASPEDRTISYMFGAYYQYGKLTTNLIQGFYFAPVAAATGGLIPLATPVAGSITTTERSDVFSGFAAATWRATDALRVNVGGRFSLVDKHDARATQMGTAASIPSLANFVPFTVALTQLYAASGINPGNYAVPNRSDHAFLPSASIQYDLSRNAMAYVSYVEGFKAGGYSIGTTNSSFDPERVKSYELGIKADLLDRLLTVNLAGFYSRYRNLQETATVTSGTVVRQFVTNAAKSKVKGVELGLTVRPSSNVTLTSNVAYLSSRYADYPNAPCTTTQQALAPVCVQDLSGARRAFAPKLSGNVGMNVTQPLGRYQLSFDANGYFTTRFLQIATGDYRISQEGNVKIDARIGFGPADGPWELAVVGKNLTNKLTAGYRQVVPGATGSLAAMADAPRSIGLQGSFHF

SEQ ID NO: 10670 - protein, 696 aa, Chloroherpeton thalassium
MFAHSRLALLIGCVTGSVAFPLLAQDAQKTETVVVTSQMQSGATKLETPDIETPQAVSIITREQFEEQGATSVRQAVSYTPGVYSNQIGASNRFDYIVLRGFSDGSLDNIYLDGLKMMGDTNSHSSLVVDPWFLENIEVVRGPASVLYGRSSPGGIVALTSRKPSFDPGGEIKLFAGNNNQRGAMFDVTGPLDDNDRVAVRLSGMTRYADSQFDPLKEERYALMPSLTWRITDNTRLDLMAYLHRDPEGGSHSGLPYDGTVASHNGKKISNTFFEGEDDYDKYDRRENMVGYNIEHMFDNGWSVRQKLRYLHTKVELNQVYAAGWLNDTELNRGYSGSGEKMDAITLDNQVDGSFDTWAVNHRVLIGMDYQDRSNNTTGYYGGFPAIDAFHPVYGANPDYITMYGQEKHKLRQTGYYLQDQMSIDRWRLTLGGRYDQVSVSNIDKLNNTRSDLDKNNFSSRAALLYLFDNGVAPYISYSTAFTPTSFADENGQILDPMKGKQWEAGVKYEPEGMNSQFSASVFRINQKNIATKEEPTDPYRSIGEIESEGVELEAIGQLTDSLRMQAAYTYTDIRYKKSSPEEEGKRAVYAPRNMASAWLSYDVKTGPLDGLTIGSGVRYVNGVTSDRQNTHTLPSYTLVDMAVGYDLSKVGLTGVSAQLNVNNLTDESYVAACNSLSYCYFGAERSIVGSVSWKF

SEQ ID NO: 10671 - protein, 816 aa, Chloroherpeton thalassium
MKKVVLLFALLIYGAITANHPTDPSDLKNGSIYGKVIDASLKEPVAYAAIVIKSQLDGANLTGGITQEDGSFEIRDLPEGDLILEVQFIGYKTHTQSLSISKRKKKIDLGTISITEESEQLEGVEVVAERTTIEQKIDRKVINVGKDLTTAGATAADIMNNIPSLNVDSQSGELSLRGNTNVRVMVDGKLSNVPVAQLLRQIPSTSIKSIELITNPSAKYNPEGMSGMINIVLHKNANIGFNGNINTGLTVAKEAKFNSSLDLNYRNGKFNLYGNYGVNVGKYVNDGSILRTTENSEQLFDFLSNDKSHLYKVGVDFYLNDKNTISVFTNQNNHDGKFRGLTDIQYYNNPSLNGTQDFTSDNENISSQYNFDYKLDFNKEGHNLELEVDYNEFEEDEIADFKNSGNVVFPNYQDFVDTERTQIIANLDYVNPLDSISKLEFGVEARVFETNVDYASTGLSFNEIGNLLPTPDKGFVYGMDIYSAYATFGQNYKKWSYQVGLRVEDVEVTADTDDTRSYTDDYTELYPSSFITYSPSDKNQFQLSFSRRVDRPGLSQVNPIREWSTPLISSLGNESLSPQFTNSFELNYTRRLEKGSITAGVFYRAIKDDISRAVYIDRLDLNKTILTFDNFDDTSSYGLEISGNYKPTKWWSINGSFDLYSQTQQGITERLAGDNSAATIDDITIENVEVDNLAWNMRMNNSIKVNKKLSLQIFGFYRGANENIQFDVKPMYFVNTGARYSFAQGKGTFSLNFNDVFNTMRFAFTSVNPIAQEGRFNWESQSLYAGLSYRFGSGKNRAAQRKRRDNNTKQGGGGIL

SEQ ID NO: 10672 - protein, 239 aa, Chloroherpeton thalassium
MLRRALLTTTTLAVFAGAALAADLPYGQESGGYAPAPIFTWSGLYLGGQIGYGWANNALSGWGPFFVFSGASYNPSGVLGGAHVGYNLQFNQIVLGLEGDVEATGVDKTYAFGPTVYTTQIPVQGSIRARFGFAVDRALFYVTGGAAFASVTNQYQSYLGYNSLNRSFAGWTIGGGLEYALTNNWSVRAEYRYSDFGTATDYTFTAGPGGNVARHLTENAARVGFSYKFDGLFAPSYAR

SEQ ID NO: 10673 - protein, 377 aa, Chloroherpeton thalassium
MKIKILMLGVAAAAAAATSAQAADLPVAPEAVDYVRVCDGYGARFYYIPGTETCLRVGGRVRTQVVVNNVLDGGAWGDRDSNGYDWLARGYLYLDARTATEFGTLRSYVSMYGDSLNGDDSGFELEEAYIQWGGLTAGRLASNFDIFTGQTFMGVVDRDWSDATTNQIAYTAAFGNGLSATVALEDRSEREFGYYGGTRAPDFVTALGLSQGWGSAQLSGVLHHVYPSTAYNNATDGEDNLGWAVGGGVVINLPMVGAGSNIFFQGFYADGALAYITTYDGVADFYGDETSKGFSLSAGTFIQATSTIGLALDGSYADIDAAGNLSDVTRYAIDGSVQWEPVSGFILGADVGYANIDVDNEGDQDQLLLGVRMQRTF

SEQ ID NO: 10674 - protein, 731 aa, Chloroherpeton thalassium
MRKMDLLRLSSLAALAAALGTASASAQARSPSESNTVADIIVTAQRRSENLQSVPVAATAFGAEALEKSGAVNILDVAAQTPGVTMTEYNIGEPQVYVRGVGSQSDSASSEPSVTVSVDEVPISRGGATGAAFLDTQRVEVLRGPQGTLYGRNASAGAINLYTNRPTFDFSGRVEASAGRFGGYGAKGVVNAPLSEAVALRVAAQYSDSDGYARTTPSGERLQGGERYAARVQLLTRQGDWDVLASLDHSFDDLAGDARYALVTPLAPAPLAAIVNSAQAGRDVWTTYGRPDAYQKRANTGGFLRLEHTGEAFNFVSLTAYRDNEYSFLADLSGLPDATFPFQPDDYVDEDSHQFSQELRLTSSDAARIKWVGGLFYFRESIDRVERIVTDSRAPLPAALSGDVSMGQDATAESYAAFGQATIPFARIWELTLGARLTHDKRDVFQSLINNRPSDTNLAFPVFPGSLYAVPAKADFTKPTWRINLAVEPSPGKHFYASYDRGYKSGSFTSQAQNAGQATTLVKPEQLDNFNLGAKTQWLSNRLRLNADAFYLDYKDLQVFEFGSSLNFVVSNADAKVKGLELQALAAVSHDITVGANYAYLDTEFTSNPAYAGATLPYRGNVLPRAPKQQYSVYVETNHQILGGELTARLAYDWRDDFYYNPSNDIASKQKAYGVIGGYLSFETADQWKVALSGENFGNERYSVHNISFQNMGFRLYAPPRTWTLILSKAF

SEQ ID NO: 10675 - protein, 1026 aa, Chloroherpeton thalassium
MKRLLLILVCISLFISAFGQSFVLKGIVSSADGELLPGVNVKIQGTTVGTITDIDGNFQLNVNKGAVLEFSYIGFKKQSIKVNSQQMLNVELAPDQTNLDEVVVVGYGKAKRITLTGAVSGIQAREIRNVPTSSVQNALTGKLPGFFSQQQSGQPGKDASDFFIRGVSSLNNDGNKPLIMVDDMQYTYEQLSQINVNEIESISILKDASTTAIYGIKGANGVLVVKTRRGEQGKPKINVRLETGMQTPVRTPKFLNAYESLQLVKEAHTNDGTLSDFPYTEDDMIAFRDHTDPYGHPDVNWYDEIFKKMAFQENINVDVSGGSKKLRYFVSAGYFTQNGLVKDFGGNSGDGVNPNYSYRRFNYRTNLDFDVTDNFNMRLDVSSRFMDINEPYNMNVTGELYDFSKMHPYSAPLLNPDGSFAYLYDTQDRKPTLNARLANEGYKRTRRNDNNILYGATWKMDFLTPGLAADFQLAYSSSDENYRAVMRTRYPTYHYDSATGLYNINPNGVYDYEQYFVYNSTDKAIKDLNIKASLKYAHVFNNAHDVNVMFLYNRQSTTNEKDAAVPNNFEGYTMQLGYKYKNKYLVDLNMAYNGTDRFGKDNNFGFFPALAIGYAISQEDFFKNVDWLGRNVQLLKFRTSYGLVGSDVASGDRYLYRQVYKTGDSYTFGEGNNFGVSGIKEGDLGNLNVTWEKARKFNVGVDMNLFDKFSLTFDWFIDKRYDQLVTRNDIPDILGIGLSPENVAETTNKGFDGQIGYQDRFGNFNFNTNFVFGYAKNRVDYKAEAQQKYEWLRETGRQIGQPFGYHWIGYYTPEDIEKINSGAADAPAKPDIAVQAGDLKYADLNGDGTINDFDKRAIGKPNLPTTTLGWTIGGSWKGFSISVLFQGSFDYSFAINGTGIESGKSQFQPLHQKRWTQERYENGESIEFPRLTMQDGTINSASAYNSDFWLINAWYIRLKTVDLGYQLPKTALPKFLDNVRFYVNAYNLLTFTGYDKYQQDPEIKTNTAGDAYMNQRVINFGVQLGF

SEQ ID NO: 10676 - protein, 931 aa, Chloroherpeton thalassium
MTHVAIDSHRYIPRNLLCASISGVLLVAAVSVQAQETNAASNLERITVTGSNIPRTDTETASPVQIVTREDIARSGRATVGEYLQTLTSDGQGSIPKNFGNGFAMGGSGISLRGLGAGSTLVLINGRRIASYGLADDGQKLFADLSSIPMDAVERVEVLKDGASSIYGSDAIAGVVNIILRNDFQGALVSASYGLSGYRDGHTPKATMTAGVGNLASDGWNALVSVDVGKSDGIMTSDRKDRKWIGTGDTRPWGYDLANSQQFLRGAITGKGTIADSSPVGAVRNPSNNQFSSLPGCSNFSSVSPQDPGGGCLWDVAQFRSLTPDEKYANVFTRGTFTLFDTTELYTELSYSKKKSEFSNFPSFVSGAWGYPGGAVNASSGDGATVLAAGHPDNPYNGPARVRYAAFDVGPRVKENTNDFMRVVLGIKGSVASWDYDVSALHSQSQMDRKFTGYLRYSSVRCVLGNLACPAGVWNIGNGSETNPRSLYDFISPVLSAQAKTKLDVFDARVSRALADLSGGAMGLAMGVEYRRDQASLTPVTYTDIGDIIGVGYSAYGGEEKVSAAYAELAAPFTKAFEATVAGRVDHYSSGNTAITPKLGMKWKPFEWFALRGTYAQGFRAPNVAESGKVGKVGGLAAFANVSDPVRCAATGGSGAECAPRFVSVITSPNPDLKPEKSNSYTLGMVFQPTSSTSMTVDGWQIKRTKEIAQIGTVDAINAGDVIRDDNLLKGVAGTGQLLGVKAKYVNLNATTARGVDTDVQQRIAMGGLGDLILDLQWSRMLKFQREDANGNISEYAGTHGNCDVSNCIGTPKDRINFGATWKLNNISVSALGHYRSPMENRLFKGGACVSHFADGSDAPIDCRLNAFTSVDLSANWQATEALAVFGSVQNLFDRIAPLDPLTGGALNYNPLDSAGAVGRFFTVGARYAFK

SEQ ID NO: 10677 - protein, 778 aa, Chloroherpeton thalassium
MLKRENLRLSTVAVLVANACISFQAYAADATPITTDKVNVVGTTPLPSLGLPLAQVPAGIQLITGPQMQKQRSVTIADFLQNNVPAVNVNDTQNNPFQPDISFRGYSASPLLGTPQGLSVYVDGVRVNEPFGDVVSWDLIPVNALANMALIPGSNPLFGLNTLGGALSLQTKSGRDNQGAALEASVGSWGRKAGSVEYGGVSQDGSVDFFITANSFREDGWRDYSPTDVRQLFAKVGWQNETSKLDLSYTGADNDMIGNGMTPSDMLRTLGRDTILTRPDQTRNTLSFLNLTGSHWFNDDVMLSGNVYYRQSRTRTLNGDGNDDVEDAAISAVGICGTDANWGFEDSCSGALNRSKARKDSYGLTTQLSFNQDWMQKKNQLIVGLGLDQSKTRFGQSSELGTLTSSRGVSGIGEFSDEGEVSLTGRTRTWSVFATDTLSLNDFWHLTMSARYNHTKVENRDHLVASGAESLSGDHGFNRINPAVGLNFTPTKDWTWYGSYNEGSRAPTAIELGCANPDVPCKLPNAMAGDPPLQQVVAKTYEAGVRGTLAEGLRWTANVYRAQNDNDIQFIYANSSGYGYFDNVGKTRRMGLDTSLVGSQGNFNWMLGYSYIKATYESDISLANEVNTSSDGDSINVGKGSRLAGIPAHRLKFRGEYAITPQWSIGTNVLVFSDQYAHGNENNKDQGEGAKLGGYTIVNLDTRYHFGNGWQLFAKAVNIFDREYSSGGMIGESYFLADGTYDGGEDHRASLRAPGAPRAGWIGVRWDFGGAKQASFTN

SEQ ID NO: 10678 - protein, 364 aa, Cupriavidus taiwanensis
MKNPLAGAAFAALAACCTGAFAQSNVTLYGRLNTSMEYSDASTASDGTKLGGTGRLTNNRSVFGMRGEESLYGSLKAIWQIESNISLDTGSGQLASRNTRIGLAGSAGSFFMGNWTTPYLEATSSYDPFYPTTAGYMALIGNGSTPTSDNVQDTSSFDRRQKNSVHYRSPKWNGFSGGVTWGINEERITVPRNPSLWSFAGAYDNGPLNVVLAYERHNNYQTAGRDDEGMKIGLSYQFPTTKVSAIYERLHYRTATGDLKRDAYYASVVQKLWTGSLRAGVGVAGNGRGNATETVGFFRSGADTGAVQATLGYEYPLSKRTSVFGFYSRIFNKKNATYDFAINELGISAGADPQTVALGMRHVF

SEQ ID NO: 10679 - protein, 1210 aa, Cupriavidus taiwanensis
MKFGDLIISRHSAWKNNLLVRTMKLTILILTTFLIQVSAAGLAQNVSFVKKNASLKELFSEIRKQTGYNVFWQEGKVNDAVKFDAFFNTVPLKDVLDKALKPESLEYTIVNNTIVVKKKDESFIDRIAAYMREINVSGTVTDAETGKRIPNVTVRLAGTTRSVVANDNGYFEFKGLPDNASLIFSSVGYAERSATANATMEIKLIPLSQTLQDVTVSTGYQTLKKGSTTGSYSVITAKDIEQTPNVNLMERLEGKVPGVQFDLRNNTIKIRGVNSYNSGVNSTPLIVIDGFPASNQKLTNITSATVEGSPRFDKQPGTSGNAILSSFNPADIESITFLKDAAAAAIWGSKAANGVIVITTKKGKKGTNTINFGATLSTSAPANFKNMTSMSNRDYLDLEQELVDRGFIADPIINGYRSAPVSEAQQWMLKAKRNPIYTSQRDSALLVLANRSNRDQLRDYMLQRAVSQQYDLSFSGGAENSSYYISGNYTKDIPVFKSNYGEVYNVNSNLTNDFLSKRITVATGLNYTYSKSQVNSAALNSLSLGTYGLSPYDMLVDENGNRIYRGVHVTSAVADSLTQAKKLLPWKYNAVDELQYNNTIATRNLFRINTSVTGTITDWLNVVVSGQIQKGAEEQTLIQNLNSYYTRNLVNTGTNPLNTSAISATPPYGIPKGAVYNAGRTNSDEYGLRAQLNVKKDWNGIHQFDFLAGSEIRQVKVSGGNQLLYGYDEDLSTSVNVNTTNTGRYYSIFGNQMSIPSANGTVFKGVTRNLSYYSNASYAYKGKYFATASVRFDDINILGVDRRDRATPLWSAGLKWNAAAEDFLKDVSWIDALSIRATLGTGGNAPTSSSNYTTISIFPADSYSQLPYASISAPANQDIGWETTKTTNAGLDASFLDNRLNTSFDVYKKKTTDILMSLPINSAYGFNSLTYNAGDMKGHGVEFALNGVLLRKNDWEWSADFNVSYNTNEVTDTRFPAKIATVGMPVITSGYPVDNLFVYRWAGLDNLGRSQIYANDGTVISSISTQTIKPEDRVYAGRTTAPYFGGFSNTIRYKGLSLYARASFNMGHKFLLQNINSSSYPSSNGFSGLLSNTQALATRWRNPGDEAFTNVPGLGNMNFNTIQRYVNSDINVRDAGNIRLQQISLSYSLPGTVLKNIPFIKRVDIGATVSNLGLIWVKNKEGIDPDYQMTGTFANLPPTRNYLFNLKVSL

SEQ ID NO: 10680 - protein, 1035 aa, Cupriavidus taiwanensis
MAMKRLRRLHASASCVAITAAMFASPVLAQQAQNTTVDEIIVTGIRASLERSIEIKRTNSGVVDAISAEDMGKFPDTNLAESLQRITGVSIDRTNGEGSQVTVRGFGGGFNLVTLNGRTMPTANVATVGGDQSSDTAGGTSRSFDFSNLASEGVTTLEVYKTGRAAVPSGGIGAAINVKTRRPLDGKPGLTGSVGVKAVYDQSMDKKVDDGGSKITPEFSGLLNWADDSDTFGVALFGAYQKRDFTSRSVTSNDWNIRPYSDFINPANGFVRNGGATQITNAPSSGSTLVAIPNDSRYHFSQGERERINGQLTAQYRPTENLTITADALYAVNKSFERRNDSTNWFNRPFDRVTFDNNPVVATAVLLQEQLSGTKDMGFEQQYRSNEDTLESYGLSADWDLSDRLRVKLDGHISKADSGPHSRNGTSSTTVSIGAPIVAAHSVDYSGKVPVQSITINDAAPRGNGNGALDAGDLGSQVARTWTNRQQHDIKEVRADVTYDLDDNGSRFDFGLNYRTSKMVQSGSSTQQDLGSWGISNPRDVQQFAPGLVKAFCMACQFNEFDLKQSGAGLVSFRADAIDLYNAMSKAYVARGNPVNITGQANNRVDEDILAGYAQVTWKSELGGMPATLVTGVRYEQTEVTSTSLVRTPSAIIWTADNDFSLQTSATYQPLAGKGKYNNLLPALDFSLDLRDDLVGRFSFSRTIARPDYGNLFAAQSAGTPNRPVANGAIPLGSSGNPDLEPLISDNFDVSLEWYYKPSSYITAGFFEKRVNNFVGTGTVSQNLFGLRDVSSGAAGTRSGNAKAILTAIGADQTDVNLFTMTALLQTTGSAAAAQAQFQANRGVTGDLNQAFVDQILAAVDLSPNSTDPLFNFQVSKPINNRTGKIHGFEIAAQHFFGDTGFGVSGAYTMVRGDVAFNNGASPSQDQFALLGLSDTANATLIYDKNGISARIAYNWRDKFLAATNRGGSRNPVYTAPFGQLDINVSYDVTPKLAISLEGINLTKESLRTYARDENQLWFAQELDRRILLGARYRF

SEQ ID NO: 10681 - protein, 355 aa, Cupriavidus taiwanensis
MQKQYKPALKLAAVAATLFSGAAMAQSSVTLYGQADMFIGGVKSPGSGERAWVANSGGMQTSYWGIKGTEDLGGGTKAIFDLNGFFRTDSGNSGRFTGDSMFSRNAYVGLQNDKLGTLKLGRNTTPYFISTILFNPLVDSYVFSPTIFHTYFGAASNGVVDPGIIGDSGWSNSVLYSTPNFGGLSANLIYSAGEKAGAAGQNKWGGNLMYFNGPFAATVAFQQVRFNAVPDDLSVAGLSRQDAVLGGITYDFKVVKLFAQGQYIKTKASTAASGDIKHTNGQVGASVPVGAGSVLASYAYGKTENAIGDFKRNTFAVAYDYNLSKRTDVYAAYYYDKITGIEHGDTFGVGMRHKF

SEQ ID NO: 10682 - protein, 108 aa, Cupriavidus taiwanensis
MNGGGDMVQPLGFGPGVPVIAGSGGADVEAWTRFYGAWSDVDGDGNAAAADTDTSGFFVGVDGMVSDTVKLGVLGGYSSTDLDVDARNAMAAPTPGISASMPGRSSTA

SEQ ID NO: 10683 - protein, 360 aa, Cupriavidus taiwanensis
MKKFFIVSTLLLSSIFSVAHAESNTVKKKWNFGIQFNSLNPLKSFYNYKILCLKNYKNITKKIISLNPGFFTKYQKNPYLNFELKLNLLENKIKDIKKNTLNAYFSNVEYATNIMYPLKKYLNIYTKIGAKIKANIHNTCLKDIFMIKKYKKFSPLFSIGLELLINKYLHSNIDINLNKHFHKLQLNKISTFTDNVNIGFSWKFNPVKDKIINLFKKSNNKLFLENYESFNKYKNIKDKIFFHPKIFKLSSTSNDFLNVLINKISKIKKDKIYLIITGNMNNQLKKTKKNKIMSFKRALEISKFFVNNGILKKNIIIQGINNIDLKNNIILNKFFTGKNLLNDPYFENQKVNIELKINSK

SEQ ID NO: 10684 - protein, 629 aa, Cupriavidus taiwanensis
MRSSIVLLFLCISLGALAQQGPTPPQTAAGGPPPTQPQPDEVVVVTGTWEPMPLEDLQRSVQSVDVQAAPLLFSSTAQFLQLDPSVDVRQRAPGGDQADLSIRGSAFEQSLVLIDGLRVNDAQTGHHNLDLPIPLDTISRIEVLHGAGSTFYGADALGGAVNFITAPAATSELRLRAGFGNFGYNEQRAVASHATKNFSEQLIGDRSFSTGFIEDRDFRNAAVSSETHFHTALGDTMFLLATSDRPYGANQFYGPFDSWERTKAWFVAWTQDLGKQTAFDFGYRRHTDEFVLLREAPSVYENNHVTDSWQGALRRHDEIGKVTTISYGAEGYRDQIDSNNLGYHGRNRGAVYAAADFRMIKRFSLSVGAREESYNGTKGQFTPSVSAAYWFAPSFKVRGAVSRGFRIPTYTDLYYSDPANAGNPNLRPESAWSYEGGVDWNAGGKIALTATVFHRREHDGIDYVKCGSGFTFDINTGTCIASGVPNDVWHAYNIDSLNFTGFETLLRYRLTQRQEFTVGYTGIHGSQNAAPRVQSQYVFNYPVNNTYVGWQGSVWRGIIARTRLGVTQRYAHDPYALWDFSVAREEGRIRPYLQFTNLTSTTYQEVDGVAMPEFGVIGGVEIAVFGKKR

SEQ ID NO: 10685 - protein, 1102 aa, Cupriavidus taiwanensis
MRIKFLCIIICLFVNALVFASATNHTITGVVISGEDNEPLIGASVYVHADDLKKAGVSQTSLGTITDIDGKFSISVPEKVTRIHCSYIGFEEQAIILQGNKKNYRIVLQPSAHALADVVVTGYQTLERRKLTAAIAKVELSDAMIGANKSIDQALTGQIAGVAVTTTSGAPGAPARIRIRGTASLNGTQDPLWVLDGMPLEGTDIPKLDDATDNDIVNMQQSSIAGLSPNDIESITILKDAAATAIYGARAANGVIVVTTKRGRTGKPIINFNTKLTYTPNLDTSRLNLLNSQEKVDLELQLLKNNQSIYPNKGGVATILNKYNLMNQYLQNGWEGLSPEAQNAINQLKTMQTDWNDILFRDAFTQEYNISISGGTEKTTYYNSLGYSKENGNVPGVSMTRFNLTSKTSYQINKILKIGVSIFANRRKNQNFVSDKYGYSNPVFYSRTANPYFYPYDAEHNYQYDYDILPGDEPDLKRGFNIFEERENTDNETIISSFNSIFDTELRFNDQWKLSSQVGIQWDQSSQEQYVGENTFNMRNIREDSSYDENQYIVPKGGMHTVNNATTSQITWKVQGEYKNTFNDIHDIQIMAGSEIRKNWYNTQFTAGYGYDPKTLTTKPLNIRNDKDAEKYKLHTKTYQENAFASFYTTGSYSFMSRYTIGGSVRMDGSDLFGVDKKYRYLPIYSISGMWRASNEPFIQRYKWIDNLAIRLSYGLQGNIDKTTSPFLVGSYDNVGLLPGYDKEQTIQIEGAPNSKLRWEKTASYNLGLDFSVLNQAINLSVDYYYRKGTDLIGKKLLPLENGFETMTINWASMENKGVEINLQTRNITTKKFSWYTTFNFAYNQNKVLKINTPDSQETPSLEGYPVGAIFTLKTDGIDSETGRIRVKAKNGKSMFLEDLYKVAIDEWGIGIYTPQVSTLEEREFYSYIGTSDAPYTGGFMNTFNYKSWELNLNFSYNFGAYVKTTPSYSLTKFDASRNTNRDILDRWTPENKNGKFPAILTAASNPAEYSLLFDQPRIYNSLDIWVKKLNYIRLQNIRLAYQIPSKLLNRININGATVAVEARNLFVFGSSYKNYLDPESMGNLYATPIAKSVTFNLSLNF

SEQ ID NO: 10686 - protein, 379 aa, Cupriavidus taiwanensis
MKKSLLALAALGAFAGAAQAQSSVTLYGVVDANIEYVSNMSSVTPSAANGFATGPSENLFRMSSGGLSGSRWGLRGVEDLGSGLKALFVMESGFGLDDGRSQQGGRLFGRQAYVGLESAQVGRVTFGRQYTSLFDMMANFSPTGYATQYEPVVAQLGLNFRSDNTAKYTGKFGPVTAVAHWSFGNGVAGGGEVAGQFRRDTGYGAGVSWSAGPFGISGAYDQYNPTLNAAGGTGEFKKAAVAASYAFGPAKLMAGYRWGMSKHVNDNTILKDNYYWVGANYQVTPALGLTLAYYYDDVKNFNPAAATVNTTNNIKNPWQISFVADYNLSKRTDVYLTTAFSKNAGLNFDTSAISFANGYFLGTGEDKMIGAAIGIRHKF

SEQ ID NO: 10687 - protein, 390 aa, Cupriavidus taiwanensis
MRRPSTWATKISQSVDKESVDMKMKLFAAAVAALAAGGAYAQSSVTLYGVADVGLEYVNNANAAGDDLFRMSSGNQSGSRWGLRGVEDLGGGLKGVFVLESGFDLDTGSNATSQGGRLFGRQAYVGLQSQFGSLLLGRQQTSFYDFGLQFDPMAISSRYGILSQDSAFASRADNTVKYIGKFGGLTASAFYSFNNNGQEVAGAFRRGQQYGALVSYAAGPFAVGAAYDEIHGSTTGTPPVDASGQRTRRATVGANYAFGPAKVYAGYRWAKAFDGAALTGGTTVDNGVLTTSTASNLYWLGLGYQLTPAFSLSGAAYYQDFRKSEADPWQFVITADYALSKRTDVYTSLSYTLNDKGSALGVNGFNTATTTNVQANKDQFGAVVGLRHKF

SEQ ID NO: 10688 - protein, 376 aa, Cupriavidus taiwanensis
MNSTSSKQAPTSQDTRILCLTRKHSVYATGLGLLLTTFCASSHAEIAINVPNANLSIYGRVASGVSYVDNIGAAGDSVFRAASNEWGTSLLGLNGSKEIAPGIQGQIKLETGFSAANGNSNAGNLFSRFATVGIKSNTMGTIEFGRSLAYSNDAWSLDPMGMNWSGVDSLSKGHNWGTWNNTVGYRSPNLSGFEAGLQLSLGGQAGNNSAGRSLAASLSYTHANLNVRAIYDETRDANGKLSDLFNASSEYIVGATYKIQSTTLFAAYNRISASDAASGTDTAMDHSWVGVNYQLNPDNLVRVGLFTAKTDVTNAKANLYTVGWDHKVNDALSLWASAALMDNNKNAAFPAVGYWQDAPAPGATQHGINAGFIYVF

SEQ ID NO: 10689 - protein, 882 aa, Cupriavidus taiwanensis
MHHLTLAAKAVRASIITMGSASVLFSGMTIAAEENAKVERIEVTGSRIKQVDMETVSPVTVINAADIAMTGEKTVADVLNNSAINSFGSWRGISGYGSGASSTSNVNLRGLGSSATLVLLDGRRMPGTSSSSGSVADTSSIPMAIVERIEILRDGASAVYGSDAVAGVINIITKKEFDGLQLDYSTEQPSVEGGDANRLSIATGYNTDKGNITLTYEYYDTKAVMDRDIWNMDDPSYSAYSGFSSVPNGSSASGWYSNSEICEQTENTVDTTDGKNVGRCLYNHGNVTKLFGDQTRNSILSNFSYEITDAIQFRGRASASLAETETRYAGTPVSTNYPVMSADNKFNPLGEDMTLYMRSAQIGERDTLTETNNVDILGGFVGTLDFGNGIDWELNAQHSRSTTNSFNYNLINDEIVQQGIDSEQYDIFNTSGMSYQQWNQQMTELYRKAAHTGVYQGKFESTQLDGLASTLLVDNGDVSVAMVGGLEYEMIKFKQTSDPESASGIISGGSGGDDVDAERDRSAAYLEFQVGLPANVELSAAVRYERYEQEGSLTGAQGQVVNSSTFDAVVPKFGLSWRPVDSLLLRASYGDSFRAPNMSEMFSSQSLSFEKAVDSLWCNEPGNVDAVYCATNNQHKTWYGGNPNLEAEEGNSLTLGGVWNVTDDWNVELSYFSITYDNKIESVDVDDILRDEIKNGSSPYIHRGADGKIEYIEAGVRNLASVETSGIDFVTAYNLETAIGDFNFKVDLTHVLDFKKQDNAEAEMIDYAGVTDTPDWRGNFATSWKYEDFSAAWTVVYIGSQSADYYNTLEETDRYVDYSSYFKHNIQFAYSHTYNGTITVGVNNLFDADAPNYYTYADYRDVNVGLYDVLGRTYYLRINQKF

SEQ ID NO: 10690 - protein, 615 aa, Cupriavidus taiwanensis
MPAILAAIASFTLVPATSFAQAADSGTDSRTTQLAPVVVTSTRTAQAITEALPHTTVVTQQDIVNSQAPDLRTLLRNQAGVEFSANGGMGTNTTLFMRGANSNQTLILIDGVRVSSASSGTAQLANILPDQIERIEVVRGNVSALYGSDAIGGVVQIFTKSGAGQAPAANAQVEYGSNNTRQGTVGYGGQIGDTSFNLTGSAFKTDGFSSINTKQAPRANPNDNPYENQSVSGQVKHRFAPNWDAGFTGYYSKSKLSFDSAFGRPTDDNRTNSELYTLSAFVNGKVGADWSTHFKLSQSEDRSDTFLNGRPNGTFNTRNRQFNWQNEYALAANHTLLFGTDYLQQELDSSAYGAPTRNVFSVFGGYDGRIGKHQLQLNARNDHYSDFGNQGSFRAGYGYYVTDALKLIASVSNAFRAPTFNELYFPNFGQPNLQPERAKSVEAGVQYATASAGLLRVTAFETRYDDLIVSAQQPSGMFLAQNVNKAKVQGIEASWRATVYGTDFGASVTFQNPVDEQTNTQLLRRARRHAALDVGRDFGNWRFGGEWLVSSSRMDSGSRRLGGYGIVNLNARYNIDKQWFIAARVENLFDKDYQLAYPYNTQGRAGFITLGWRQR

SEQ ID NO: 10691 - protein, 78 aa, Cupriavidus taiwanensis
MKATKLVLGAVILGSTLLAGCSSNAKIDQLSSDVQTLNAKVDQLSNDVNAMRSDVQAAKDDAARANQRLDNMATKYRK

SEQ ID NO: 10692 - protein, 363 aa, Cupriavidus taiwanensis
MKLARIAAGLLAASPLLASAQSVTLYGVVDTGVEYVSNVGANGYGLTRVPNNTATVPSRWGLRGTEDLGGGLKSIFVLESGFAPDTGSANQGGRLFGRQALVGLSNQYGQLSFGRQYTMLFWATLDSDILGPNVYGSGSLDSYLPNTRADNAVSYKGTFGGFTVGATYSFGRDAVNAGPSPAGTNCAGENPADKKACREWSAMVQYATNWWGVHTAYDSQRGGPGAFGGLTNSNLTDDRLSVGGYMILSRTKLGAGWLRRDNEGSATRISDLYYAGASYDITPAINLAGQVYYLNYHGSDNKAWLYALRGTYAFSKRTSVYATAGFIDNGGQLAASVSGGSPGSNPKPGANQFGTMLGIKHIF

SEQ ID NO: 10693 - protein, 1161 aa, Cupriavidus taiwanensis
MSRRFTEITLFLSVLCLLLGTAYAQYGASLEGTVTDKSGAVVPGANVTITDQATSVSRNTVTSGSGFYRVTAMPPGMYTVSVEASSFGKSETKNVDVQAEKVRGLNITVSPAATQQSVDVSTEAAGLETESANVDGTITTKQVDRLPTYGRDPYSLLRLAPGVFGDASLAGNGTANWFPNSPGPGQNDQPGIFQNENFVQATANGQRASGNNFMIDGTSVNSLTWGGAAIITPNQESIQEITVVSSTYSAEDGRNSGAQVKVVSKSGTNNFHGSGFFKYDEPGLNAQNQWGGPTPGTPTEKVNVKARDFGGSIGGPIVKNKLFFFFSYEGGRYSNTNYSTQWVETPEFDQLLAATYPNSLIGQAVTLPGNAPRILNVIPQTDCSAVLGQGYTAPGCHVINGRLDVGSPIGTYGDYAPVFTAGSLGSGFDGVPDLEEAFIALPGTSKGNQYNLRVDYNLGSKDLLAFSGYMVPRNDVVATNSGRPNEDLTFEPRNKYGAILWNHTFSATLLNEFRVNATRFFTNQYDTNKNAYWGIPYLQIEQIPNNRINYGATQGTNAPLMAAQNQFEFRDNLSKNMGRHAFKMGGSFAMNQDNNDYEFGSQRPIFVYHELWNFFNGAPIYEGIDADPRSGQPTDVHKYFRQNDWALYFQDDWKITPKLTLNIGIRYEYFAPLTEKYGRLSNLYLGAAGPDALTTATVKTTDQLYPPDRNNFAPRLGFAWSPFSDAKTVIRGGVGVSYNRITDTMTGISRVNPPYLFRYGICCGTETGAFGTPYVGGQIDPNVVGTNYQSMYNYGPNPVLTNNFDPTTGLPITGSVEVWGAPQNMATPYIWNYSLDVQQELPWNMVLDIGYAGSETRKLLRIVNLDYIYSNAGSDTASHANPVYFPSTSANGNYSALLVNLNRRFSNGLQFIGKYRFSKSMDTVSGEGAGFETNQFWPLNQTWDYGPSDFDSTHNILFTALWDLPIYRNRHDWVGTLLGGWHVDGTYQYHSGFPWSPVQSNDCPTIPLIGSAPCPALVTAQYMNGKSGLANDDFLHGGIFPNALVTVTCPGGATATINQYFQPADCSQPPAGPPFIHRNSFRGPNYSTVDLAIGKTARLPWFGGESSQIDFRANLYNAFNRLNFEPFGYSSSATSINSNTFGQPQAALAGRVIDFQVRFTF

SEQ ID NO: 10694 - protein, 803 aa, Cupriavidus taiwanensis
MQPLFMPRPALALAIALMPAAVLAQAQRSYDVAAGPLDAALRSTAAQAGVALIFTADQTAGQRSAGLRGSYTVEGAFEALLAGTAWQAVRQASGAYALRRVEQVVPAAAAGATLGTVNVTAAAERSAVSEGTGSYATRQSSTATRLGLSQRETPQSVSVVTRQLMDDQGLTSLPEVLEKTPGITVGRNDSERTTFYSRGYAIENFQFDGVPNTMDSANQYTTSLADSAIYDRVEVVKGATGLLTGAGYPSAVVNLVRKRPTKTFQASAEAAIGSHDRLRGVGDISAPLTEDGRVRARVVAVAQNAKSHVDDYSRNVRSLYGIIEADLGPGTVASLGIDHMQTRANGASFGHIPLFFKDGSRTHFPTSLNPAARWSYWDNDSTNLFAELKHSFGNGWKADLSASRLRQSRDVEVGVAAHGMVDPVSGLGINMLSNKIPTDATTQAVNAALSGPLQLFGREHELSFGASWSRQRRHAPGYTNAYGPVGNYFEWDGQVPRPDFQLSDHRMTRIVEKGAFGAARLRPTDELSVILGARVSWYDMLDDTTGLDGSYGVNNALRVAHKTVPYAGVVYDLSRQLSLYASQTDIFNPQTYYKDAAGSPLPPLTGRSREVGVKGEFLDGRLNASLALFHIQQRNAAQYVSANPETGEEVYAAIDGVTSKGVEMEVSGSITPAWNIYGGYTYRTSRAPAQPDVILSAVNTNQPRHLFKLSTSYRLNPQWTVGGSLAWQSLTYYQQSSAPYARADQRAYALVGLMARYDVDRQWSVTLNVNNLFDKTYMPGLGSYGTGVYGDPRNVLLTARYRF

SEQ ID NO: 10695 - protein, 428 aa, Cupriavidus taiwanensis
MSLHNVCYTTLKQQESDVSLVQSKKLILGALGALVAAVPSVGLASGFDRGVVPPDFLYEKDDIVQVSLAVVKPDVRGKIVASPKATLEAQASFLQGQAAANPGNLALQQQAAQVTYLASKAPAVGQETGNLPGDYERKGISLKKTINDDFTIGLQVTQPAGLDIAYPDEIFGVYVETEITSLDLLLKYQVNDVFSVFGGPRIQQNSSGGFANDLNGEFHYQGTTEVGYMVGAGYKNPDLHTQVLVSYTSDIKHTMDATPISGSGPVADGVIATDYEGEVYINTPDHFQVAIKQPLSDKSALIASYRKSGWSQANIETNLAGFESLTDFKDVEAYTLGYGRKLTEEVALFATLLHQTGEANVFGPVNNRTGAALIAQFKVDRFKVETGVTYFDLEDAETTIPMGAAGDVVTKFEGNSALAYTFRLGYYF

SEQ ID NO: 10696 - protein, 482 aa, Cupriavidus taiwanensis
MHSFRLAAAVLPLLLSSCMLGPDHAPPETPLPEKFSEGAKQSAGDVAVSAWWDSFSDRTLNQYVASGLDENLSVQQALERVNAAAADVTIAGAGGLPKASHTTSGEIGKGGDITSTQNISSVQLSLTWLLDVFGQYRRSTESALASLDSAHAAVDAAKLALIKDLVSSYIDARYYQQRVSISRANLKSRQETYDFTNLQVEAGAASRQDVLQAEGLVRSTIAEIPRLELNFRVSAHHIAALLALPSETVIKQLQKSEGQPVYRGKINAGIPADLIRNRFDIRQAERDLAAATAQIGVAEAQLYPAITLSGSITPSYIKQRGRHGGILKWSFGPSLDLPILDGGRLRANVETSKSDAAAAYISWKLTVLTAVQEVEDALTAVRRDVHTENSRRRQVETIEEALKLSTASYTDGASSLLDVLEAQRQVSSAQASLAAAIQQLAKDHVRLNVAIRGGFAAPKVASPREASTVAAANANIQSAHSP

SEQ ID NO: 10697 - protein, 2732 aa, Cupriavidus taiwanensis
MEARAWGASVSAQQSGGIQMNRAFALVWNAAIGNWLVTHELVRRRGKPGAPRRQLPALVVLTVGATAAPMLAWGACTPAIPAAGATVTCSGLPSTSNIFASGANNLTVNIASGSQMTAGLLGGTAIALSGTNSTLNNAGTIDPSVLGLLSVLSSGVTMGNASSTAVTVNNLAGGTIYGTGGVLGANLLNLDGMALGLTSASGGTVQINNAGVIDSRPLAGLSILSSNTPVIAVTGGGTVNAVNTGTINGRVGFQSSATGNTFVNAGAINGSVSMGAGSTNSFTAVTTGTVNSAGGIALELLGPGGLLSFAQTGVVDGGLGGSNTLILQNSAVGTGSGSTGAGTLSTAQYINFGNLRVNSGTWSVGGANNFGNSALNGGVLQFANPAQLGNTITANGGTLEATAAGLTLAPTNGIALGTGGLSLQGTNNLIIGSAITGTGALTKTGTGELTLNGAGTFTGGVNLIDGALTVGTNSALGTGTVTASGGSVLAGASVNLANAFSLSNTVGIGGENPLRIAGTISGTGLLNKVGTGTLTLGGNNTYSGGTTLGAGSVLLETSGALGTGTVTAAGGSLDTTAPLSLTNNFALTNTLGLGASGNALTLSGTLAGVGGVNKTGAGTLTLGGLNTYSGGTNLASGTLQLGTASALGTGALNVTGASNLSTTAPLTVANAISLAAALNLPSTQALTLTGAISGAGSLIKNGTTTLSLTATNSYSGGTSLTAGTIAVGADNALGTGPLAVLGNSVLSNAVAVALANDIALGAALTVDNAADMLASGAISGSGDLIKTGLGTLTLSGNNSYTGPLAIQAGTVVASTAASLGNASNVDVAAGALLNLTNGGLINTLTGAGDVDTDTGATLQLVGGGDFAGSLGGGGNLDKVGTGTVRLLGTSAIGGSTQVSGGTLDVVGSLGTSALNVALGGTLTGTGTAGNVGAAVNISDGGRLALTSGSSLSVGALTLAPGAFVDVALGAPSTTRLLEVNGNLTLDGTLNITDIGGFGTGVYRLIDYTGALTNNGMLIGLFPGSVDISQLALQTAIGQQLNLVVTAPGSIVQFWDGVQTTANGTIDGGNGTWGAATNWTGQDGSANSAWQGDFAVFSGAAGTVGVQGTQNIGGLQFVTDGYQLTDVGAGALAVTNPLTAIRVDPGATASIGVAITGIGGVEKLDTGTLVLSGPNTYTGGTALSGGSLVLGNAQALGTGTLTAAAGTTLDTNQAWAVGNAVVLNGALTVPGSNDLALTGAISGPGSLIKNGTSTLALDGSNSYLGGSVLNAGTLAVGSNTALGAGALSVLGTSTLSNAIALALGNNVNLGANLTIASADNLALTGVLSGAGALTKTGLGTLTLSGSNLFSGPVSVQSGVLATSSTGTLGTTASVDVAAGAGLSLGSNTALNSLAGLGNVAIVGSNTLQLGVNNVSSTFAGSLSDAGNLEKVGTGTLQLTGTSAIGGTTQITAGTLDVDGTLGSTGGLTVGTGGTLSGSGVVDAAVTVNDGGRLVVTSGSLLTTGSLSFAPNATLDAFLGIPSQTGVLAVNGDLTLDGTLNITDIGGFGTGVYRLIDYTGVLTNNGMGFGTLPGTVDSTQLTLQTSLAQQVNVVLLESGNTAQFWDGAQTVANGIADGGTGVWTAGATNWTSGDGLTNSDWQNSFAVFGGTAGNVGVQGTQGIVGMQFITDGYVLSDAGAGALSANAANTIIRVDPGVTGTIDVAIGGTGALQKLDTGTLVLSGSNTYTGGTALGGGSLVLGNAQALGTGTLTTAAGTTLDTNQALTVGNTVVLDGALTLPGSNDLALTGAISGAGSLIKNGTSTLTLSGNNSYAGGTVLNDGTLAVAGDTALGSGTLSVNGDSVLSNPVAAALGNAVTLGAALTVDNPADLTLAGNISGSGALIKTNTGTLTLGGSNTYSGGTTLTAGTLVGDSASLQGAIVDNATLAFNQVADGVFNGSITGTGTVVKDGVGALLLNGANGYTGGTSIVAGTLIGDTASLQGDIANDAALVFNQTTDGVYAGTVSGTGSLEKAGAGALQLLGPNTYTGGTVISAGSLVGNTASLQGDVVDNATLIFDQATDDTFAGTVSGTGSVIKQGTGALTLVAPNTYSGGTTVASGSLIGTTASLQGDIVNNAVLVFDQAGDGTYAGNVSGSGALIKQGAGALTLQGGNSYLGGTTINAGTLIGNTASLQGDITNNSTLTFLQNSAGTYSGRLFGFGRFIKLGNGTLVLTANSGSFTGPTEVNAGTLSVGNQANPGAALGGPVTVGPGGTLTGSGSIGSLVSSGTVVIGGTSGTISVGGNATFAPGSTLQVAPGAGGVVTPVTVGGAATVATGTTLELVRATDLPLFTEIPVISASGGLTGQFTNIISDYAFIDPNVSLTATALSVTFGRNTVGMVGMVTTPNQQSTAAAVDGLPNTSPIYQAVLRLPDDPEAVRTAFASLSGESHASTATALLDSRFLNSGIGNHLRGDSQDTLVGDTMVWITGRSLPNRVDGNADAVSVRRENNGVMAGAERRFGESSVVGIAVGNQDIKSWSREWGDRADVDGTHAGVYGRTDWSAFSLQGVVDYASYNIDSTRRLMLPGVLAERLSSSYDATAVTVSLEAAWNLRTKGAVYSPFVAADYTRLKTDGFTERGGISALSVDRASDTFSTATLGVRGHWDLGQKAGLYASAGWRHAFGDRSVQRSAGFVGTASEFSVQSVTLAKNAVVGELGVSLITSPGSRLALSLQGLDGDGQTAYGGQVTWAVSF

SEQ ID NO: 10698 - protein, 773 aa, Cupriavidus taiwanensis
MRRQVGQIALIISGLGVLPLSESAIAQSSSSNGGTTLTPIEVIAPRTRPATRNRTVRATPNPHRAAVRPRSREAAPPPAAAPSPPALPQTGTVGQPPAPYAGGQVGTGVRMGMLGNTSVLTTPFNVTGYTSKLMEDQRARSIADVTLNDPSVRNDAPPFSERDSFFIRGFSVTNLDTAYDGLFYLANPRRSFLEGIERVEVLKGPSALLSGGTARTGGTINMIPKRAGDEPLTRLTTTYISNSQIWNHADLGRRFGENKEWGVRFNGSYRKGDTPLDLNSAEVGVAALGLDYRGERFRASLDFNSSVQNIRAPTSLFNSAAPNIIIPHAQNGRINTSSRDEFIDSRYKMVAGRAEYDLLPDTTVYIAGGGSRYNEDFLTSSYRITNPNGTATNSLAIQPQKLQGFAGEMGLRSKFRTGVIGHQFNVAAVTMTNELYRGGVLGFTPFSYVTNIYNPVRLPPGSFQTTGFARSDDRPLFTRLVARSVAVSDTLSVFDDRLLLTLGGRWQDIAITGYATAPGPNLGMETSRNQQARFSPAVGAVLRATDRLSLYTNYIESLDAGPTAPALAGNSGTVFPPVVSRQQEVGAKYDFGTVTVTASLFEIRQPFAFTDPGTNLFSVAGLQRNRGFELNVFGSPIEGLRLLGGIALMDARQVNTIGGRFDGNNVPGVPVTALNLYGEYDLPHWMAPGVTMTGRLIRTGDVFYDQANTQSVSGWTRVDLGARYTFVGPLGKPIVMRAIVENVADNAYYLSAARGFLAVGAPRTYMLSATFNF

SEQ ID NO: 10699 - protein, 804 aa, Cupriavidus taiwanensis
MLFRQTCLAAAITAVFAGNFVQAEEAPDRKMEVIVVTASGYEQKLVDAPASISVITQEDLMIKPYTTLLDAVRDLEGVDIGETRDKTGQGTISLRGMGSDYTLILVDGKRQNNHGDIYPNSFGGNQFGHVPPLDAIDRIEVIRGPASTLYGADALGGVVNIITKKVGDEWSGSVTHSRTNQTNDAYGEDITTDFSVMGPLIKGVLGLSVHGSIYDRMGSTPEYAPVNYPNGEVRTRSLGFGGGGKTVDNENHMLGGSLSWTPNEHHKIWFDLDSSSQEYDNTPLINADGVREYPLGTVDNLESLWVASNFCKGGVGSREAACLASGGEWARRSNPRVGYSETQKFTRDAWALTHEGAWDFGTSFVSLSYVDTQNHGRTLPFTTAERTLLLQMIDGKGAYTGMTEAERKAIVSSTFLPRPKREMASNQYTLDMKLDIPFEAAGNHVAVTGAQVIRGELKDGVFGMEEGTPGAVQEHNMWSVFAEDTWSMTSDLSVTAGLRHDDHEIFGNQLSPRLYGVYTINNEWTVKGGVSTGFKTPKTTQLYDGVVGFGGQGTSPQFGNPDLEAETSVSSEVALYWSHPDGHNFNVTVFKNDFDDKIASQPCGTGTSIECSDAGEYADLGYAVSTKTVNIDKVTIQGAELAGRWEILDALTFNANYTYTDSEQKSGAEQGRPLGNSAKHMANATLKWEITDSVNVFLTSEYRAKRYRSWDTINDAPLYYKGYNVFHLGGSYQASEFVTFNMRINNLFDKDFTTYDIVFTECSDTSATCVSDDNGQNGYTASYVDDYNNKDKARNLWVSMNVRF

SEQ ID NO: 10700 - protein, 699 aa, Cupriavidus taiwanensis
MLLKSTFNISLLTLSLISSWCLADEKKVSNDLETIEIYSKSYRSTGTKSGLTPIESPMSFEVYDNKLLQLRQVDSVNEALRYVPGVTPESRGVATLFDQYSIRGFESYRNYYDGLLLQYNLAYNLAPQVDAFATENVEVLKGPTSVLYGSAPPGGMVNQTAKMPQQISQHLVRARLGINNLAELALDSTGMLTEQVNYRFIALGRRRDGQQKTTEEQRTIIAPSVTFEISEKTSLNLNVYYQDDPNMLPSSSLPGQGTVYAASYGKLDADAYAGDKNWTMFEREVTMLGFKLNHEFNDNSSFLQNFRYTLGDSTLRNTYGKGLADGDKIYKRSAYQTIEDIEGFVVDNQYGTHISTGKFNHNLLVGFEYQTLDSTFNYSDTFGNNTPAIDLSQPDYTLFNIDQLPLDTYQQFSRLAQQQRGFYLQDELSQDQFTAIIGLRYDDFTSVSEDDESGDISETHINQNELSIRLAAIYTLDNGIAPYLSYSESFEPTAGKDSITGKAFKPTTASQIEAGVKYQNDAATTRITAAIFDLKKKNMITSTPDFMKKTQSGAVQSKGIELSIFQQVNDYIDITANMTKLDISVTENPNDPSLIGKTPIWVAQQQASLWLNYYFSQNFELNGGLRYVGESQLDKHNTDVIPGYTLLDFAASYDFSDQYRLGLAVSNLTDKRYVGSCVDVRRCWMGAERSIELTLNASF

SEQ ID NO: 10701 - protein, 646 aa, Cupriavidus taiwanensis
MKGKVVVTTAVLLAGTAMEAAQAETFNLEPVQVVGSDVHPSQEVRTQVEDSFNQSRSASYVNGSVIQNLNPVNKGDALRYNAVGLINQPGDGGRFGGGTKIRTFGDWGASESIDGLPAFKLAGEEGGGYANTIIPSIAVDRIGVLRGGRAVQYGDGTDGGVVETTIKSGRYYTNHQAVNLDVSTAKEAMTQGEIADHGEAWDYYMAGNWLQGEYNGDPENLERQRVLGGLGKFGWNIGPDTRGEFLAIIDRSSPDIIRNGNVESIEVNSEVGAATVDHKFSDRSSVRVGALVTNTRSTWDARARDRNVNNRIVFADHYLSTPLAEGLRYDGSLGLEYKQTEYQRDRLWDNTFDDIALKSANSLTVNDNLVLSAGLRHTWFSNDIIYNGAEQPNNLADDKVWSYEFGASYSVLDNTRVRGSVATGYNRFIEKYGNFGADALNANGAGDDIVESRTYELGINQGWAGGWLDVALYTTEQDGVPRRNNDAIESVKVDQSGLEVELFTRITSQLTMSAGYMRVLQLETTRADGTKVNGNIFWDGQSTSVPENQFNLRLDYHLTETVNLWGAGYYSTGYEAVAADDSVVERDGFLRLDLGAGWAITPNWAVRARVENLTDERDFGQTVKGAPVNDEGKLGRVFWLGTDITF

SEQ ID NO: 10702 - protein, 802 aa, Cupriavidus taiwanensis
MNQFYKKSHYSIQKHQITGLLFLLFIYPFSTSYGNEQFSFDSRFLPSGYNYSLNSNLPPEGEYLVDIYINKIKKESAIIPFYIKGNKLVPCLSKEKISSLGININNNDNTECVETSKAGISNISFEFSSLRLFIAVPKNLLSEIDKISSKDIDNGIHALFFNYQVNTRLANNKNRYDYISVSPNINYFSWRLRNLFEFNQNNDEKTWERNYTYLEKSFYDKKLNLVVGESYTNSNVYNNYSFTGISVSTDTDMYTPSEIDYTPEIHGVADSDSQIIVRQGNTIIINESVPAGPFSFPITNLMYTGGQLNVEITDIYGNKKQYTVNNSSLPVMRKAGLMVYNFISGKLTKKNSEDGDFFTQGDINYGTHYNSTLFGGYQFSKNYFNLSTGIGTDLGFSGAWLLHVSRSNFKNKNGYNINLQQNTQLRPFNAGVNFDYAYRKKRYVELSDIGWHGNLYNQLKNSFSLSLSKSLNKYGNFSLDYNKMKYWDNAYDSNSMSIRYFFKFMRAMITTNCSLNKYQSYEKKDKRFSINISLPLTKDYGHISSNYSFSNANTGTATSSVGLNGSFFNDARLNWNIQQNRTTRNNGYTDNTSYIATSYASPYGVFTGSYSGSNKYSSQFYSASGGIVLHSDGVAFTQKAGDTSALVRIDNISDIKIGNTPGVYTGYNGFALIPHLQPFKKNTILINDKGIPDGITLANIKKQVIPSRGAIVKVKFDAKKGNDILFKLTTKDGKTPPLGAIAHEKNGKQINTGIVDDDGMLYMSGLSGTGIINVTWNGKVCSFPFSEKDISSKQLSVVNKQC

SEQ ID NO: 10703 - protein, 383 aa, Cupriavidus taiwanensis
MKKALLAAALMTAGVVAHAQSSVTLYGRLDAGIEYMTGVPQGVGANGQATGSTNRWRAESGDWGTSLWGLKGVEDIGGGNKVLFQLEGSFNTMTGAGPGGGGLFNRWATVGLSNDQYGTFTMGRMLFISNGDWDFDPFGQSNWSSASLVRGRNWPQSSNNFAYQSPKIAGFDFYGQYALSNATSWNGNGTTPQGREAGAQITYTNSLFQIRGMYDEIRNPTNGTLYGPNASVVNAGNIGSGVFAASREYSAFVNVFLGQFKIQGAYQAIRSAGATGVLPGQPTTLDHEWGGVTWQATPAAALIAAVYHVNGNNGAGNATIYTVGGSYNLSKRTLLDIQVATTQNSKTANYGLNANNAGTATSTDNPLPGHSQTGVYAGIQHSF

SEQ ID NO: 10704 - protein, 753 aa, Cupriavidus taiwanensis
MSRQSTDTAVSSQRLLASAIGVAITAIAAPQAAQADEAGQKKTDKDRVLSLDAATIVGEQQDETTYNVDRSASKKYTAPLLDTPKTVTVIPQQVIKDTGALTLADALRTTPGITFGAGEGGNPAGDRPFIRGFNAESDTFLDGMRDVASQTREVFNVEQIEVSKGPGSAYTGAGSTGGSLNLISKTAKQDNFTDAGFTWGSDQTRRTTLDVNRMIGDNAAFRLNLMKHDAHVAGRDEVSVSRWGVAPTVTFGFDTPTRATLSYYHLSTDDMPDYGLPLTNVNRSKANPSKPASVDRDNFYGLKDRDYRKSTTDSGTFRIEHDLNDNLTLSNSTRLVRTTLDYIVSNPDDSRGNVANGYVYRSAKSRNSTSKGWVNQTDLKANFETGFIKHTLVTGLEFSYEDVHNRPYAITSGGGAGNTCNARLLASGDCTSLNRPTPGDNWTGSITDGLAYTDTDTKTSAAYVFDTLKLSEQWELNLGLRYDDFDTKSSGYQTAGRNGPAGYFKRENNSHFWNYQTGLVYKPAPNGSIYLAWSTSSNPTGETGGEGQADISVGNNGLDPERNRNLELGTKWAFFDDALSLNAALFRTDKTNARVASPDVSTLQVLDGEQRVQGVELGFNGKLTEKWKVFGGYTYLDSEIRKSTVKSDEGNKMPQTAQNNFTLWTTYDLLQNFTIGGGTTYVDKQYGNTANSTYIPSYWRYDAMASYKVSKNVDLQLNVQNLTDKRYFDQVYSTHMAHVAPGRTALLGVNFHF

SEQ ID NO: 10705 - protein, 949 aa, Cupriavidus taiwanensis
MLGCLMTGGVSLAQAAGAVTSVATRLDDATPRDYDIGQGPLGTSLGVFANQSGLLLSYDPDLTRGRAAPALKGRYTVLEGARRLLANTGLQLLPSASGTYILAPQARTSSTATELSATVVDSTELLDPQRDTYRAPRSTVHLSREDLDRFGTVSVGDMLKGVAGVQVGDSRNGGALDVNIRGIQGQSRVAVRVDGSEQALDVYRGYGGTQQRSYIDPDLLSSVTVNKGPSTRSGAIGGSVEMKTLGVDDILVDGKDVGLRLTGNLWNNGVDPDHRNSHSRDEDLSAVPRDKRNGLFGSKAESGSAAFAYSNERVDLVAAYAHRNQGNYFSGKHGQDRYRLYDRDGDEQSSVASTYNAGEEVLNSSSQTDSYLLKTTWRLADDHTLELGYRRFEGRMGEIMPSDIFRFGTAGIYQYPQSEIDIDTYTARYHYLPEGNPWVDLTSNLWMTDSKTSTLSAAWMAPKSQLFRTDRSWSRQDDRRIGGDLNNVSRFTTGYGDFKLDLGGAFQLEDLQPQKSVVATQHDINANRMLRDASRQEFSFNGKLEYQPIEQVTLWGGGRYAHYRTKDNTVLAEARREEREVRWITASSPEHWGSMMWFPDQNGQYTDATDPRLNNGIVFENSNEPFNGVPFNESGAVDVTVYPEDISSVVTGYNYTPQGKSSGGGFSPAFGINVEFLPDTFVYASYTQGLRLPSLFETSQGTQQVTPGKHLEPERSRSWEVGVSALRSSLLAAGDEASAKLAFFDNDIKNYITRYYDPSPGKWGQMTFSNTDRFRTRGLELQSHYDAGRVFADLSATYYLKTETCDAAFAAKLRASANRYQPTQNTPDCTPGSYMGSYTNTQNPPKFSANLTTGLRFFDEALTVGGRMTYTSGPTAQMDKPWQTGATTPQIDYRSVALFDLFLKYKVLEHTELNLSVQNLTDRYYLDPLAQSFMPAPGRTVRMGVQTRF

SEQ ID NO: 10706 - protein, 718 aa, Cupriavidus taiwanensis
MQPAFRLSGGAIGAALLFAQLAALPAHAADPAPAANPEATLNAVTVVGNWLENANEAKVLEHPGARTIVDRETFQEAGANNVREVLRRIPGVQVQENNGTGGSDVSLNVGVRGLTSRLSPRSTILMDGVPLAVAPYGQPQLSMAPLSLGNLETIDVVRGAGSVRYGPQNVGGIINFVTRPIPKTFVADASVSTDIYSHGGSVKTNPTAFIGGTNDNGLGGALLYSGIHGNGYRESNDHVNIDDLMLKGTYRISKTDELSAAFHYYEGRAGMPGGLTSAQYAADPFQSVRPYDNFDGRRSDFSLKYSHNDNNRKFEVLTYYTDSFRGSNIEQQGTGTQANLRRLTAAPRNYHTFAIEPRYSQLFRGESMSHEVSVGYRFLREASDEKASRTLFYTPGTIDPTTLRSPVYQSRTGGTTANAVYIDDTINVGSWTITPGLRYEFIRSYVTDNFTGARNDVSSNEPLPSLAVMYHVSDQWKLFANAGVSFGPLQYFQIAQTTNGLTPEKAKTYEVGTHFNANGWGGELTLFNIDFDDELQLRGGTGGAPDAWTNLGATTHRGVESSLRYDFGALDKSLAGLSAYATYTFTEATYNQGNFAGRDLPFYSRHVATVGMRYARNRWALNVDGFAQSKQRSPGDPSTSTNYQTAESANGALGDIPGYALLNMRLGYDFGKSAQNLKVAVGVKNVFDKRYFTRSTDNNAGKYVGMPRTFYIQASLAY

SEQ ID NO: 10707 - protein, 428 aa, Trichoplax adhaerens
ARTQMATAAPFVSDQSEAKGFVEDAKLTETLKNYYFNRDNKNGGRDQKDWTQGFLGNFTSGYTQGTVGVGIDGYGYLALKTDGGDGTSGSGNMSRSDTVNPNNGARDVNDSQGKAGASVKFRVSKTDLKFGDMQPSTAPVFAVGGSRILPQTATGFQLQSSEVKDLDLEAGHFYSASSQDKNARNGGLYANYAGVEADSIDYFGGKYSITENLSASLYGAKLEDIRNQYYANVNLTTPFSGDTSLNTDFNIYRTTDTGDKLAGDISNTAFSLATALSFLKAHTFTLAFQKVNGDTPFDYIGVGKNNRGGDSIFLANSFKYSDFNGPGEKSVQARYDLKMAEYGVPGLSILVGYVKGWDIDGTSTPAGSPYTGLYGEDGKDDGTNFEAKYVVQSGPAKDLSLRIRKAWHFANADEGGGDTLEFRLIADS

SEQ ID NO: 10708 - protein, 715 aa, Trichoplax adhaerens
MLYYAKQWGGFVALGFLLLATPWAALAEDGKNSPQTDKETHYQLDTVTVTVEKREQNSQDVPASLSVLSETAIEDAGLTSVEEAVSYMPNIHFIDFGAAFEQRIFMRGLGSTHNAPAVNFNIDGVTQFRSESLDMALYDIESIEVLRGPQGTLYGRNSLGGVINITTRKPDNELRGQIRTDFGNYNLQQYQGTVSGPVIKDSLYLGLAGSYKVRDGFTKNDFLDNDVDNMESVDGRVHLRLAPADSNFEANLKLYAEGDRHGTSALQLLDDVKDNPHTANFDHVSDTHRQVLGSSLSLEWKLDDGVFTSISAFQKLNLWSDSDFDFSTADMNTFTNDSESYQYSQELRYSAGTDKDIFRWTTGVYAWGSQQEDISSTTDGKDMPPMFGFPGNANHNKADLEGYGFAPFGQATVTVFDKLDLTAGIRWEWEKRDGDFHDYTERADTGTTVENLKGSDSIISQQWLPKFSAAYHFTDNLMAYASLAWGYRSGGFNFMYDPNNPESVSFDPETSINYEVGVKSTWLDNRLYANLSAYYIEIEDMQVSVGIPGKMTMLVDNAGEAHSRGAELEVGVRPFTGMDINASYGYTEMEYDKYTDPVKNVDYSGKTPPYVPNHTYSLSAQYRYPLTDTLTLFTRGEVIGVGKQYWGSDNAVSEDPYQLLNARIGVESEDFDVYLYGKNLTDQEYRKIGYLTGMGAVYAQSGDPLTFGVNLVYRF

SEQ ID NO: 10709 - protein, 197 aa, Trichoplax adhaerens
  misc_feature (3)..(4): Xaa can be any naturally occurring amino acid
SYXXRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKVAGDKDSGFGFAYQAKAGVSYNVTPEIKLYAGARYFGSYGANFDGEKKQGSGAEEVTTTDKGAYKVFYSTIGAEA

SEQ ID NO: 10710 - protein, 794 aa, Trichoplax adhaerens
MTKLTLISSAILSVLCTQSALAATITGKVINDKNQPIENASIHVHGKNQTIKSNELGEFSIEIDANSQLHISKDNYVDSRITVTESSNNVTVSLLPTSVETVVVYASALHKSSLEMISPVSVLSGDELRNKSKPTLGETLKGLPGVNASYFGPVSSSPIIRGLDGPRVKITQNGLDASDASRIGPDHATSSDSLAAEQIEVLRGPSTLLYGSGAIGGVVNVVDNRIPTSNLDDLTGAAEYSHDTVSNSNTVAAKLETGNDGFNFHFDGTKRSGDDYETPTFTVTDEDGDVETENSVENTFIDSETLNFGTSYVGEHLTVGFSYGSIETDYGIPGHEHHHEHDHEGETEEEHAEHEDEEEGEEAVFAELEQDRWQGLVSYALHNNWIETINLRIGYTDYSHSEIEDGEIGTTFTNKTTEARLNVEHKFADWHGMLGYHYSDSDYDAIGDEAFTPASITTSNALYVLEERVFGDVTLELGARIEDYKIESNISSAEHHHDHDEELEEEHEEEIIAYSESFTNVSASAGAIWQYTPGQSLALSLSHSERAPLSAELLSNGLHIATGTYELGLGYHIEDNEAHFEPEDIKQEKSTNLDLSFRRFSGDFGYTVNFFYNDIKNFYFQENTGLVYDEEEGLESAVGAHDDAVAVYQFKSKDAELYGFEFDAHYQITPNTMVKVFGDSTRAKLKSDEGNLPRIPANKLGSELQYDLGNLQLTLTGTHYFDQNDITAFESQTDGYTLFDAQANYQLGLGAVDAQFYINVDNLTDELGFVHTSFIKDKAPLPGRNIRLGVRGYF

SEQ ID NO: 10711 - protein, 742 aa, Uncultured marine microorganism HF4000_ANIW133B20
MGGRRPESVRAPACMVRLCVFSTGIHSFLQQWNDMSRMFKLHPLAACLAVALPALADDRDPQPLALPSTAITDTQDNRTIDLATPTQAGSRLGLSALETPASTSSISERQIQQRNNITVQDAVTRSPGITFVGSPGDGGTGLSARGFAGHSSVMTLFDGARLYTGAGTQTFPVDPWMVERIEVIRGPASVLHGEGATGAVINVIPKKPFAGEVRNHLRLGYGSWDRQQLGLDSGGSLSERLSYRLTLNQQAGNGWVDRTASRSLALSAALRFDASDDLSFTLAHDRGDAQPANYYGTPLIDGHYRSSLRKKNYNVQNDVQQYVDEWTRLTTDWALNDQLSASNQLYYIKSRRHWRNAEDYSWDAGRQQLLRGSYLEIKHNQEQFGDRQTFTFDHTLFGLDSKTVLGAEYNKVRFNVDSNSPYNDVGGDYLDPWQPQPGGFHSASPLRPQTLSTTHTFALFAENRLQLSDRLSLVTGVRRDQNHIDRNNLTNDSRSDRSLQGGNWRVGLVYAISDDLSLYGQYSTSEDGVNNLISLSPAQMNYDLTEAKQTEAGLKQRFWEGRGEWTLAAYHIVKKKLLVDDPITHEKQQAGQQTSDGLEATLELALAHQWQVSANASLIRAKYDDFDERVGGLPQDRAGNRPANVPRRTANLWLSKGFGQQVEAGIGARYVDERYADTANTQSAPGYTVVDANIAWRVLPDVKVGLQLNNLFDREYVQSAFSGQQWLMGIPRSYFATVDYSF

SEQ ID NO: 10712 - protein, 140 aa, Uncultured marine microorganism HF4000_APKG2M17
MFSILRPLLHTAALACALPALAADPQPASGGWAQPDPAPIGYAVLNVSRERVESGTACDVGLYVHDELVGNLQPGASLALNLQPGAVDVRLAPNGPGDACRNGMTILAGQTLTLRAGEIRNLRITLGAGGLYLAPVADGY

SEQ ID NO: 10713 - protein, 1628 aa, Rickettsia raoultii
STATIVASFAGSAMGAAIQQNRTTNAIATTVDGAGFDQTAVPANVAVPLNAVITANVHKGINLNTPAGSFNGLFLNTANNLAVTVSEDTTLGFITHVVNNANFFNLTLNAGKTLTITGQGITNVQAAATKNAQNVVVQVNNGAAIENNDLQGVGTIDFGAAASTLVFNLANPTTQKAPLILGDNAVIVNGANGTLNVTNGFIKVSSKSFATVNAINIGDGQGIIFNTDANNANALNLQAGGTTINFNGTDGTGRLVLVSKNAAATDFNVTGSLGGNLKGIIEFNTVAVDGQLKANAGPANAVIGTNNGAGRAAGFVVSVDNGKVATIDGQVYAKDMVIQSANAVGQVNFRHIVDVGTDGTTAFKTAASKVAITQNSNFGTTDFGNLAAQITVPNTMTLKGNFTGDASNPGNTAGVITFDANGTLASASADANVAVTNNITAIEASGAGVVQLSGTHAAELRLGNAGSVFKLADGTVINGKVNQTALVAGALAAGTITLDGSATITGDIGNAGGAAALQGITLANDATKTLTLGGANIIGANGGTIDFQANGGTIKFTSTQDNIVVHFDLDIITDQTGVVDASSLTNAQTLTMNGKIGTIGANNKTLGQFNIGSSKTALSDGDVAINELVIGNNGAVQFAHNTYLITRITNAAGQGKIIFNPVVNNNTTLAAGTNLGSATNPLAEINFGSKGVNVDTVLNVGEGVNLYATNITTTDANVGSFIFNAGGTNIVSGTVGGQQGNKFNTVALDNGTTVKFLGNATFNGNTTIAANSTLQIGGNYTADFVASADGTGIVEFVNTDPITVTLNKQAAPVNALKQITVSGPGNVVINEIGNAVNYHGAVTDTIAFENSSLGTVVFLPRGIPFNDAANIIPLTKSTVGNKTATGFDVPSVIVLGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSNSTSMIGTTKANNGTVTYLGNAFVGNIGDSDTPVASVRFTGSDGGAGLQGNIYSQVIDFGTYNLGILNSNVILGGGTTAINGKINLLTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSPFGGAPGVGQNVTTFVNATNTAAYNNLLLAKNSAYAANFVGAIVTDTCAAITNAQLDVAKGIQDQLGNRLGALRYLGTPETAEMAGPEAGAIPAAIAAGDEAVDNVAYGLWAKPFYTDAHQSKKGGLAGYKAKTTGVVIGLDTLANENLIIGAAIGITKTDIEHQDYKKGAKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKLTAHQGTL

SEQ ID NO: 10714 - protein, 198 aa, Wolbachia endosymbiont of Oligonychus ununguis
GPISDEETSYYVRLQYNGEVLPFKTKIDGVTYKSGKDSNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVGYDVTPEIKLYAGARYFGSYGANFGKTAKDDGGIKVLYSTVGAEAGVAFNF

SEQ ID NO: 10715 - protein, 158 aa, Neisseria gonorrhoeae
GLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGFYKRHNYTTEKHQVHRLVGGYDHDALYASVAVQQQDAKLTWSNDNSHNSQTEVAATAAYRFG

SEQ ID NO: 10716 - protein, 158 aa, Neisseria gonorrhoeae
GLKGGFGKVRVGRLNNILKDTGGFNPWEGKSYYLGLSNIAQPEERPISVRYDSPEFAGFSGSVQYMPNDNSSKNHSESYHAGFNYKNSGFFVQYAGSYKRHSYTTEKHQVHRLVGGYDHDALYASVAVQQQDAKLAWPDDNSHNSQTEVAATAAYRFG

SEQ ID NO: 10717 - protein, 158 aa, Neisseria gonorrhoeae
GLKGGFGKVRVGHLNNILKDTDGFNPWEGKSYYLGLSNIAQPEERHVSVRYDSPEFAGFSGSVQYVPNDNSGKNRSESYHAGFNYKNSGFFVQYAGSYKRHNYTTEKHQVHRLVGGYDHDALYASVAVQQQDAKLTWSNDNSHNSQTEVAATAAYRFG

SEQ ID NO: 10718 - protein, 158 aa, Neisseria gonorrhoeae
GLKGGFGKVRVGRLNNILKDTDGFNPWEGKNYYLGLSNIAQPEERHVSVRYDSPEFAGFSGSVQYVPNDNSGKNRSESYHAGFNYKNSGFFVQYAGFYKRHNFTTEKHQVHRLVGGYDHDALYASVAVQQQDAKLAWSDDNSHNSQTEVAATAAYRFG

SEQ ID NO: 10719 - protein, 158 aa, Neisseria gonorrhoeae
GLKGGFGKVRVGRLNNILKDTDGFNPWEGKNYYLGLSNIAQPEERHVSVRYDSPEFAGFSGSVQYVPNDNSGKNHSESYHAGFNYKNSGFFVQYAGSYKRHNFTTEKHQVHRLVGGYDHDALYASVAVQQQDAKLAWSDDNSHNSQTEVAATAAYRFG

SEQ ID NO: 10720 - protein, 1248 aa, Neisseria gonorrhoeae
GLIAVSELSGRVSSRTTGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKFSYKVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENYRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSIGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTSDISVSGNLSMTGNPDKDNKFEPSIYLNDASYLLTDDSARLVAKNKASVVGDIHSTKSASIMFGHDESDLSQLSDRTSKGLALGFLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNKNVFKASKQTIGFSNVTPVITTQETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEVGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 10721 - protein, 177 aa, Neisseria gonorrhoeae
GLKGGFGTIRVGSLNSPLKNTGANVNAWESGKYTGKFLEISKMAGREHRYLSARYDSPEFAGFSGSVQYAPKDNSGSNGESYHVGLNYRNGGFFAQYAGLFQRYGEGTKKMEGYTYNIPSLFVEKLQVHRLVGGYDNNALYASVAAQQQDAKLYGTWRANSHNSQTEVAATAAYRFG

SEQ ID NO: 10722 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYEHQVYSIPSLFVEKLQVHRLVGGYDNNALYASVAAQQQDAKLYGTWRANSHNSQTEVAATAAYRFG

SEQ ID NO: 10723 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDDQAYSMPSLFVEKLQVHRLVGGYDNNALYVSVAAQQQDAKLYGATRVNSHNSQTEVAATAAYRFG

SEQ ID NO: 10724 - protein, 179 aa, Neisseria gonorrhoeae
GLKGGFGTIRAGSLNSPLKNTKGNVNAWESGKFTGDVLEISGMAKREHRYLSVRYDSPEFAGFSGSVQYAPKDNSGSNGESYHVGLNYQNSGFFAQYAGLFQRYGEGTKKIEYDGQAYSMPSLFVEKLQVHRLVGGYDNNALYVSVAAQQQDAKLYGATRVNSHNSQTEVAATAAYRFG

SEQ ID NO: 10725 - protein, 179 aa, Neisseria gonorrhoeae
GLKGGFGTIRAGSLNSPLKNTDDNVNAWESGKSTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 10726 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSFPSLFVEKLQVHRLVGGYDNNALYASVAAQQQDAKLYGTWRANSHNSQTEVAATAAYRFG

SEQ ID NO: 10727 - protein, 175 aa, Neisseria gonorrhoeae
GLKGGFGTIRAGSLNSPLKNNNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNTPSLFVEKLQVHRLVGGYDNNALYASVAAQQQDAKLYGTWRANSHNSQTEVAATAAYRFG

SEQ ID NO: 10728 - protein, 179 aa, Neisseria gonorrhoeae
GLKGGFGTIRAGSLNSPLKNTNDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 10729 - protein, 177 aa, Neisseria gonorrhoeae
GLKGGFGTIRAGSLNSPLKNTKDNVNAWESGKFTGNVLEISRMAKREHRYLSVRYDSPEFAGFSGSVQYAPKDNSGSNGESYHVGLNYRNNGFFAQYAGLFQRYGEGTKKIEGYQYNSPSLFVEKLQVHRLVGGYDNNALYASVAAQQQDAKLYGTWRANSHNSQTEVAATVAYRFG

SEQ ID NO: 10730 - protein, 178 aa, Neisseria gonorrhoeae
GLKGGFGTIRAGSLNSPLKNTKDNVNAWESGKFTGNVLEISGMAQREHRYLSVRYDSPEFAGFSGSVQYAPKDNSGSNGESYHVGLNYQNSGFFAQYAGLFQRYGEGTKNEYDGHAYSMPSLFVEKLQVHRLVGGYDNNALYVSVAAQQQDAKLYGATRVNSHNSQTEVAATAAYRFG

SEQ ID NO: 10731 - protein, 179 aa, Neisseria gonorrhoeae
GLKGGFGTIRAGSLNSPLKNTKNNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 10732 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 10733 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 10734 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWRANSHNSQTEVAATAAYRFG

SEQ ID NO: 10735 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGAGRANSHNSQTEVAATAAYRFG

SEQ ID NO: 10736 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTEKIEYDNQFYSVPSLSVEKLQVHRLVGGYDNNALYASVAAQQQDAKLYGTWRANSHNSQTEVAATAAYRFG

SEQ ID NO: 10737 - protein, 179 aa, Neisseria gonorrhoeae
GLKGGFGTIRAGSLNSPLKNTKDNVSAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFG

SEQ ID NO: 10738 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDGQDYSMPSLFVEKLQVHRLVGGYDNNALYVSVAAQQQDAKLYGATRVNSHNSQTEVAATAAYRFG

SEQ ID NO: 10739 - protein, 179 aa, Neisseria gonorrhoeae
GLKGGFGTIRAGSLNSPLKNTGSKVNAWESGKYTGELLEISKMAEREHRYLSARYDSPEFAGFSGSVQYAPKDNSGSNGESYHVGLNYRNNGFFAQYAGLFQRYGEGTKKMEGYSYNIPSLFVEKLQVHRLVGGYDNNALYASVAAQQQDAKLYQNQLVRDNSHNSQTEVAATVAYRFG

SEQ ID NO: 10740 - protein, 179 aa, Neisseria gonorrhoeae
GLKGGFGTIRAGSLNSPLKNTDANVGAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVRDNSHNSQTEVAATVAYRFG

SEQ ID NO: 10741 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFG

SEQ ID NO: 10742 - protein, 179 aa, Neisseria gonorrhoeae
GLKGGFGTIRAGSLNSPLKNTKDNVNAWESGKFTGNVLEISGMAQREHRYLSARYDSPEFAGFSGSVQYAPKDNSETNGESYHVGLNYRNGGFFAQYAGLFQRYGEGTKKIEYDNQFYSAPSLFVEKLQVHRLVGGYDNNALYASVAAQQQDAKLYGTWRANSHNSQTEVAATAAYRFG

SEQ ID NO: 10743 - protein, 179 aa, Neisseria gonorrhoeae
GLKGGFGTIRAGSLNSPLKNTKGNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYATWSANSHNSQTEVAATAAYRFG

SEQ ID NO: 10744 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSIPSLFVEKLQVHRLVGGYDNNALYASVAAQQQDAKLYGTWRANSHNSQTEVAATAAYRFG

SEQ ID NO: 10745 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYDVQAYSMPSLFVEKLQVHRLVGGYDNNALYVSVAAQQQDAKLYGATRVNSHNSQTEVAATAAYRFG

SEQ ID NO: 10746 - protein, 179 aa, Neisseria gonorrhoeae
GLKGGFGTIRAGSLNSPLKNTDANVNAWESGKFTDNVLEISGMAQREHRYLSVRYDSPEFAGFSGSVQYAPKDNSGSNGESYHVGLNYRNSGFFAQYAGLFQRYGEGTKKIEYEHQVYSIPSLFVEKLQVHRLVGGYDNNALYVSVAAQQQDAKLYGARRDNSHNSQTEVAATAAYRFG

SEQ ID NO: 10747 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQFYSIPSLFVEKLQVHRLVGGYDNNALYVSVAAQQQDAKLYGAGRANSHNSQTEVAATAAYRFG

SEQ ID NO: 10748 - protein, 177 aa, Neisseria gonorrhoeae
GLKGGFGTIRAGSLNSPLKNTKGNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYGTWRANSHNSQTEVAATAAYRFG

SEQ ID NO: 10749 - protein, 178 aa, Neisseria gonorrhoeae
GLKGGFGTIRAGSLNSPLKNTNNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFG

SEQ ID NO: 10750 - protein, 179 aa, Neisseria gonorrhoeae
GLKGGFGTIRAGSLNSPLKNTKDNVNAWESGKFTGDVPEISGMAKREHRYLSVRYDSPEFAGFSGSVQYAPKDNSGSNGESYHVGLNYRNGGFFAQYAGLFQRYGEGTKKIEYDNQLYSVPSLSVEKLQVHRLVGGYDNNALYASVAAQQQDAKLYGTWRANSHNSQTEVAATAAYRFG

SEQ ID NO: 10751 - protein, 177 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEEYTYNIPSLFVEKLQVHRLVGGYDNNALYASVAAQQQDAKLYGTWRANSHNSQTEVAATVAYRFG

SEQ ID NO: 10752 - protein, 179 aa, Neisseria gonorrhoeae
GLKGGFGTIRAGSLNSPLKNTDANVNAWESGKFTGNVLKISGMAQREHRYLSARYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYQNQIVHDNSHNSQTEVAATVAYRFG

SEQ ID NO: 10753 - protein, 179 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNGGFFAQYAGLFQRYGEGTKKIEYDNQFYSVPDLFVEKLQVHRLVGGYDNNALYASVAAQQQDAKLYGTWRANSHNSQTEVAATAAYRFG

SEQ ID NO: 10754 - protein, 179 aa, Neisseria gonorrhoeae
GLKGGFGTIRAGSLNSPLKNTKDNVNAWESGKFTGDVLEISGMAKREHRYLSVRYDSPEFAGFSGSVQYAPKDNSGSNGESYHVGLNYRNGGFFAQYAGLFQRYGEGTKKIEYDNQFYSVPSLFVEKLQVHRLVGGYDNNALYASVAAQQQDAKLYGTWRANSHNSQTEVAATAAYRFG

SEQ ID NO: 10755 - protein, 179 aa, Neisseria gonorrhoeae
GLKGGFGTIRAGGLNSPLKNTDDNVNAWESGKFTGNVLEISGMTKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYGARRANSHNSQTEVAATAAYRFG

SEQ ID NO: 10756 - protein, 177 aa, Neisseria gonorrhoeae
GLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKMEGYAYNIPSLFVEKLQVHRLVGGYDNNALYASVAAQQQDAKLYGAWRANSHNSQTEVAATAAYRFG

SEQ ID NO: 10757 - protein, 179 aa, Neisseria gonorrhoeae
GLKGGFGTIRAGSLNSPLKNTGANVNAWESGKFTGNVLEISRMAQREHRYLSVRYDSPEFAGFSGSVQYAPKDNSGSNGESYHVGLNYQNSGFFAQYAGLFQRYGEGTKKIEYDDQAYSIPSLFVEKLQVHRLVGGYDNNALYVSVAAQQQDAKLYGAMSGNSHNSQTEVAATAAYRFG

SEQ ID NO: 10758 - protein, 165 aa, Helicobacter pylori [sequence omitted]

SEQ ID NO: 10759 - protein, 959 aa, Achromobacter sp. BP3
MGPIHGMGSGRTPMKKQDVARTVLASALAVALSACGGGGGGGGIRPSTPAAPPVTSPPPPPPPTSPPPPPVTTPTTPEPAIDAHLALTNARAAQALGFTGAGYRIGVIDTGINANHPALQGRVSDSFIYVDPRTNNTAVGDVVGHGTVVAELAAGRAVGQWPGGIAPGAGLVSARIISDRAPEDDGSGDGNEVDGPLGLGPVHADLISAGVRIMNNSWGGLFWNDPTVTNQIAQEYRPFILSHDGLVVFASGNESRSQPSDTAALPSQPGPNGTLPAADLERGWLVVGALDTANPTQLASYSNACGVAMRYCLVAPGTSLFIDPDATAGNIRYFYGSGTSFAAPLVSGAAALVWQAFPYFNNDLVRQTLLGTATDLGAAGVDPVFGYGLLDVGKAVLGPARFDWGTVEVDVTTLRSTWANDISGTGGLTKRGTGALVLSSTANTFTGDTQVLGGTLQTASLQSARVSIANGARLVGAGSIGGRVDNAGTLQVNGATASIAGNYTQASNGRLAVNVGDRLNVAGTATIAGDLQLLGRRDYVVNNTTYAVLQATNGLQGTFDTLSSGPAVTFLSATRSYDANTAYVSLQRMDVTAVAASLGAIGTASMDAAIRVEQAFQQVDAQQFQGNGALSGAFIRAAAALQQSPTAKAAADSLRSLSGRAHADSAAMTFDTIDLGRRALAAHFDGLSQQPRLLGNWQRALGGPGEGGATTSGFATSGWMMGNDLRLASGAVTGFAFGETRSSSLGDLDGARGRDRQVQAQLYWGTTLGAAYTLGQMGFGNVNRQIERTLQLGEDRSSAFSDYSGSYLSSNLETGYRLGGAHASLTPYMGLDYVRLRSDGFRESGGDGFGLRANASTSSRAQALAGVRSAYHWRGIQLGGYAEWQQALSSDGLTLDASFVGVDAWAPLRGMQPARSGGLFGITAAAPLGQQSQLRFGYDQRVGERGDDRALSLRYSADF

SEQ ID NO: 10760 - protein, 185 aa, Wolbachia endosymbiont of Plutella xylostella
SYYVRLQYNGGILPFYTKVDGITNATGKEKDSPLTRSFIAGGGAFGYKMDDIRVDVGGLYSQLAKDTDVVNTSETDVADSLTAFSGLVNVYYDIAIEDMPITPYVGVGVGAAYISNPSKAGVVKDQKGFGFAYQAKAGVSYDVTPEIKLFAGALYFGSYGASFDKAAKDDAGIKNVAYSTVGAEA

SEQ ID NO: 10761 - protein, 196 aa, Wolbachia endosymbiont of Plutella xylostella
SYYVRLQYNGEFLPLFTKVGGITYKKDKSDYSPLKPSFIAGGGAFGYKMDDIRVDVEGVYSYLNKNDVKDVTFDPANTIADSVTAVSGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 10762 - protein, 188 aa, Wolbachia endosymbiont of Plutella xylostella
SYYVRLRYNGEILPLFTKVDGITYKKDKSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKVLYSTVGAEA

SEQ ID NO: 10763 - protein, 925 aa, Wolbachia endosymbiont of Plutella xylostella
QKKSDVTGAMARVGSEELNTRPVNNAFEALQGKAAGVDITSSERPGTVGSIRIRGNRSISASSDPLYVVDGVPLSAGGIETINPRDIESIDILKDASSTAIYGSRGANGVILITTKRGKAGRLALNYSGSVTLENLKDKSPAMSASDYITWRRWAYYNSDPVNNPRGDQPNYDKDQIYFAASGDPAALANVNKGWSNGTWDGSKVTDTDWADIVTQTGITHEHTISGSGGNETAQAFFSVGYLNNQGTQKGQEYERYNFSMSVDLQVKPWFKMGGSINGSWAVQDYGYSRTGQSSGSGPVDIYSAAKAIPRFGVPYDEEGNIITNPCGSTTNVYTVIDEWNKSTDNRQTFRALGSFYGQFDFGKIWAPLEGLSYKISFGPDFRHYRQGIFISKDSAVKMGSKNYAKYATDRYLSWTLDNQINYNKTFGKHNLGVTLLQSASKYNKESGSESANAIPNENFEWYNMGSVDITDAATYGAGMSTGMSENQLASYMARVNYAYNDRYLLTVSGRYDGSSVLADGHKWSFFPSAALGWRIDQEDFMKDISWINQLKLRFGLGTTGNSAVSAYSTLGNIQSFYVPFGSTLTPAYATNEPYYTSSQVKMANKNLGWEKTTQYNYGIDFSFLNGRISGSMDIYHSNTNDLLLSMTIPTLTGFNSTYANVGKTKNFGVDLSLNLVPIQTKDFEWSSTINAAYQKDEILELANGKQDDISNAWFIGESINVYYGIANDGLWQESDAAEMAKFNANGHKFEAGMVKPVDQDGNYIIDSNDRIILGNKNPKWVLGWSNTFNYKGLELGIELNGRFGYIVDTGGEGQNGMYNQREINYWTPDNTGADYQKPIYSTAGGDAYSSLLGFKDASFIKIRNISLGYNFNSKALKNIGISSLKLYAQAKNIGNLYSSVDFMDLDLGTTYYNRGFTFGLQVGF

SEQ ID NO: 10764 - protein, 186 aa, Wolbachia endosymbiont of Plutella xylostella
SYYVRLQYNGEILPLFTKVDGITYKKGNSDYSPLKASFIAGGGAFGYKMDDIRVDVEGVYSYLNKNDVTDAKFTPDAIAGSLTAISGLVNVYYDIAIEDMPITPYIGVGVGAAYISTPLATAASSQNGKFAFAGQARAGVSYDVTPEVKLYAGARYFGSYGANFDKTDKDGKGELKVLYSTVGAEA

SEQ ID NO: 10765 - protein, 162 aa, Wolbachia endosymbiont of Plutella xylostella
  misc_feature (78)..(78): Xaa can be any naturally occurring amino acid
SYYVRLQYNGEVLPFKTRIDGIEYKKGAEVHDPLKASFMAGGAAFGDKMDDIRVDVEGLYSQLNKNDVSGATFTPTTXANSVAAFSGLVNVYYDIAIEDMPITPYVGVGVGAAYISNPSEADAVKDQKGFGFAYQAKAGVSYDVTPEIKLYAGARYFGSYGA

SEQ ID NO: 10766 - protein, 162 aa, Wolbachia endosymbiont of Plutella xylostella
SYYVRLQYNGEVLPFKTRIDGIEYKKGAEVHDPLKASFMAGGAAFGYKMDDIRVDVEGLYSQLNKNDVSGATFTPTTVANSVAAFSGLVNVYYDIAIEDMPITPYVGVGVGAAYISNPSEADAVKDQKGFGFAYQAKAGVSYDVTPEIKLYGGARYFGSYGA

SEQ ID NO: 10767 - protein, 194 aa, Wolbachia endosymbiont of Plutella xylostella
SYYVRLQYNGEVLPFKTKVDGVTYKSGKDNNSPLKASFLAGSGAFGYKMDDIRVDVEGLYSQLSKDADVVGTSPAVAKSLTAFSGLVNVYYDIAIEDMPITPYVGVGVGAAYISTPLETPINDQKSKFGFAYQAKAGVSYDVTPEIKLFAGARYFGSYGASFDGKKLDPEGNKQVADTDAGAYKVLYSTVGAEA

SEQ ID NO: 10768 - protein, 162 aa, Wolbachia endosymbiont of Plutella xylostella
SYYVRLQYNGEVLPFKTRIDGIEYKKGAEVHDPLKASFMAGGAAFGDKMDDIRVDVEGLYSQLNKNDVSGATFTPTTVANSVAAFSGLVNVYYDIAIEDMPITPYVGVGVGAAYISNPSEADAVKDQKGFGFAYQAKAGVSYDVTPEIKLYAGARYFGSYGA

SEQ ID NO: 10769 - protein, 162 aa, Wolbachia endosymbiont of Plutella xylostella
  misc_feature (11)..(11): Xaa can be any naturally occurring amino acid
SYYVRLQYNGXVLPFKTRIDGIEYKKGAEVHDPLKASFMAGGAAFGYKMDDIRVDVEGLYSQLNKNDVSGATFTPTTVANSVAAFSGLVNVYYDIAIEDMPITPYVGVGVGAAYISNPSEADAVKDQKGFGFAYQAKAGVSYDVTPEIKLYAGARYFGSYGA

SEQ ID NO: 10770 - protein, 186 aa, Wolbachia endosymbiont of Plutella xylostella
SYYVRVQYNGEVLPFKTRIDGIEYKKGTEVHDPLKASFISGGAAFGYKMDDIRVDVEGLYSQLNKNDVSGATFTPTTVANSVAVFSGLVNVYYDIAIEDMPITPYVGVGVGAAYISNPSEASAVKDQKGFGFAYQAKAGVSYDVTPEIKLYAGARYFGSYGASFNKETVSAAKEINVLYSAVGAEA

SEQ ID NO: 10771 - protein, 162 aa, Wolbachia endosymbiont of Plutella xylostella
SYYVRLQYNGEVLPFKTRIDGIEYKKGAEVHDPLKASFMAGGAAFGYKMDDIRVDVEGLYSQLNKNDVSGATFTPTTVANSVAAFSGLVNVYYDIAIEDMPITPYVGVGVGAAYISNPSEADAVKDQKGFGFAYQAKAGVSYDVTPEIKLYAGARYFGSYGA

SEQ ID NO: 10772 - protein, 955 aa, Escherichia coli B171
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDAIINFTGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMTMKASNGLNIHLNHYESLLGRASMILGYDITAGNSQLNVYVKTGAIREFSGDTEYLLNNSREKYSFKGNGWNNGVGVSAQYNKQHTFYLEADYTQGNLFDQKQVNGGYRFSF

SEQ ID NO: 10773 - protein, 672 aa, Escherichia coli B171
MIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYCVSMNIAWRFE

SEQ ID NO: 10774 - protein, 790 aa, Escherichia coli B171
MKRVLIPGVILCGADVAQAVDDKNMYMHVFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSSVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPESDREMGNKSYGLAWDMDTQLAWAKLRTTVGWDHISDYTRHDHDIWYTELSCTYGDITGRCTRGGLGHISQAVDNYTFKTRLDWQKFTVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHISQVDINPQIVFSYIKSKGNLSLNNGYEESNTGDNQVVYNGNLVSYDSVPVADFNNPLKISLNMDFTHQPSGLVWANTLTWQEARKARIILGKTNAQYISEYSDYKQYVDEKLDSSLTWDTRLSWTPQFLKQQNLTFSADILNVLDSKTAVDTTNTGVATYASGRTFWLDVSMKF

SEQ ID NO: 10775 - protein, 342 aa, Escherichia coli B171
MRKIVAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPNLH

SEQ ID NO: 10776 - protein, 948 aa, Escherichia coli B171
MKRHLNTSYRLVWNHITGTLVVASELARSRGKRAGVAVALSLAAVTSVPALAADTVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINENGRQIVAAEGTANTTVVYAGGDQTVHGYALDTTLNGGNQYVHNGGTASGTVVNSDGWQIVKEGGLADFTIVNQKGKLQVNAGGTATNVTLKQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIHFDNQTTPDAALSRAVAKGDSPVTFHKLTTSNLTGQGGTINMRVRLDGSNTSDQLVINGGQATGKTWLAFTNVGNSNLGVATTGQGIRVVDAQNGATTEEGAFALSRPLQAGAFNYTLNRDSDEDWYLRSENAYRAEVPLYASMLTQAMDYDRILAGSRSHQTGVNGENNSFRLSIQGGHLGHVNNGGIARGATPESSGSYGLVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLRDSAKHSVRELPVNWWVQPSVIRTFSSRGDMSMGTAAAGSNMTFSPSQNGTTLDLQAGLEARVRENITLGVQAGYAHSVSGSSAEGYNGQATLNVTF

SEQ ID NO: 10777 - protein, 948 aa, Escherichia coli B171
MKRHLNTSYRLVWNHITGTLVVASELARSRGKRTGVAVALSLAAVTSVPVLAADTVVQAGETVSGGTLTNHDNQIVFGTANGMTISTGLEYGPDNEANTGGQWIQNGGIANNTTVTGGGLQRVNAGGSVSDTVISAGGGQSLQGQAVNTTLNGGEQWVHEGGIATVTVINEKGWQAVKSGAMATDTVVNTGAEGGPDADNGDTGQFVRGNAVRTTINKNGRQIVAVEGTANTTVVYAGGDQTVHGHALDTTLNGGYQYVHNGGTASDTVVNSDGWQIVKEGGLADFTTVNQKGKLQVNAGGTATNVTLKQGGALVTSTAATVTGSNRLGNFTVENGNADGVVLESGGRLDVLEGHSAWKTRVDDGGTLAVSAGGKATGVTMTSGGALIADSGATVEGTNASGKFSIDGISGQASGLLLENGGSFTVNAGGQASNTTVGHRGTLMLAAGGSLSGRTQLSKGASMVLNGDVVSTGDIVNAGEIYFDNQTTPDAVLSRAVAKGNAPVTFHKLTTSNLTGQGGTINMRVRLDGSNASDQLVINGGQATGKTWLAFTNVGNSNLGVATTGQGIRVVDAQNGATTEEGVFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSTQHVRAGFRLGSHNDMTFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 10778 - protein, 774 aa, Escherichia coli B171
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGVRDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVGGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 10779 - protein, 199 aa, Escherichia coli B171
MRKVCAAILSAAICLSVSGASAWASEHQSTLSAGYLHARTNAPGSDNLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSDTSLAWGAGVQFNPTESVAIDIAYEGSGSGDWRTDGFIVGVGYKF

SEQ ID NO: 10780 - protein, 663 aa, Escherichia coli B171
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNAVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10781 - protein, 632 aa, Escherichia coli B171
MVIQNGQTVTETVALDADGDSLTIDAGGAIDVTDQDGVVISADDVVVVNDGTINTTGFDAGGIFSGGVGAVSINNGTITTLGAQGDGIVSNRADATNTNNGQISTDGFDADGILSFEQNALNTNTGSVSTLGGGSGGIFSRGRDSQNNNSGSIVTQGDQSDGLLSVGFASTNTNSGAVQTSGFDADGILSLGSSTQNTNTGDIVTIGDASSGIFSQGRNTTNINSGTIRTSGVDSDGVVLLGAGATLTNTGLIHVTGEDSQAVRGGSGSQTVNLGAGSVIIGGFDLGFGSDTVNYDNSGGGVSAVLTFENVENVIIKGDDRPLFATGDVITVVDTTGFSVLNDATGFLADTAQRTIGQQAGTDGAWASVIGASRDRKDDGVTLSYQTGLFGVIAGYETDLGGSRLGLVGGVSTGKTETDETSIEIATQSLFGGAYIGTSLGGLDLTSSLLAGIESHDSDRVVADNLAGFETATAKIDGSFVTAGLQAKSSSFGLGGIQFQPSASAQYTFASYDGYSESGTTNANLDVDSRTAQSLNARVQLETFSTAGAFETAFRFGIDGRATDAEDITITLGEESQSFAETDSDTALGGFLGAQAVFSETQAMRVVGDFEFGFADGGERAVAGGLNVSFSF

SEQ ID NO: 10782 - protein, 351 aa, Escherichia coli B171
MKKSTLALVVMGIVASASVQAAEIYNKDGNKLDVYGKVKAMHYMSDNDSKDGDQSYIRFGFKGDTQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRDTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 10783 - protein, 855 aa, Escherichia coli B171
MGSESSTGPSSTDSPIMASIRLTYRRRPAPARHLPRASCPAAPGRFARRPSGAVLLSALLPLPALADTDTDASRATQRASRRAFDIPAGPLEATLNRFGRDAGILLAFPPELTAGLASGGVHGRFDVDGAFDRLLTGTGLVALRQPGGGYTLMRADGSAAGPVAAGVAPATELPTIDVRSSALRAESYRAPKEAGVLRSDIPLLDTAQAVNIVPAQVLRDQRPRNLDDALGNVSGITQGNTLAGTQDTIMKRGFGGNRDGSIMQNGMPLVQGRAFNAATDSVEVLKGPTSLLYGLMDPGGVVNVVTKQPQLVRYNAISLGASTFGHGKNGGSATFDSTGPIGDSRLAYRLIVDQSNEQYWRNFGEYRQTFVAPSLAWYGRDTQVAVSYQYRKFHSPFDRGTALDPRTNAPLDIPARRRIDEPFNNMDGESQLAQLSVDHQFNADWSAHFGYSYNRETYDANQLRTTGVDPVKGTMTRSNDATHGSLSTDSYGIGYVTGKLTLAGMRHDVQVGFDTEYRRIYRKDMLRQAVKTPFNYIDPVYGLLPPSSTVSASDSDQTDTLHDASAFFQDTVHLTDKWIVSGGLRYITYNQVAGRGRPFVANTDLSGSKWLPRAGVVYKWTDAFSLYGSYSQSLKPSSSIAPMTGYIIDGATPPEEATAWEVGGKLDLPGGMTGTLALFNIDKKNVLVSQYNDATKLTDWRTSGKARSRGVELDVSGKLGERVNVIASYAYIDAKTTEDPLYAGNQLWNVARHTASLAAVYDFGTVAGGDDLRIGADVRYVGARPGDSANSFTLPSYVLADAFATYDTRIGKQKLSFQLNVKNLFNRTYYPSSANRYFVAVGDARQVSLLTTLQF

SEQ ID NO: 10784 - protein, 746 aa, Escherichia coli B171
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYQQGNDDLKAETSINKEIGLEFKRDGWLAGVTWFRNDYRNKIEAGYVAVGQNAVGTDLYQWDNVPKAVVEGLEGSLNVPVSEMVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 10785 - protein, 199 aa, Escherichia coli B171
  misc_feature (180)..(180): Xaa can be any naturally occurring amino acid
MRKVCAAILSAAICLAVSGVPAWASEHQSTLSAGYLHASTDAPGSDDLNGINVKYRYEFTDTLGLITSFSYANAEDEQKTHYSDTRWHEDYVRNRWFSVMAGPSVRVNEWFSAYAMAGVAYSRVSTFSGDYFRVTDNKRKTHDVLTGSDDARYSNTSLAWGAGVQFNPTESVAVDVAYEXSGSGDWRTDGFIVGVGYKF

SEQ ID NO: 10786 - protein, 199 aa, Escherichia coli B171
MRKVCAAILSAAICLSVSGAPAWASEHQSTLSAGYLHARTNAPGSDNLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSDTSLAWGAGVQFNPTESVAVDIAYEGSGSGDWRTDGFIVGVGYKF

SEQ ID NO: 10787 - protein, 948 aa, Escherichia coli B171
MKRHLNTSYRLVWNHITGTLVVASELARSRGKRTGVAVALSLAAVTSVPVLAADTVVQAGETVSGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATDVTMTSGSALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTQDAVLSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESNGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 10788 - protein, 215 aa, Escherichia coli B171
MTENKEVIMRHLYATILLFTTLLAGIAFPAQAESGHGAFSVGYAQVHPGGVPALSGTGARAGDLKGINVKYRYEFTDHLGGIVALSYASVKKSDTMKTGENTFHYESLRGRYVSLMAGPVWQLSERVSLYGMAGMAYTRWSDSVQDYRRDEVKPGYVKETTTASDGHTARHLSPAWNAGIQFSPVETVVIDLAYEGSGSGDWRTDGFIVGVGHKF

SEQ ID NO: 10789 - protein, 199 aa, Shigella dysenteriae 1012
MRKVCAAILSAAICLAVSGAPAWASEQQATLSAGYLHASTNVPGSDDLNGINVKYRYEFTDTLGLITSFSYANAEDEQKTHYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10790 - protein, 436 aa, Shigella dysenteriae 1012
MRKIVAMAVICLTAASGLISAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKSGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAQIVTRGYESSKRDVRIEGAGILGGMNYRVSEGPLQGMNFFLAADKGREKRDGSTLGDRLNYWDVKMSIQYDFMLKSEITPERKTSGVSDC

SEQ ID NO: 10791 - protein, 752 aa, Shigella dysenteriae 1012
MIVRYWRSILLVCTAAAVVLPVSQSFAQSAAATTPQATTDDSTVLQKIVVKGKRVAPGSVADTPLATEITQKQLEEKQVTNYDDIGRSVDAGVNYSRGDAGFNLRGLSGARILTTIDGIPIPYISNSSRQGAFAPANANGGGDTFDFDSLSSLDIVRGADSSKGGSGMLGGAIVLNTLKPEDLIPEGRDWGAIVKSTYDSEDRSLSGSAAAAKKIGGTSILFQGGYRKGHERDNMGDNDSYGALRTEANPADFDQNNLLFKLRQELEGGHRIGLTAERFRRDLKTDLRQLQGGTSPRNFMIDNYDGRELRDRDRVSLDYDYEAQSSDAFFSSARATLYWLDLKKEAGSRGRTTANVAYGRNNEIENETWGFSGTATKDFEYSGLNHSMRVGLDVGVSSWSQYSWALCPTSTTCPALNNQAEVPDVDSQNLGLVVEDKIEIGNTGFTLTPGFRFDWFNYNPSTGGDFANNTGLTRFGDLRNRTEAALSPKILATYDLTPDVELYMQLAVGFRAPTVDELYSRFYNPTSRYAQLGNPDLEPEIGRGIEVGATFDTGDVTGRVALFHTRYQNFIETVTTTDATGFTEFNYTNVAAATISGIEASAAKTFNNGINLHASLAYAYGRNEETTQRLRSVAPFKAIVGGGWSNETFGFDLSSTLSAGMLTDHLNTPVTNTADTTFDAPGYAIVDLTGWWTPERLPGLRIQGGVYNIFDQEHYNALAVREVNLSSATASQPREWYSEPGRTFKVSLTKTF

SEQ ID NO: 10792 - protein, 366 aa, Shigella dysenteriae 1012
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNGHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 10793 - protein, 764 aa, Shigella dysenteriae 1012
MKSKRYLVGSSMLSVATLLSVQPALAQTTAPADSGLNEIVVTAQKREENINKVPMSITAATGEQLRSVGVAQVRDLVKITPGLTYADSGVGTPVYTVRGIGFSDIALAGRPTVTVYADQAPLPFSSEARGAALDLERVEILKGPQGTLFGTNSTGGAINFVAAKPTNDLQAGADFSYGRFNSHQIGGFVSGPISSTLSARLAVQHDGMDAWQKSYTTDRKLGVQDFWNGRLTLDWAPSDRLKTSFTLNRWIDHSDTQAQQFIAYRPTTPAPVPELTGYPVAPHNARAADFDTDKSYRRDNDFIQANFRVDYDVADALTLTSLTSYSRYRENQLADLDGTTVNNSYFQTIGRLRSISQELRLSGSIADRGHFTIGANYADDDTSEVNPTFSPVSSVSNLFSGLFGTPLPVTFTTDTNQDSVTKAVFANFDYDLTDAINVYAGGRYTDFRTKFTGCAGDSGDGVAATIFSVLNGSPVLPGQCFTVTEAGTAGVVRSTLKQDNFSWRAGVQWTLAPRVLVYANVSKGYKAGSFPIVPANSYLSFNPVTQESVLAYEAGFKAGLFNRALQLNGALFHYDYKNKQVLGSVVLPGVGNVLRLLNIPKSRVNGAELEITAAPVTGLKVSAAGTYISSKVTSSFVNVDPFGTPGDFKGQAFPNTPKWQFTGDSEYKWPVSERLNAFLGGNVSYQSETYSQFGELALFKTKAYARLDLRAGIEAEDGKWRASIWGRNVTNTYYYSAATYVQDAVVRYMGQPVTYGVTLAFRYR

SEQ ID NO: 10794 - protein, 1363 aa, Shigella dysenteriae 1012
MNKIYSLKYCHITKSLIAVSELARRVTCKSHRRLSRRVILSSVAVLSLSSAWPALAATVSAEIPYQIFRDFAENKGQFTPGSTNISIYDKQGNLVGKLDKAPMADFSSATIATGSLPPGDHTLYSPQYVVTAKHVSGSDTMSFGYTKNTYTAVGTNNNSGLDIKTRRLSKLVTEVAPAEVSDVGAVSGAYQAGGRFTAFYRLGGGMQYVKDKNGNLTQVYTNGGFLTGGTVSALSSYNNGQMISAQTANIFNPANGPLANYLIMGDSGSPLFAYDSWQKKWVLIGVTSSKTDSGNNWVVTTQDFLGQQPQNDFDKTIAYTSGKGALQWKYDAANGTGTLTQGNTSWDMHGKKGNDLNAGKNLLFTGNNGEVVLQNSVNQGAGYLQFAGDYKVSALNGQTWMGGGIITDKGTHVLWQVNGVAGDNLHKIGEGTLTVNGTGVNAGGLKVGDGTVILNQQADANGKVQAFSSVDIASGRPTVVLSDAQQVNPDNISWGYRGGRLDLNGNNLTFTRLQAADYGAIITNNSEKKSTVTLDLQTLKASDINVPVNTVNIFGGKGSPGDLYYDSSTGNYYILKASSYSPFFSDLNNSSVWQNVGKDRNKAIDTVKQQKIEASSQPYMYHGQLNGNMDVNIPQLSGKDILALDGSVNLPEGSITKKSGTLIFQGHPVIHAGTTTSASQSDWETRQFTLGKLKLDAATFHLSRNGQMQGDINATNGSTVILGSDRVFTDKNDGTGNAVSSVEGSATATTAGDQSDYRGNVTLENKSSLKIMEKFTGGIEAYDSSVSVTSQNAVFDRAGSFVNSSLTLEKGAKLTAQGGIFSTGTVDVKENASLTLTGTPSAQKQEYYSPVISITEGINLGDKASLSVKNMGYLSSDIHAGATAATINLGDSDAVGKTDSPLFSSLMKGYNVVLNGSITGEQSTVNMNNALWYSDGNSTIGTLKSAGGRVELGGGKDFTTLKVKELNANNSTFLMHTNNSQADQLNVTNKLSGSNNTVLVDFLNKPASEMNVTLITAPKGSDEKTFTAGTQQIGFSNVTPVISTEKTDDATKWMLTGYQTVADAGTSKTATDFMASGYKSFLTEVNNLNKRMGDLRDTQGDAGVWARIMNGTGSADGGYSDNYTHVQIGADRKHELDGVDLFTGALLTYTDSNADSHAFSGKTKSVGGGLYASALFNSGAYFDLIGKYLHHDNQYTANFASLGEKDYSSHSWYAGAEVGYRYHLSEESWVEPQMELVYGSVSGKSFNWEDRGMALTMKDKDYNPLIGRTGVDVGRSFSGDDWKITARAGLGYQFDLLANGETVLRDASGEKRFEGEKDSRMLMTLGMNAEIKDNMRFGLELEKSAFGKYNVDNAINANFRYSF

SEQ ID NO: 10795 - protein, 948 aa, Shigella dysenteriae 1012
MKRHLNTSYRLVWNHITGTLVVASELARSRGKRAGVAVALSLAAVTSVPALAADTVVQAGETVSGGTLVNHDNQIVFGTANGMTISTGLEYGPDNEANTGGQWIQNGGTANNTTVTGGGLQRVNTGGSVSDTVISAGGGQSLQGQAVNTTLNGGEQWVHEGGIATGTVINEKGWQAIKSGAVATDTVVNTGAEGGPDAENGDTGQTVYGDAVRTTINKNGRQIVAAEGTANTTVVYAGGDQTVHGHALDTTLNGGYQYVHNGGTASGTVVNSDGWQIIKEGGLADFTTVNQKGKLQVNAGGTATNVTLKQGGALVTSTAATVLGSNRLGNFTVENGKADGVVLESGGRLDVLEGHSAWKTLVDDGGTLAVSAGGKATGVTMTSGGALIADSGATVEGTNASGKFSIDGISGQASGLLLENGGSFTVNAGGQASNTTVGHRGTLMLAAGGSLSGRTQLSKGASMVLNGDVVSTGDIVNAGEIYFDNQTTPDAVLSRAVAKGNAPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQSGVSGENNSVRLSIQGGHLGHDNNGGIARGATPESNGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 10796 - protein, 774 aa, Shigella dysenteriae 1012
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYNDNNKGIYAGQPRTLYMQGSLKF

SEQ ID NO: 10797 - protein, 294 aa, Shigella dysenteriae 1012
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLNFGPFKEWYFANNYIYDMGRNKNGRQSTWYMGLGTDIDTGLPMSLSMNVYAKYQWQNYGAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 10798 - protein, 660 aa, Shigella dysenteriae 1012
MIYWLYLAVFFLLSALDAKEIAMQRFDKQNHKIFEILADKVSAKDNVITASGNAILLNYDVYILADKVRYDTKTKEALLEGNIKVYRGEGLLVKTDYVKLSLNEKYEIIFPFYVQDSVSGIWVSADIASGKDQKYKVKNMSTSGCSIDNPIWHVNATSGSFNMQKSHLSMWNPKIYVGDIPVLYLPYIFMSTSNKRTTGFLYPEFGTSNLDGFIYLQPFYLAPKNSWDMTFTPQIRYKRGFGLNFEARYINSKNDRFLFNARYFRNYTQYVKRYDLRNQNIYGFEFLSSSRDTLQKYFHLKSNIDNGHYIDFLYMNDLDYVRFEKVNKRITDATHMSRANYYLQTENNYYGLNIKYFLNLNKINNNRTFQSVPNLQYHKYLNSLYFRNLLYSVDYQFRNTAREIGYGYVQNALNVPVGLQFSLFKKYLSLGLWNDLQLSNVALMQSKNSFVPTIPNESREFGNFVSSNFSMYVNTDLAREYNKLFHTIQLEAIFNIPYYTFKNGLFSQNMYALSAQALNSYTSPLLRDYDYQGRLYDSVWNPSSILPSNASNKTVDLTLTQYLYGLGGQELLYFKISQLINLDDKVSPFRMPLESKIGFSPLTGLNIFGNVFYSFYQNRLEEISVNANYQRKFLSFNLSYFLKNNFSSGINSIVENLRII

SEQ ID NO: 10799 - protein, 351 aa, Shigella dysenteriae 1012
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 10800 - protein, 186 aa, Shigella dysenteriae 1012
MNVSKYVAIFSFVFIQLISVGKVFANADEWMTTFRENIAPTWQQPEHYDLYIPAITWHARFAYDKEKTDRYNERPWGVGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 10801 - protein, 446 aa, Shigella dysenteriae 1012
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPARQTPQGQALAATANGIDSNTKIAHLNGNQWGFGWNAGILYELDKNNRYALTYRSEVKIDFKGNYSSDLNPAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 10802 - protein, 1029 aa, Shigella dysenteriae 1012
MLENIRRNKKYSILISSKFNIMRKILFLILMLSSVSIQAQNLIVKGVVSDESDVLPGVSIFVEGTSKGTISDINGKYSIEVKKGSKLVFSYVGYRTEELVANTSVLNVKMKTDAIQLEEAIVVGYAKQKKATLTGAVSSVSSETITKRSVASLSTALQGAMPGVTIQQTSGEPGGDGGSIRIRGIGSINSNTDPLVLVDGIEMSIDQVDANTVESISVLKDAASASIYGSRASNGVILITTKRGQKGKITTTYSGYLTIQRPTNMPEPVAAWEYLQAELNAWDNAEITVSDAQRAQQLQQIEEQKTLRPDNWNRYDTNWKDETMKSHSIMHNHNVTISGGSDKLTFFGSGTYLYQDGLIPNDNYSRTNLRLNADAQILPWAKFSIETALRQGKKVNPGLSTPKQIINQSLYMLPTLSAARELDGNWGYGKNGMNPTAQAYDSGEKISKGTDAVVNGTLTLTPIKGLELVGQYSRRQSTSRERALITPYTTSLKGQIMGSYPTDDSLTESWSETVRNYYRAQASYENKFFDHYGKILVGFQAEDNLNTSFSGGKRGFDLGRYYLGNGDSATATSSGGANSWAMMSWYARLNYNYKQRYLLEVNGRYDGSSRFTRDNRWGFFPSVSAGWVISEENFMKPTRKVLDFLKVRASYGLLGNQNIGNYPYAATIATGYGYYLGGDEADKELVSGVAQTTLANSNISWEKSKQINFGIDFSLWNGLLSVTADYYIKNIYDMLMKFPLPYYVGMSPAYTNAGDMSNKGWEVSVSHKNKLNDFTYGVTFTLSDNRNKITNLNGLNSQDKTMVEGYPNKGIWGYVTDGYYKDWDDVNNSPKLGDARPGFVKYVKVYQGEDSDPMTIDTRDMVYLGDPFPHFEYGVTLNAGWKNFDFTAFFQGVGQRVNYMSGVGLKPFANGSNLFRHQMDSWTPDNQDAAYPILVPEANAGPNYQKSDKWVRDASYCRLKNVVLGYTLPNSWTKKLNIGSLRVYASGQNLFTISNFYKGYDPEVAYSGSVGGEFYPIMQTFTFGIDLKF

SEQ ID NO: 10803 - protein, 309 aa, Shigella dysenteriae 1012
MGADAAAFNAQNHARTDVNFDGSALVRFDPDPGSRYELGFAHRARSPNLYERYAWSTNVMAMQMIGWFGDGNGYVGDINLKPEEANTVSLTATWRDPDKAAWELRATPYYSYVANYIDADRCALAGCLANLATNLTTTDNFVYLQFANHNAWLYGVNLDGKLNLWDTPEFGQGRVRANFNYVRGQRTDGIDLYHIMPVNVTLALDQAYGGWTSSIEVQIVGSKTLVSQVRNELETSNYALLNLRLGYQWDAVKVDFGIENVLNANYFLPLGGANLVNYQTTSMMGTATAWGFPVAGLGRSFNGRISVRF

SEQ ID NO: 10804 - protein, 1234 aa, Shigella dysenteriae 1012
MIASLFPANGVAAAIDLCQGYNIKASCHASRQSLSGITQVWSIADGQWLVFSDMTNNASGGAVFLQQGAEFTLSPENETGMTLFANNIVSGEYNNGGAIFAKENSTLNLTDVIFSGNVAGGYGGAIYSSGTNDTGAIDLRVTNAVFRNNIANDGKGGAIYTINNDIYLSDDVFNNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFAHSLTGFQNGTLNIDAGGNVTVNQGSFAGTIEGAGQLTIAQNGSYVLAGAQSMALTGDIVVDAGAVLSLEGDAADLAALQDDPQSIVLNGGMLDLSDFSTWQSGTSYKDGLEVSGSSGTVIGSQDVVDLAGGNDMHIGGDGKDGVYVVIDAGDGQVSLANDNQYLGTTQIASGTLMVSDNSQLGYTHYNRQVIFTDKPQESVMEITANVDTRSTTTEHGRDIEMRADGEVAVDAGVDTQWGALMADSSGQHQDEGSTLTKTGAGTLELTASGTTQSAVRVEEGTLQGDVADIFPYASSLWVGDGATFVTGADQDIQSIDATSSGTIDISDGTVLRLTGQDTSVALNASLFNCDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTQDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDASTISDDAVKQRGEIKVGVTGNISQRVSLRGSVAWQKGSDDFAQTAGFLSMTVKW

SEQ ID NO: 10805 - protein, 729 aa, Shigella dysenteriae 1012
MARSKTAQPKHSLRKIAVVVATAVSGMSVYAQAAVEPKEDTITVTAAPAPQESAWGPAATIAAKHSATATKTDTPIEKTPQSISVVTNEEMQMHQFQSVKEALGYTPGVTVSSRGAFNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIAGDGHTLNRGTVVDNERLQNFSVDTQLESKFATGDVEHTLLTGVDFMRMRNDINASFGSAPSIDLYNKYHPEYFAFGSAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRISYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 10806 - protein, 729 aa, Shigella dysenteriae 1012
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 10807 - protein, 352 aa, Shigella dysenteriae 1012
MKRKVLAMLVPALLVAGAANAAEIYNKNGNKVELYGKMVGERILTDRESGEKGDNSQDTSYARVGVKGETQINPELTGYGQFELDLEASNRHNPDQTRLAYAGLSYKDFGSFDYGRNVGVAYDAEAFTDMFVEWGGDSWAGTDLFMTNRTNGVATYRNTDFFGMVEGLNFALQYQGKNEGTGNYKANGDGHGLSATYTIDGFSFAGAYANSDRTDWQSGDGKGERAEVWALSTKYDANNVYAAVMYGESHNMNSDDGDVVNKTQNFEAVLQYQFDFGLRPSIGYSYSKALDVAGYKDSDRLNYIEIGTWYYFNKNMNVYTAYQINLLDKSDYVLAHGLNTDDQLAVGIVYQF

SEQ ID NO: 10808 - protein, 199 aa, Shigella dysenteriae 1012
MRKVCAAILSAAICLAVSGAPAWASEHQSTLSAGYLHASTNVPGSDDLNGINVKYRYEFTDTLGLVTSFSYAGDRNRQLTRYSDTRWHEDSVRNRWFSLMAGPSVRVNEWFSAYAMAGVAYSRVSTFSGDYLSVTDNKGKTHDVLTGSDDGRHSNTSLAWGAGVQFNPTESVAIDIAYEGSGSGDWRTDGFIVGVGYKF

SEQ ID NO: 10809 - protein, 955 aa, Shigella dysenteriae 1012
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKIKTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSSSDATINFSGTAAQRNSIFSGGSYGASAQTATAVINMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFTTLNVENLSGNSTFIMRADVVGEGNGVNNRGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIDSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMAMKASNGLNIHLNHYESLLGRASMILGYDITAGNSQLNVYVKTGAIREFSGDTEYLLNDSREKYSFKGNGWNNGVGVSAQYNKQHTFYLEADYTQGNLFDQKQVNGGYRFSF

SEQ ID NO: 10810 - protein, 326 aa, Shigella dysenteriae 1012
MDISTKKVEFSMKLKFLVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQIWTDQSWHPNTHLRDANEFELNLKGWLLNNLDYRLGLIAGYQESRYSFNAMGGSYIYSENGGNRNKKGAHPSGERTIGYKQLFKIPYIGLTANYRHENFEFGAELKYSGWVRSSDTDKHYQTETIFKDEIKNQNYRSVAANIGYYVTPSAKFYIEGSRNYISNKKGDTSLYEQSTNISGTIKNSASIEYIGFLTSAGIKYIF

SEQ ID NO: 10811 - protein, 1099 aa, Escherichia coli 101-1
MNKNIRFPQKEKQPKKLIRAMKFFLLFALLTTGSCFASETYSQEASFSMNYENKTIKEIINEIENNSEFIFFYLDKSIDLNRKVSINVKEQKIETILDQLFSNTENNYSISDRQIIISKKETPVNTKTNQKDTRTISGIVRDNMGPVTGANIVIKGTTNGTISDLDGKFTLENVPANAILQISYIGYLPQEITVNNQSSYNIMLKEDNQSLDEVVVVGYGTVRKADLAGSVAVLDNKAFKDQPITQISDALQGRVSGVQVQSSGVPGGTVKIRVRGSGSINRSNDPLYVIDGIVRESGLTGLNPEDIQSMQILKDASSTAIYGSRGANGVVLITTKTGKANVRQIMFDAQIGVGTVAKRYETLNPYEFATLYNTYRKETFSPEQLSAFQNGTAGTDWLDEIFQNGITQDYKLTLSGGSDKIQYIISGNYVGQEGVVKENTNKRYQARANITSQLTDWLHLTADVNASHNVKRSADFSAAKGNIVNIAMNYAPVLGIMNEDGTYTRDPYSAITQLNPVGLLNEQIGESMRDIVNAHIDLKFNILPGLTFTTSNGIDYNDVKNYSFATTKVSSSSSMSNNDAYRMTLQTTNNLTYNGKWGDHALTATAVYEATQSEYRYMNISGNNLMTESVGWWNVEMAGTRNAKNDYSKWALMSGVGRVMYNYKDRYMLTGTIRADGSSKFFNNKWGWFPSIAAAWSMGNENFMQHQNFIQDLKIRASYGLIGSQAIDPYETLGLMTQAMYAFGGNAYYTGYWIGQTVATPDLSWETTHQFDVGLDFSILNSRLNISFDYFDKRTKDGLLKRTIPNYDGGGSYWVNAAEISNRGIDFSINANIFESSDFSWNTNFNGTYLKNEVKDLAGLDFIQGANIASGMFSTDGVTRIAVGQPIGAFYGYEWTGLDAAGNDSFVDRNKDGIIDSKDRTFIGKATPDFTLGWNNSLHWKNWDLNIFFTGSFGAERFNMVRYTGTSMTGDFAFITLKEYLNDNFDTKGQSARYPSVNVKGNNYQAAATSTKYLESANYFRLDNISLSYNLPKAVSKFADLRFTFSCQNLFTITNYKGMDPAGISFVDTGTGSVDVNDGIDLGAYPLTRSYTFGVRMNF

SEQ ID NO: 10812 - protein, 836 aa, Escherichia coli 101-1
MDTSERRWGTGRLWGVPASCARTGRPTRIIPLAALLMASTAVLPLLANSPALSQVATSTTFNIPAGDLGSVLAQIGRAASQPISFPADLTRGRSAGPIVGRMSVQEALARALAGSGLVAVQGAGGALTIRGGATVPAAGSTVLGDIAAIDVTDTAAGSRDVGFTAVDTQSSARIDIPLKEDPRSVVGVTEAVIRTQAQTSALDVARNVSNVRTSAGSEELGAPRYLIRGFPQDSFLLNGLPSGSTRIPITDIERIDVIKGPTTEFGGPSFRGGAINAITKAPTATPIQRAEVFYGSRFFRTLAFDFGGPVQDLEGVTYRLNVSGNTANYALGGTRSPHEALISPVVAWQGVDTRLAAGVRYIDTLSGIPRYAPTSPDNFRPFRIQRDVPFGNLDNLVAFRSFNPYLEADHHLGRIDSDTVGSFDFKIRNRTSYFLTDMFGQNLIPYNFTRLLAGRPMFQPQGYVFGETANRLVTQSDLLIQHNTEFVRQTMRIGIDYLDTSVNTKSNIQAISGDFALSNPPQNLPYPRYSTRSPRGFSQFSGASVYQDNVGIAFQDKIDILDRLHILGSVRHDWFNSRSNTLTPGGLSTSTLTESALTYTAGAVYDVLPWASVYGSVGTGFVPQRGLVNRTQPAPPARSNNSEFGLKLSLLDNNMTVTMARYHLENTNNLIQDNARMLNLLGPGYRAEGYEIDFQGQVTENISIIGGYGYNDFKSAPDPQALLGTVTPVLPGQPQHQANLFVVYTFTDGPLKGLSIGGGGRGQTFSYMGLLPKVESPVLPGFITYDATIGYTIENFRIDVSVRNILDRYYYDVTETVFAAPVADGRVFMIRAGLDF

SEQ ID NO: 10813 - protein, 1234 aa, Escherichia coli 101-1
MIASLFSANGVAAAIDLCQGYDIKASCHASRQSLSGITQVWSIADGQWLVFSDMTNNASGGAVFLQQGAEFTLSPENETGMTLFANNTVSGEYNNGGAIFAKENSTLNLTDVIFSGNVAGGYGGAIYSSGTNDTGAIDLRVTNAVFRNNIANDGKGGAIYTINNDIYLSDDVFNNNQAYTSTSYSDGDGGAIDVTDNNSDSKHPSGYTIINNTAFTNNTAEGYGGAIYTNSATAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFAHSLTGFQNGTLNIDAGGNVTVNQGSFAGTIEGAGQLTIAQNGSYVLAGAQSMALTGDIVVDAGAVLSLEGDAADLAALQDDPQSIVLNGGMLDLSDFSTWQSGTSYKDGLEVSGSSGTVIGSQDVVDLAGGNDMHIGGDGKDGVYVVIDAGDGQVSLANDNQYLGTTQIASGTLMVSDNSQLGYTHYNRQVIFTDKPQESVMEITANVDTRSTTTEHGRDIEMRADGEVAVDAGVDTQWGALMADSSGQHQDEGSTLTKTGAGTLELTASGTTQSAVRVEEGTLQGDVADIFPYASSLWVGDGATFVTGADQDIQSIDATSSGTIDISDGTVLRLTGQDTSVALNASLFNCDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTQDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDASTISDDAVKQRGEIKVGVTGNISQRVSLRGSVAWQKGSDDFAQTAGFLSMTVKW

SEQ ID NO: 10814 - protein, 441 aa, Escherichia coli 101-1
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 10815 - protein, 790 aa, Escherichia coli 101-1
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHISQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 10816 - protein, 700 aa, Escherichia coli 101-1
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYITPSNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPAPGRNYGVGVNIAWRFE

SEQ ID NO: 10817 - protein, 405 aa, Escherichia coli 101-1
MGIKGVLRLLLFVFLLSATSGWAADIHGKSSTQLLWFNDFYNGRQIELGEYLQFSVTKLDKDGKFNIYGYGRGTQDLTNGEGLNGRLYYLYGDYRDLFDKLDVKLGRQFVNLSAGTTIIDGGQADLKNIGPVAFTVLGGRDVVFGIDGELSRDGNYALGMAAYLTGFRKTDLDVSWFRKWDEGDVSRDIVGGSFKQYLLDSVKLYSNARYDLTSEVFNEVLAGIKYFPTANLVLTGEWFQSYPTFDTTSIYSVFAVNRYQEGVVRADYTINENIAVNAGYSRQDYGEDGTADVYEAGCTLRPINTLTIGLAYDRHEGYGGHLDGGTFDVTWDATKELMLAGGLTVDAYNRDFFPTVSGDEIAQKYWLGAKYRMGRNMAASLRIEDDVNVTYNSNVQGRFVFDYSF

SEQ ID NO: 10818 - protein, 199 aa, Escherichia coli 101-1
MRKLCAVILSAVVWLVAAGTPAIAAEHQSTLSAGYLQTHTDMPGSDDLKGINVKYRYEFTDTLGLITSFSYANAEDEQKTHYSDTRWHEDSVRNRWFSVMAGPSVRVNEWFSAYAMAGMAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 10819 - protein, 746 aa, Escherichia coli 101-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 10820 - protein, 365 aa, Escherichia coli 101-1
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 10821 - protein, 715 aa, Escherichia coli 101-1
MTPLRPRLPLGLLSLGLALHSGQGLSADSVTLAPVRVSEVYGNEGYQAREAQVGGLHSAPLLDTPAAVSVFNRQLLDDRQVRKLSEVLQSDASVGESYAPVGYYENFNVRGFELNAASSYRINGQTIAGEQNVALENKQQVELLKGLSGLQSGMSEPGGLVNYVTKRPEDVRSVSVSSNEQGERYLATDLGGWFGAERQFGLRANLAHEDIRSYVDHADGKRDFASLAFDWQINPDAVLELDAEYQHREQYSVPGYQLLGGTQLPHGVDPKDHLAWQSWAKPVQNDSLNLGGRFKYRFNDTWNGTLSASRSKVVIDDYSAFAWGSNGGWASHFSPNGDYDIYDFRSPDDTRRIDEAQAMLDGRFDALGVGHELTVGTSAQRRTLDQRPTFNELLDADHPGNIYTGAPALAPSDKPLGHSERRLDSRQYGLFLSDRITFNENWQAVLGAREVRLDEKTWDQTGAVTRHTQQYQLLPNAALIYKPQPDTTLYASYSKGLSAGGTAPWFASNKFEILAPTLSRQLEVGIKRDWQGMSFSAALFQIRQAYQYSRLEENADPTFVQQGQQKNTGLELGASGQVTSNLQIQASAAAIRARVQNSGTDAYEGHQAINVPRLRAAVHADYALPVPGLALLGGARYSASKYASQAGNVEVGGYTVFDIGSRYRTRIGGYDTVLRLTVDNVFDKRYWRDVGDYLGDNYLFQGAPRTARLSASVSF

SEQ ID NO: 10822 - protein, 230 aa, Escherichia coli 101-1
MKNINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFTPWFNLTVRNRFNHNNYSSTDLNGDLDNNDSYEIGNYWNFIITDKFSYTFEPHYFYNINDFNSGNGTKHHWEITNTFRYRINEHWLPYIELRWLDRNVEPYHREQNQIRIGTKYFF

SEQ ID NO: 10823 - protein, 760 aa, Escherichia coli 101-1
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPSGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10824 - protein, 968 aa, Escherichia coli 101-1
MHSWKKKLVVSQLALACTLAITSQANAANYDTWTYIDNPVTALDWDHMDKAGTVDGNYVNYSGFVYYNNTNGDFDQSFNGDTVNGTISTYYLNHDYADSTANQLDISNSVIHGSITSMLPGGYYDRFDADGNNLGGYDFYTDAVVDTHWRDGDVFTLNIANTTIDDDYEALYFTDSYKDGDVTKHTNETFDTSEGVAVNLDVESNINISNNSRVAGIALSQGNTYNETYTTESHTWDNNISVKDSTVTSGSNYILDSNTYGKTGHFGNSDEPSDYAGPGDVAMSFTASGSDYAMKNNVFLSNSTLMGDVAFTSTWNSNFDPNGHDSNGDGVKDTNGGWTDDSLNVDELNLTLDNGSKWVGQAIYNVAETSAMYDVATNSLTPDATYENNDWKRVVDDKVFQSGVFNVALNNGSEWDTTGRSIVDTLTVNNGSQVNVSESKLTSDTIDLTNGSSLNIGEDGYVDTDHLTINSYSTVALTESTGWGADYNLYANTITVTNGGVLDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAGAIADYKDKEIIYVNDVNSNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 10825 - protein, 199 aa, Escherichia coli O111:H-
MRKVCAAILSAAICLSVSGAPAWASEYQSTLSAGYLHARTNAPGSDNLNGINVKYRYEFTDALGLITSFSYANAEDEQKTHYSDTRWHEDSVRNRWFSVMAGPSVRVNEWFSAYVMAGMAYSRVSTFSGDYLRVTDNKGKTHDVLTGSDDGRHSNTSLAWGAGVQFNPTESVAIDIAYEGSGSGDWRTNSFIVGVGYKF

SEQ ID NO: 10826 - protein, 782 aa, Escherichia coli O111:H-
MRHLTQQSIQHVCRRILGLLVTLTVIAYMGGILLKSPALAEENPADTNASDPPSSFSEEPSELSLFEDIPMVVTVSKKPERVTEAPSIVSIITAEDIERMGARTIMDVLRTIPGFEIHTDAWNVSQITVRGLRSETSSGVKILIDGHALNDPFTGGATEFYEDLPLSNVQRIEVIRGPASSLYGANAFVSVINILTKDALDINGINVSVRADTFHTVNPSFQWGKIINNLEMTLFVDYLTTQGGKLSVSADSMSVYDQSVAGIYPPVSLAPGDFREEQERIDVAYKLAYHGFTLYGRFLRKEWGPFLTDYFILNDDSAETVTHFYTALDFQRFLTERLEIQGKAYVDYFFLEEREHLATGLSLPSPLRENETYTYPNGIMVEAFDKSWRVGGEQLLNYRLFARNDLTLGIAYEYLVVADFDVRTNAQNIERDLPPDELYNLDVLLPDVQTSLSRSVFSLFAQDTWSVRQNIDLTLGLRGDFFSDFGGVLTPKVGITYRPDPRVNVKAMFGNAFRVPAFYETFIERPSQGSAARDDLVVENLGMLEIGVGYKPFEWLLGEMNVFSTAIRRLAKTTDPGNALESDDNITVSTADGELVYESIGGIDVQGVELELRGEREQDIEFGIIPRVINSSFRINYSYQEGRDAETQEILPSIARHKGNIDLGLRFSSISAKTGKSNLLGLFRSLSDEFSLHTHIFLSGKRERSAQDVRDDLPPYALMDLTFMAHDVFRKGLDVSLSVKNLLDTDYRDPSPEFIPEEPLLTIPDDYPNPGRSIFVEFRYAF

SEQ ID NO: 10827 - protein, 199 aa, Escherichia coli O111:H-
MRKVCAAILSAAICLSVSGAPAWASEHQSTLSAGYLHARTNAPGSDNLNGINVKYRYEFTDALGLITSFSYANAEDEQKTHYSDTRWHEDSVRNRWFSVMAGPSVRVNEWFSAYAMVGVAYSRVSTFSGDYLRVTDNKGKTHDVLTGSDDGRHSNTSLAWGAGVQFNPTESVTIDLAYEGSGSGDWRTDAFIVGIGYRF

SEQ ID NO: 10828 - protein, 948 aa, Escherichia coli O111:H-
MKRHLNTSYRLVWNHITGTLVVASELARSRGKRTGVAVALSLAAVTSVPVLAADTVVQAGETVSGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATDVTMTSGSALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTQDAVLSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESNGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLAFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 10829 - protein, 682 aa, Escherichia coli O111:H-
MILSSFKGSPILSFTFASICSSILFADETLSSTKLSPLISAAHPISNANISVIDDTFLTHTQANNLRDIFAKDAEIQVGGGAQIAQKLYVRGFEDRMFRVRLDGITQGGNLFHHQGNLLIDPFLIKSIEIEKGLAKPEDGAGALAGGINIITKNAFDMLLPNRSYGAHFVLGGQSNKGIDTALATYGKITENIGLLASYSFDDVPYYRAGNGDKVSSSKTRSHNALFKLSFLPNANHSLNLNYHFNNVNAIAPYGANVLLSQDPKLYDNTLFSHAISTQYAYVPTDNFTLLWNTFYSYKNLTLSPIGAVSSTDHEKAHDLSLHHLGSDIMLKHYFSPVRHYIKYGLNYQLITTKEHNLDGHDRDDNNQGHELGAIYGGFIGANFNFLESLSLDVGSRYDVFTYRDKVNTRHNTQGFSPYISLLYAPTNELSFKITQNYNTRGAMPLDASLLSNPHVKITPLKAEGMYNTELNMDYDNSLFSVHISLYHQYLKNFINSYVNSGSHTNGATHAHGDSFRENMASAIRIIGYEASMGLDFSFIDVHMGIAQSFPTYRQKLITDTFELAAVSGRSYFLSAGIRPFDFLPQFRILWLSRFVEGINYQGYNMYYNDTESVTKKGYNTHNLYLTYDVKSYLSVRLAFLNLTNQTYINPMSPLKELFSKGEGTPLYEPGFSTKAQIALSF

SEQ ID NO: 10830 - protein, 146 aa, Escherichia coli
GITSAEDKEYGVLNNSKYIPTNGNTVGYTFEGIDGLVLGANYLLAQQRNAHGSTAGEVVAQVISNGVQVGAKYDANNIIAGIAYGRTNYREDLAKPEDKSGKKQQVNGALSTLGYRFSDLGLLVSLDSGYAKTKNYKDKHEKRYFV

SEQ ID NO: 10831 - protein, 751 aa, Salmonella enterica
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 10832 - protein, 656 aa, Salmonella enterica
MTQKRTLLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIARPAMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQATVFSHLRAGQAWLDSDLHYLSAKFSNIQRSITLGALRRVEEGETNGQLWGARLTSGYDFVMMPWLTTGPMLQYAWDYSHVNGYSEKLNTSTSMRFGDQNAHSQVGGAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 10833 - protein, 239 aa, Salmonella enterica
MKNFFAVCIIPLVVAWSATASAKEGIYITGKAGTSVVNVYGINSTFSQDEIVNGHATLPDRTKGVFGGGVAIGYDFYDPFQLPVRLELDTTFRGETDAKSGQDIIAFGDPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 10834 - protein, 350 aa, Salmonella enterica
MNKSTLAIVVSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFGIVDGLDLTLQYQGKNEDRDVKKQNGDGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGAIYYFNKNMSAFVDYKINQLDSDNTLGINDDDIVAIGLTYQF

SEQ ID NO: 10835 - protein, 377 aa, Salmonella enterica
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNFMTGRANGVATYRNTDFFGLVDGLNFALQYQGANENQVSHEQEGTNNGGDRNVKNANGDGFGISSTYDLGMGVSFGAAYTTSDRTNGQVNYSTAGGDKADAWTVGAKYDANNIYLATMYSETRNMTPYGNDDCRSCVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 10836 - protein, 650 aa, Salmonella enterica
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYNGRKRADSATAKTPGGYVVWDTGAAWQATKNVKLRAGVLNVGDKDLKRDDYGYTEDGRRYFMAVDYRF

SEQ ID NO: 10837 - protein, 696 aa, Salmonella enterica
MFATTRMALLIGGAIGGATFPLSAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDTWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGRKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 10838 - protein, 973 aa, Salmonella enterica
MHSWKKKLVVSQLALACTLAITSQANASTDISGTTYTTFNHYNDATYADGVYYDGYVGWNNYATDSVYNGDIYPVINNATVNGVISTYYLDDGLSTNTNSNSLTIKNSTIHGMITSECMTTDCVGRDATGYVYDRLALTVDNSTIDDNYEHYTYNGTYTDGTADTHVVDVYNLGTAITLDQEVDLVIKNNSHVAGITLTQGYEWEDIDDNTVSTGVNSAEVFNNTVTVTDSTVTSGSWSDEGTSGWFGNTNNASDYSDSYTADDVAIAAIAHPNADNAMQTTVNLSNSTLMGDVVFSSNFDENFFPNGADTYRDTDADLDTNGWDGTDRMDVTLNNGSKWVGAAMSVHQVDSDGDGVYDSFAAGTDATATLIDIAANSLWPSSTYGIDNNDTAYGEDGHVVGNEVYQSGLFNVTLNGGSQWDTTKTSLIDTLSINSGSVVNVADSDLVSDSISLTGGAALNINEDGHVATDELTINNSTVTIADDVSAGWGVYDAALYANTINVTNNGVLDVGNSTAYALQADTLNLTSYTDANGNVNAGVFNVHSNSFVLDADLTNDRTNDITKSNYGYGVIAMNSDGHLTINGNGDAWTGDQSEVDNAGDNVAAATGNYKVRIDNATGEGSVADYKGKELIYVNDKNSKATFSAANKADLGAYTYQAQQEGNTVVMQQMELTDYANMALSIPSANTNIWNLEQDTVGTRLTNSRHGLADNGGAWVSYFGGSFDGDNGTINYDQDVNGIMVGVDTKIDGNNAKWIVGAAAGFAKGDMSDRTGQVDQDSQSAYIYSSARFANNVFVDGSLSYSHFNNDLSANMSNGQYVDGNTSADAWGFGLKLGYDWKLGDAGYVTPYGSVSGLFQSGDDYQLSNDMKVDGQSYDSMRYELGVDAGYTFTYSEDQALTPYFKLAYVYDDANNDADVNGDSIDNGVEGSAVRVGLGTQFSFTKNFSAYTDANYLGGGDVDQDWSANVGVKYTW

SEQ ID NO: 10839 - protein, 922 aa, Salmonella enterica
MKKVVRAVSLMLLMAGVCGNAFAEENENIVRQGAIRGRVIDNGKQILPGASIFVENLKTGVISDVNGFYTLPNLKPGTYTVKVTYVGYSPIEMKVTVPEGKTLEKDIVMNEGVELQEVQVKGAFQGQKKAINTQKNNLGITNVVSADQVGKFPDSNIGDALKRISGINVQYDQGEARFGQVRGTSADLSSVTINGNRVPSAEGDTRNVQLDLIPADMIQTIEVSKVVTPDMDGDAIGGSINLVTKNSPYKRTINATAGSGYNWISEKAQLNLGFTYGDRFFNDRLGMLLSASYQNAPSGSYDTEFMWEQNEDGKVYVSDYQMRQYFVTRERQSYSAAFDFDINENHKLTFKGIFNNRNDWENRYRTNIKDLDENGKGTVRIQTKAGTPDNRNARLERQRTMDFALGGEHLWGAIGMDWNASYAKATEERPNERYLDFQLKKQEFDMDLSDERQPLATPGTGATLTLSDKFSLKELTEQQEDIKEEDMKFSANFKASLNNGAKLKFGAKVVRKTKEKEIDFYEYTPKDEDAFMTNSLKNTVDQSTDKFMPSDKYQVGTFASKEYVGGLNLNDASQFDKEQVQAELAENFEARETVSSGYVRFDHKFASDINLMAGLRMEHTSLRYTGRNYDDETDKTTKTGRMTNSYVNFLPSILVKWDVNDDFKIRGSYTQTLSRPKYSALVPSVNINRGDNEIKIGNSDLKPTISYNFDLSADYYFKSVGLVSAGFFYKKIDDFIVDQVLTNYEYQGTEYTRFTQPKNAGNANLWGLEFSYQRDFGFIAPALKYVGFYGTYTYTHSRVEDFNFEGRENESGLSLPGSPEHTANASLYFEKGGLNVRLSYNFASDFIDEMGPSTFYDRYYDAVNYMDVNASYTFGKKVKMTFYAEANNLLNQPLRYYQGTKDRTMQAEYYGVRMNAGLKISF

SEQ ID NO: 10840 - protein, 378 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNVYLAAQYSQTYNATRFGTSNGNNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 10841 - protein, 1943 aa, Salmonella enterica
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVTTFSNGVTIDKGKDTLAFDSFKLDSGSVLEGAVWNYSEPDNQWQLTTADGKTLNVTGWDVTDANAAVIEGTQENGLYWKYDSRGYLIIADDKTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSNISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSVSGDSNAVDITGNVNISADYGQDDLAAGAPPLTGVVVGGNGNTVTLNGALNIDDNDLSATGGQYLDVVGLSVTGDDNDVEIDGGINITHSEDPLDGTSADITGISVSGNSTVTLNGHSTIDTNTVVGGHVVLARVNNGGSLILDDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGNIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGTTKAIINNGEINLLCDSGCDIYAPGTTGTQNDHNGTADIAIPDATTAPTEGSIPTPPEDPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEGGYKERSAGDFNLSMNSGNETAVDSIVGLKLDYAGKDGWSATATLEGGPNLSYSKSQRTASLQGAAGQSFGVDDGQKGGGINGLATIGVKYSSNDTALHLDAYQWKEDSISDKGFMLNVKKTFR

SEQ ID NO: 10842 - protein, 705 aa, Salmonella enterica
MNKTVLAVAVSALCGNVHAADMSSTQSQNTSVSQTNVVMVTAQKIEKEPYEVNGSVTVITSDELEREGATELYDSLKNIPGVSVSGGAGRPQNITIRGMRGNRIKIIEDGVETGDGYGADDLSDKVGRNSFDLSAAKQLEVVKGAGSSLYGSGALGGLIVITTKDASDYLTPSKNTAVEVSTNYVGESDKIKGTVNFAQRIGSSEHLIRYSQWMGGESENYTGEVYDRDVDGFDLSLTSNFYIGEHQEIKTKVSYYEDTMDRNDHDNYKSGDFNENTVTSSNKYQATYLYNDADFVLFDDAKVLGYYQSTKSNNNKTRYKTKLVQNINYKFLLLENGQFDEEKVGLKTEFQRHLDNQNIVWGVDTVFKEHSRTLGKAIISDGSTSTSQTNPFADANTFNIGLYAHDDIMWDAWDIGFGVRYDFHQLTPKDKNQLASNGYNFALSDTTSSEISPSFSIGYNFTDELKTYFSYNHGFNSPNYAKVYGYVPHDGVPPFEIVPNYNLKAETSDNFEIGVKSRMGIYSVNAAVFYSDFENFIRTKQTGMNSDNGRLTIQYVNLDKVKSYGFEMGASADISETVTASGSVGVVTAEEENGAYVETSTPWEGNLALHYSQDFDAFVRWSFAAAMNKVPTCSDGECVTTAGWGTVDLGLSYEPITDLFISGNLNNLFDREYVRYQDVGGMSDAQSKYNAEAGRNFNVFVKYNF

SEQ ID NO: 10843 - protein, 706 aa, Salmonella enterica
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLTWRFE

SEQ ID NO: 10844 - protein, 234 aa, Salmonella enterica
MIVRKRRGRRTLRCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLALTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 10845 - protein, 312 aa, Salmonella enterica
MKKHAIAVMMIAVFSESVYAESTLFIPDVSPDSVTTSLSVGVLNGKSRELVYDTDTGRKLSQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 10846 - protein, 253 aa, Salmonella enterica
MKKILTLTLSSLLIIPALTHAEFKGGFADIGLHYLDWTSDTTEKTSKKSHKDDFGYLELEGGANFSWGEMYGFFDWENFYNGRHAKPGSEQRYTFKNTNRIYLGDTGLNLYLHAYGTYGSPHRANFHDDMFLYGLGYNFTGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 10847 - protein, 670 aa, Salmonella enterica
MTVTGAPAYPESSGYTTNRANSLTRTDLPLSDIPASIQVVPHEVLRDRAVTQPGQLLENVSGVQTEASYGGNHGMFFNIRGFTTHSSSRDGFQYNGNLVTRDVQNIERIEVMKGPSGTLYGGVGSLGGQVNTVSKRPLYYNYGAINLLWGNYQQWRPTFDINRVLGKGFSVRLNGAYENNGTFRDGGGFESYSLAPAISWQGEKTSVTLLAEYNRFDQDLFDFGLPNLPNFRHLSRTRYFGLRKGDYPDLPGDSGLNETYVGTAILHHQLSQTWGLRIATQYHRATQDSTQSFPDNYLYTGDNKLHFTHYMNGHEWSRGHAVQAELRGQVYTWNFEHNLLFGTEYRKIVNGFNNTDQTSFVLDLFDPGMRSAHHEPIIPGEGYNEGRGDDIGIYAQDLLTLTSAVKLLAGLRLDRFHNEAKSSDYTNSANQMALSWQVGAVWELNPTAALFTRVGRSHSPNITRSIDASVFNAEVGTQKEIGAKFNFFDRRLNATLAAYKLTRRHILTSDPNDPLRNILAGRQSSHGFELDVSGELTRRWKVIASYAYTHAEVKADGFFPVGDKLPDVPRHSGNLWTTYEPGGVLQGLGVGGGIYAASSRQATLPNSHKLGAYVRMDTTAYYDTGNWHAQFNVNNLFDTKYYYGGASGVYNYTLIPNPPRTFLLTLSYRL

SEQ ID NO: 10848 - protein, 212 aa, Salmonella enterica
MKKFTVAALALTTLLSGSAFAHEAGEFFMRAGPATVRPTEGAGGTLGHLNGFDVSNNTQLGLTFTYMATDNIGVELLAATPFRHKVGTGATGDIATVHLLPPTLMAQWYFGDSSSKVRPYVGVGVNYTTFFDNDFNDNGKNAGLSDLSFKDSWGAAGQVGVDYLINRDWLIGASVWYMDIDTTANYKMGGVQHHDSVRLDPWVFMFSAGYRF

SEQ ID NO: 10849 - protein, 230 aa, Salmonella enterica
MKSLNTLVILTSVISTSVFAGAYVENREAYNLASDQMEFMLRVGYNSDMGAGIMLTNTYTLQRDDELKHGYNEIEGWYPLFKPTDKLTIQPGGLINDKSIGSGGAVYLDVNYKFTPWFNLTVRNRYNHNNYSSTDLNGELDNNDSYEIGNYWNFIITDKFSYTFEPHYFYNINDFNSSNGTKHHWEITNTFRYRINEHWLPYFELRWLDRNVGPYHREQNQIRIGAKYFF

SEQ ID NO: 10850 - protein, 223 aa, Salmonella enterica
MRKSLFLLLPLVVTNAHAVYVDVRHEYLDDSKANYDRAYISHRFANGVGFAIEAISKSGGDDTNKAFNDLETQGNEYTISYQFKTGDVAWQPGFVLETGNGYSTYKPYFRATWTLNESWWVGARYRFEYVRRSSDIRDDDTINRMDVWAGYKWKNFDWTIEGIYKKADKYDLYDGGKDNYEYNFRTAYIIDQWSPFVEVGNVSVNSNSDERQTRFRVGIGYTF

SEQ ID NO: 10851 - protein, 614 aa, Salmonella enterica
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGASYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAVTDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 10852 - protein, 369 aa, Salmonella enterica
MLSRWRYSWRILDDNEAQKMKKTAIAIAVALAGFATVAQAAPKDNTWYAGAKLGWSQYHDTGFINNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 10853 - protein, 421 aa, Salmonella enterica
MRVMKWSMIALAVSAGTSQLAMASAQDESKGFIEDSKLSVKTRMLYFSRDFRNNEGGQSRREETGLGFVGTFESGFTQGTVGVGVDAIGMLGLKLDSGKGRAGTGLFPTGSDGRSQDDYSKGGGAVKFRISDTVLKVGDQFTALPVFATDDSRLLPEIAQGTLITSNEIEGLTLHAGHFTSLTAQEQTNRDSFGLKEANVVGGTYAFTDNLSTSLYYSKVEDYWRKYYANVNWALPISDNQGLVFDFNIYDTKSEGSAEYRAFDGEKLDNRAFSLSGAYNIGAHTFTLAYQKVTGDGDYGYGIDGGGTIFLANSVARSDFNAEDEKSWQARYDLNFAEYGIPGLTFMTRYVRGSDANVAGTTNGKEWERDVDIKYVLQEGPAKDLSFRVRQATYRSSDGVYYDSPSIDELRLIVEYPLSIL

SEQ ID NO: 10854 - protein, 724 aa, Salmonella enterica
MSFIQYRRDKHLPSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGTTTNLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEVGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 10855 - protein, 185 aa, Salmonella enterica
MKNIILSTLVITTSVLVVNVAQADTNAFSVGYAQSKVQDFKNIRGVNVKYRYEDDSPVSFISSLSYLYGDRQASGSVEPEGIHYHDKFEVKYGSLMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 10856 - protein, 403 aa, Salmonella enterica
MNRKVLALLVPALLVAGAANAAEVYNKNGNKLDLYGKVDGLRYFSDDAGSDGDQSYARIGFKGETQINDMLTGYGQWEYNMQASGTEGNRDTSWTRLGFAGLKFGEYGSFDYGRNYGVIYDVEAWTDVLPEFGGDSYTQTDVYMLQRANGLATYRNTDFFGLVEGWNFALQYQGNNESGNNGFGQEGSGNGTNRGTNKENGDGFGLSTSYDFDFGLSLGAAYSNSDRTDAQVGNGYGDGHRYYGNNDAGGETAEAWTVGVKYDAYDVYLAAMYSETRNMTSYGDSDYHSADGKLGGGGIANKTQNFEVVAQYQFDFGLRPSIAYLQSKGKDLGGQDMDSHGNYRYTDKDLVKYVDVGMTYYFNKNMSTYVDYKINLLDEDDDFYANNGIATDDIVGVGLVYQF

SEQ ID NO: 10857 - protein, 178 aa, Salmonella enterica
MNKMLLAGSAGIVLLSAAASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSNVAINLGYEGADFDATHNSGSLNSNGFNLGVGYRF

SEQ ID NO: 10858 - protein, 591 aa, Salmonella enterica
MWKLFSQCLKMTSGVAALSVIAAQSAIAAPDESQMNTTQGDVMSPEEALGILQNRPTLKTPLNRDTSKQFRDGTTGNGMSQVTSISELRDVSPTDWAYEALRSLVERYGCIVGYPDRTFRGNRATSRWEFAAGLNACLNTMERLIQENVAVLREDIERLKRLAQEFEQELIALGARVSNLEERVAFLEEHQFSTTTKLNGEVLFTFSTAAGERAIDSRQRDAIFNFGADGRAATRRPDDNATLAFRTRLNFDTAFYGKDRLRVRFQSGNIPRWDRATGTTMARLGHDGPSDADVRFDDVYYRFPIGNFRGFIGTSAMDIDNIFDVGNPFLQESGTGSLSRFMRYNPLVFRGNEGIGGGFDYSLFDSKVVVRGLYLAPNGNSPDLGQGMFNGSYSAGGQLGIYAVDNFDFTFTYVSTFYAGTGDPQRDSNVNTSQSNGSRVASDPFLNAPTLTDNYGIQGDWRINDKFHLTAWGGYGLARAQGQDRNGNDRSGYGADLWTWSANLSVVDVFKEGAVINVGGGQYVTAERIDARTGDLRVPDKDTPYIIQAQYMYPLNDNILLTPGFYVVINPEGDEDNNSIWVGALRTTFKF

SEQ ID NO: 10859 - protein, 747 aa, Salmonella enterica
MARLKTAQPNSSLRKIAVVVATAVSGMSVYAQAAVQPKEETITVTAAPAAQESAWGPAATIAARQSATATKTDTPIQKVPQSISVVTAEEMALHQPKSVKEALSYTPGVAVGTRGASNTYDYLIIRGFAADGQSQNNYLNGLKMQGNFYNDAVIDPYMLERAEVMRGPVSVLYGKSSPGGLLNMVSKRPTTEPLKEIQFKMGTDSLFQTGFDFSDALDEEGVYSYRLTGLARSANAQQDRAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRYAENKVSQNSVYGYGVCSDPANRDSKQCAALAPADKGHYLARKYVVDDEKLQNFSVDTQLQSKFATGEVDHTLLTGVDFMRMRNDINAWFGYDDSVPLLDLYNPVYTDFDFASRDPATSGPYQILNKQKQTGLYVQDQAQWDKVLVTLGGRYDWADQESLNRTTGITSKRDDKQFTWRGGVNYLFDNGITPYFSYSESFEPASQTGENGKIFAPSKGKQYEAGVKYVPNDRPIVITGAVYQLTKTNNLMADPAGSFFSVEGGEIRARGVELEAKAALSASINVVGSYTYTDAEYTTDTTYKGNTPAQVPKHMASLWGDYTFFDGPLSGLTLGTGGRFTGSSYGDPANSFKVGSYTVVDALVRYDLARVGMAGSNVALHVNNLFDREYVASCFQTYGCFWGAERQVVATATFRF

SEQ ID NO: 10860 - protein, 186 aa, Salmonella enterica
MIIRKYFLIIALLLMPWLAIPSVSAADKGWFNTFTDNVAETWRQPGHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 10861 - protein, 212 aa, Salmonella enterica
MKKFTVAALALTTLLSGSAFAHEAGEFFMRAGPATVRPTEGAGGTLGHLNGFDVSNNTQLGLTFTYMATDNIGVELLAATPFRHKVGTGATGDIATVHLLPPTLMAQWYFGDSSSKVRPYVGVGVNYTTFFDNDFNDNGKNAGLSDLSFKDSWGAAGQVGVDYLINRDWLIGASVWYMDIDTTANYKMGGVQQHDSVRLDPWVFMFSAGYRF

SEQ ID NO: 10862 - protein, 706 aa, Salmonella enterica
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGKQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELSLDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 10863 - protein, 362 aa, Salmonella enterica
MKLKLVAVAVTSLLAAGVVNAAEVYNKDGNKLDLYGKVHAQHYFSDDNGSDGDKTYARLGFKGETQINDQLTGFGQWEYEFKGNRTESQGADKDKTRLAFAGLKFADYGSFDYGRNYGVAYDIGAWTDVLPEFGGDTWTQTDVFMTGRTTGVATYRNTDFFGLVEGLNFAAQYQGKNDRDGAYESNGDGFGLSATYEYEGFGVGAAYAKSDRTNNQVKAASNLNAAGKNAEVWAAGLKYDANNIYLATTYSETLNMTTFGEDAAGDAFIANKTQNFEAVAQYQFDFGLRPSIAYLKSKGKNLGTYGDQDLVEYIDVGATYYFNKNMSTFVDYKINLLDDSDFTKAAKVSTDNIVAVGLNYQF

SEQ ID NO: 10864 - protein, 372 aa, Salmonella enterica
MKKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDINGLGSFDLVKYIDVGSYYYFNKNMSAYVDYKINLLKDGNPSNPNTDNTVALGLVYEF

SEQ ID NO: 10865 - protein, 383 aa, Salmonella enterica
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTDKGYDGGVANKTQNFEVTAQYQFDFGLRPAVSFLMSKGKDLTYNNVNGDDKDLVKYADVGATYYFNKNFSTYVDYKINLLDDDDPFYKDAGISTDDIVALGMVYQF

SEQ ID NO: 10866 - protein, 398 aa, Salmonella enterica
MNRKVLALLVPALLVAGAANAAEVYNKNGNKLDLYGKVDGLRYFSDNAGDDGDQSYARFGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNEDPGAGEGTANGSDADSGTRKLARENGDGFGMSTSYDFDFGLSLGAAYSSSDRTDNQVASGRGDGHHYYGNSYAGGETAEAWTVGVKYDAYNVYLAAMYAETRNMTYYGGGDGGDGGIANKTQNFEVVAQYQFDFGLRPSIAYLQSKGKDLGGQDMDSRGNYRYTDKDLVKYVDVGMTYYFNKNMSTYVDYKINLLDEDDDFYANNGIATDDIVGVGLVYQF

SEQ ID NO: 10867 - protein, 178 aa, Salmonella enterica
MNKMLLAGSAGIVLLSATASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSNVAINLGYEGADFDATHNSGSLNSNGFNLGVGYRF

SEQ ID NO: 10868 - protein, 724 aa, Salmonella enterica
MRVKKFIWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGISGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 10869 - protein, 703 aa, Salmonella enterica
MSVYAQAAVQPKEETITVTAAPAAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNDGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 10870 - protein, 253 aa, Salmonella enterica
MKNKKYINSLLAACVLFSCFNGQAAELKRVYGKLSFGYGDWNKGFVNVDRGEVWKAVADFGAVFDRGEFASFYEMNVLNHPVEGRNHVTQFLGHYRVVEGSNFTAMMKLYMSMENKFGDELNMMYGVGYLGLTSPSGFIKPYFAVHNLSNDYTSKKYGQATGFNGYVLGWVAAYNFDMFNEKFVISNWNEVEMDRNDAYAEQQGGTTGLNGAVTFTWKFMPRWAASVSYRYFNNKLGYDGYGDRMNYLIGFEF

SEQ ID NO: 10871 - protein, 234 aa, Salmonella enterica
MIVRKRRGRRTLCCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLAFTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 10872 - protein, 1953 aa, Salmonella enterica
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEPDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVIDGNNARVNNDGDMTITDGGTGGHITGDNVVIDNAGSTTVSGADSTALYIDGDNALVINEGNQTISGGAVGTRIDGDDAHTTNTGDITVDGAGSAAVIINGDNGSLTQAGDLLVTDGAMGIITYGTGNEAKNTGNATVRDADSIGFVVAGEKNTFKNKGDIDVSLNGTGALVSGDMSQVTLDGDINVVSVQDSEGVFSSATGVNVSGDSNTVDITGNVNISADYGQDDLAAGAPPLTGVVVGGNGNTVTLNGALNIDDNDLSATGGQYLDVVGLSVTGDDNDVEIDGGINITHSEDPFDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGAEVSNSGDIFVYATSSNSSEDRAAITRASGEGAAVHNKVGGDITIISNQTPQGNGGIGTYPLEWYTHTFYAMMASDYGDVVNDQGATIHLQGAGVYGVAASKGTASNAGDIYLDGFVPTLDDENNITDTNYWKPSQLYLTSSGMVAGSTSSGEGDATAINTGNITVNNAGFGMMALKDGTAINQGTITLTADDGVTGQANELVGMAALNGGTVINDTTGVINIDADYGQPFLTDGNSLIVNYGTVCFGDDCQDSDEYNPTNSDVSIPYADGATIADAGTSTTLENNAVVTGNASNAGEVSGKPITILDSGTLTNNDSGVINSDTTVSGNLVNDGTINGKLTQNGGDIVNNGTIDSRSLTTGGVLTNGTDGTMTSGAKVTGANSAIINDGTFRLGSATDSTNASMLEINDNAQFFNTGTLILDNNKNAIHLNPNNGTLYNTGTMDLTATSNKGAINYWGAGATFINDGTVNATTATLAYAAGGAGSASQQHAFFWNQSEGIINYDADNGRAVDFSANSNYVAVNDGTMNISGNNAYGMYGGKNAQLVNNGTIELGTEGTTDTGMVAMALDKNATADAVIENNGTINIHANNSYAFSVAGAGHVVNNGTVVIDDNVTGSGLIKQGDSVNVEGTNGNNGNSGEVHYADYTLPGTPVEPDGNMTSGSTTDGTSNNLNGYVVGTNADGSAGQLKVSNASMNGVEINTGFTAGTADTTVSFDNVVEGSNLSDAGAIQSTSVVWNAQGSQDADGNVDVTMTKNAYADVATDGSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKITPYAGVKFRHTMEDGYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 10873 - protein, 656 aa, Salmonella enterica
MTQKRTLLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHFLSAKFSNIQRSITLGALRRVEEGETNGRLWGARLTSGYDFVMMPWLTTGPMLQYAWDYSHVNGYSEKLNTSTSMRFGDQNAHSQVGGAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 10874 - protein, 751 aa, Salmonella enterica
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 10875 - protein, 239 aa, Salmonella enterica
MKNFFAVCIIPLVVAWSATASAKEGIYITGKAGTSVVNVYGINSTFSQDEIVNGHATLPDRTKGVFGGGVAIGYDFYDPFQLPVRLELDTTFRGETDAKGGQDIIAFGQPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 10876 - protein, 696 aa, Salmonella enterica
MFATTRMALLIGGAIGGATFPLFAQETTKNDTVIVTSPVQSGATRLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVSLTSRKPAFDAGGEVKLFAGNNNQRGAAFDVTGPLDDNERVAARLSGMTRYADSQFTPLKEERYALMPSLTWRITDRTRLDLMAYLHRDPQGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTSTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEWLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 10877 - protein, 312 aa, Salmonella enterica
MKKHAIAVMMIAVFSESVYAESTLFIPDVSPDSVTTSLSVGVLNGKSRELVYDTDTGRELSQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 10878 - protein, 435 aa, Salmonella enterica
MSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQIPSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 10879 - protein, 378 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGNNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 10880 - protein, 650 aa, Salmonella enterica
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 10881 - protein, 253 aa, Salmonella enterica
MKKILTLTLSSLLIIPALTHAEFKGGFADIGLHYLDWTSDTTEKTSKKSHKDDFGYLELEGGANFSWGEMYGFFDWENFYNGHHAKPGSEQRYTFKNTNRIYLGDTGLNLYLHAYGTYGSPHRANFHDDMFLYGLGYNFTGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 10882 - protein, 724 aa, Salmonella enterica
MSFIQYRRDKHLPSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIIDADLGATTSLSAGYEYQKIDVNSPTWGGLPRWNTDGSKNSYDRARSTAPDWAYNNKEINKFFVTFKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQDNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 10883 - protein, 230 aa, Salmonella enterica
MKSLNTLVILTSVISTSVFAGAYVENREAYNLASDQMEFMLRVGYNSDMGAGIMLTNTYTLQRDDELKHGYNEIEGWYPLFKPTDKLTIQPGGLINDKSIGSGGAVYLDINYKFTPWFNLTVRNRYNHNNYSSTDLNGELDNNDSYEIGNYWNFIITDKFSYTFEPHYFYNVNDFNSSNGTKHHWEITNTFRYRINEHWLPYFELRWLDRNVGLYHREQNQIRIGAKYFF

SEQ ID NO: 10884 - protein, 223 aa, Salmonella enterica
MRKSLFLLLPLVVTNAHAVYVDVRHEYLDDSKANYDRAYISHRFANGVGFAIEAISKSGGDDTNKAFNDLETQGNEYTISYQFKTGDVAWQPGFVLETGNGYSTYKPYFRATWTLNESWWVGARYRFEYVRRSSDIRDDDTINRMDVWAGYKWNNFDWTIEGIYKKADKYDLYDGGKDNYEYNFRTAYIIEQWSPFVEVGNVSVNSNSDERQTRFRVGIGYTF

SEQ ID NO: 10885 - protein, 618 aa, Salmonella enterica
MIKKASLMTALSVTAFSGWAQDSNSDTLVVTANRFQQPVNTVLAPTDIVTRDDIDRWQSKDLNDVMRRLPGVDIARNGGMGQSASLYVRGTEARHVLVLIDGVPMARPGISNGVDISQIPISLVQRVEYIRGPRSAVYGSGAIGGVVNIITMTDSDRSQVNVGMGSNGYQTYDGAINKRFGDTVVTAAGAYQTTKGFNVQPNSPYSGDSDRDGYRNKLFLGGVQHKFDDNFSGFFRGYGYTANTDYDQGSYGYVGGNDERQNYTQSWDTGLRYSSGIYSSQLIANYQRIKDYNYSSDAGRYAAGTTLDDMEQRYIQWGNNIEVGHGAISGGVDWKQEKLTSSSTTLSDAYKRDTTGLYLTGQQQIDSVTLEASGREDHDEQFGWHGTWQTAAGWEFIDGYRATLSYGTGFLAPSLGQQYGATRFASFYGPGIASNPNLKPEESKQWEAGIDGLTGPLDWRISAYHYEIQNLIDYKNNQYINVKSATIKGLEWTGNVTTGPVEHHLTLQYVDPRDDDTGKVLYRRAKQQVKYELTGQIYDLDWNVMYQYLGKRYDDDYDNGRDVKMGGLSLWDVGLSYPVTSHLTVRGKIANLFDKDYETVYGYQSAGREYTLSGSYTF

SEQ ID NO: 10886 - protein, 358 aa, Salmonella enterica
MDDNEAQKMKKTAIAIAVALAGFATVAQAAPKDNTWYAGAKLGWSQYHDTGFIHNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 10887 - protein, 230 aa, Salmonella enterica
MKINKYLLGMVSFIAFSSYLQAATLDYRHEYADRTRINKDRIAIIEKLPNGIGFYVDASVKSGGVDGEQDKHLSDLVANAIELGVSYNYKVTDNFVLQPGFIFESGPDTSIYKPYLRGQYNFDSGVYMAGRYRYDYARKTANYSDDEKTNRFDTYIGYVFDELKLEYNFTWMDSDQIKFDNKKTNYGHNVALAWKLNKSFTPYVEVGNVAVRNNTDERQTRYRVGLQYHF

SEQ ID NO: 10888 - protein, 745 aa, Salmonella enterica
MCLLRSRRRITLPMSRLAFSPRLTIPLSSLLRGGSATLLGSTVLAGGLCGFVHFAEAADLSSADVSLPPLSVVSNALDQARSQIQPSLGATTYHFSRTALETIPQGDNAPLQQVLLQAPGVAQDSFGQIHIRGDHGNVQYRLNGVQLPEGLSVFGQVLETRFAHSLSLIMGALPAQYGFREAGVVDIVTKNGTTDPGGQISVYGGARDYFQPSFAYGGRKGAVDYFLTGDYLLNRVGIENPTSSFNAIHDQSNQWHGMAQISGIINDTTRISTIVGSSTQHFQIPNRPGLLPSNGYSVNGIDTKDSATLNQRQREITNFAILSLQKHYDTVDVQSSVFSRYSSLYYAPDQIGELLFNGFSQSAARGVTSTGAQTDASWKVSDHHTVRGGFLATIERATFQTNSQVFATDDSGQVASGASPYSIYQGGGRTGGLYGIYLQDEWKILPRVTINYGARFDVVDEYTHENQLSPRVNIVWMPTDRTSVHAGYARYFTPPTFELLSTASIAAFQNTTAAAPGGLLNNTVKAERANYFDIGIDQQFLPGWRGGVDGYYKQATNLLDEGQFGAPIILTSFNYARGYVGGVQFDTTFDRGPWSVYANVAWSKAMGKDIVSAQFNFDPEELEQIKNSYIHLDHDQRITASAGAAYTFFHDTHHPLRMSGTMLFGSGLRSDGTVPNGSALPAYGTFNFSAVQTLDLGFGKSTQIRLDVINLFDSTYMLRDGTGVGVGAPQYGLRRTILAGLTQRF

SEQ ID NO: 10889 - protein, 590 aa, Cyanothece sp. PCC 7822
MSQKWWTLIKGAPLWLGASFLTSGGVMAASDTSLTEVEPFSEQQLLAQAAPGTSTNVAPEANQLLQMMQRSRSGKRLNTGVYNDPMSQVNNVNQLRDVEPTAWAYEALRSLVERYGCIVGYPDRTFRGDRALTRWEFAAGLNACLNVLERLIQEGVAVVREDLEKLKRLADEFAAELAALGARIDNLESRVAFLEDHQFSTTTKLNGEVIFAYVNAFSDDYAFDSTFENRTPRQQAALEDSRRIGREGIFVDRARLNFDTSFTGKDRLRVRVQSNSTPNLTTATGSNMARVGWDSGTNNDTILDDIYYRFPIYKNLTAWVGTNALDLDDIFNVGNPYLEASGTGALSRFVRRNPLVFRGPEGNGAGLRYKFNDFITVTALYLADQDDAKNPLPGRGVFNGNFSTGVQAVVSPTRTLDINLTYLHSYFSENRVNLTGSTGSRIGQDPSTVYLPLGTIPSAWNRDSVGAQVDWQAYPWLHLTAWGGYAYAEAKNPDYDSSADLWTWNAAVSFVDLLKEGAVLSLTGGMPPRATGVENGPDDEDTSFLVEVQYKYPLNNNILITPGFYVIFDPNHYERNNDIWVGVVRTTFRF

SEQ ID NO: 10890 - protein, 446 aa, Cyanothece sp. PCC 7822
MSQKTLFTKSALAVAVALISTQAWSAGFQLNEFSSSSLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVAPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 10891 - protein, 888 aa, Cyanothece sp. PCC 7822
MSNQYKLKKVAYSVGLGLLVSAVSAVAQESQVMEEVVATGSRLQGTAAAVIEERKNQAFVADILGSEQISRTGDSDAASALRRVTGLTLVDGKFIYVRGLGQRYSSARLNGASIPSPDLTRNVIPLDIFPANVIESLSVQKAYSPNMPAAFGGGNVDIRTKAIPTEFVSGIQVGIEANSNNSDGYTYDRNEQGIPQTLTDAIPYYRGDFSLANIINKDNLVTGDTSAADQARVLNRTLAKSLPRDLALIDESLDPNYSAQAFIGNSFDEDFFDGKIGFLASVAYDNKWTYSDRTSAVTSATPIDNCSSQLVTAEDVQNSCFDTVASSEMTTEEERLNGLVSVGYKLDTHSLTYTKIYIEDNEDESQISISQNPSQNITIAADNEADRTHSFNFEERTLDVDQFRGQHTFLDYMGVGVDWQYTESSAETNNPLNVAYEFTDTYDNGAYTGSFIDGAQGRANYQFVDMEDNMKSWGGNVTLPLTFKNFEVELKGGWDFVDRARLYTTSSFFLDNTNSSIVVNDNESDILSLSSYLTDEFIDTNMLINFNEPIAPEADDYLAAQKIDAGYAAFDVFYKGIWRISGGLRYESFKQVSLSSSSLIFTKEDSDNYYSEEDILNGTVNDDDFYPALSLTYVGGEDYQLRFGYGETVVRPDLREVVPVGYNDPLTDIRTTGSTTLSSTTLKNFDLRYELYFDDGDNLAISGFYKDIANPIETVLNVGDSSYTASFTNGETAEVYGVEAEWLYDLSFVSDGFFTSGNITLSDSEVQIDAASAGNLTNTEKRMTGHSQYVVNMQLSYDSANGNHSGSLVYNAFGERILASGINGRDDSFEQPFHSLDATYSYYPDFNTTVKLTVKNLLGEDQEVTQSGLSVRTRSIGTTVKLSYKYDF

SEQ ID NO: 10892 - protein, 379 aa, Cyanothece sp. PCC 7822
MSQNLRSRDPGTVSIHLTTDTLGANINRLDLHLLNRKNLSMWVGSMRNSIFQYNPADYPAGPYVPNNDNTYKILQKGVYGSFVAHVADPLKLIFGGRLSWYSYNSAINAVDQNTGAVTSTSLTAYEDNKVFTPYLGMVYDLTSQWSAYASFAETYQPQAFNLRGPLPGTPLGPITGRTYEVGVKGSLLDGRLNTTFALYHVKRNGEAVRDFAYPATPGDLGTNCCWLGDGRIVSQGVDIEVNGEVAAGWQVSAGYTFNDNENIAGGGRYNAFTPKHLFKLWTSYDLQGPLEGFKIGGGVTAQSSFYQTGTFAGNPFRITEPGRAVVDLFAQYRLDEHWTLALNVNNLFDRTYYQAIGAFYLGNFYGAPRNFLLSARARF

SEQ ID NO: 10893 - protein, 901 aa, Cyanothece sp. PCC 7822
MLEESAVTRGKWMLAAAWAVVLVGARVHGAELNTLRGLDVSRTGSGAQVVVTGTRPPTFTVFRLSGPERLVVDLSSADATGIKGHHEGSGPVSGVVASQFSDQRASVGRVLLALDKASQYDVRADGNRVVISVDGTSQSVDAKRAETPARTERMTASVEAKPHPVAAQAPAKVVKAESAAVPKAALPENVVAAEADEREVSNPAQHITAMSFADDTLSIRADGDIARYEVLELADPPRLAVDLFGVGLATRAPRVKSGALRDVRVGAHADKVRLVLDVRGTMPAYRVDRANRGLEVVLGRAVARTWRRPLRPRAVVASVAEVEPLRQTPVKSDASPVVEVKDVRFEESSSGGRIVMKLSGTSGWKVDRPDPRSAVLTLDNARLPKKFERSLDTSALDTPVKMISAFSVPGAGGKVRLVVAADGAIEEKVSQSAGTLSWRLDVKGVKTEEVAVAQRTAGFTTEAPAYAAEGAPQQARYRGKRVSFEFKDIDIQNLLRVIAEISKKNIVVADDVSGKVTIRLRNVPWDQALDLVLRTKALGKEEFGNIIRIAPLKTLEEEARLRQERKKSLQQQEDLMVNLLPVNYAVAADMAARVKDVLSERGSVTVDQRTNVLIVKDVRSNTERARSLVRSLDTQTPQVLIESRIVEANTSFSRSLGVQWGGQARAGQATGNSTGLIFPNNLAVTGGVTGTGAGLPDNPNFAVNLPTGTGQGVGGAMGFTFGSAGGALQLNLRLSAAENEGSVKTISAPKVTTLDNNTARINQGVSIPFSQTSAQGVNTTFVEARLSLEVTPHITQDGSVLMSINASNNQPDPSSTGANGQPSIQRKEANTQVLVKDGDTTVIGGIYVRRGATQVNSVPFLSRIPVLGLLFKNNSETDTRQELLIFITPRILNRQTIAQTL

SEQ ID NO: 10894 - protein, 727 aa, Chthoniobacter flavus Ellin428
MTQLSPTRLSILACALTTAFNAQANSPTQAPAKIEQISIFGSKNPLDTTPGSAHQITEAELETFKYSDIMRTLTSVPGVYIQEEDGYGLRPNIGMRGTGQNRSEKITVMEDGVLAAPAPYASPAAYYFPTSGRMQSVEILKGSSTVKYGPRTTGGVINMLSRQIPQETLAGKIDLALGQDGFGKLHTYAGGQGKRIGAVAEIYRYQADGFREINTVGGDTGFTKNDALAKVRVNTDSTATYQQSLELKLKFADETSNETYMGLTDADYQASPYSRYSASQKDQMTTEHKQVQLNHIIDFSDTLSLSSIGYYNDFHRNWYKADKVGGESLSGKGIQNAADFDAGLLSELEVNVKANNRSYLAQGIQTELNWLLGDHDLAFGLRYHEDEMDRYQWADSYAMDANSVMLRTKSGVPGTDSNRVDSATAFAAYVQDKISLDALTITAGLRWEDVETQRRDWGKKNPGREGNPDKQVESQFNALLPSLSATYQINEQVLLLAGVQKGFSPAAPGNAKGQEEQSWNYEAGVRYHQDAFSAELIGFYSDYSNMHGNCTAAQGCDDAKLDNQYNAGEVEVKGLELSLAHEFNRTGAMSFPVKLAYTYTDAEFGNSFESEFETWDKVEAGYKLSYLPENQLYISAGVQSQSWQVTVAARYTDEMRTKAGAGAIPADEVIEAKTLVDLSARYFVTHSQEVYLTVDNLLDETYMTTRVHGSIFAGKPQTVTLGYSYKF

SEQ ID NO: 10895 - protein, 210 aa, Chthoniobacter flavus Ellin428
MFSATPSASAVTPYVRASGGVGLMNNVEYRFTAQDKVETDKMHAGAAVEGAFGIKTGRFRVEAAAGYQSNQVDQFTLKGTGYGVNNGLTSTPESGDEKWTYSIQSYMVNGFADFNTESKISPFVMAGVGIANIQNKEQYPADATGVTVTGTSNGVFAWQAGAGVGVNASDKVTIDLEYRYFAASNAEGFAADRVVDISTSNLLLGVRYGF

SEQ ID NO: 10896 - protein, 801 aa, Chthoniobacter flavus Ellin428
MKIRAIATLLFILFSISAFGQGRAKISGYIRDADGNPLDLVNIRVKNTLNGTMSNEKGHYSLSVATGDSVTLIYSCLGYNKAERILPQVTKDMRLNVQMNYTSLELGEVVATAIRKQTTTLETLNADRVKLLPDPAGGSIESLVVTFAGVTSNNELSSQYSVRGGSYDENIVYVNGLEVFRPLLIRSGQQEGLSFINPDMTEAVNFSAGGFEARYGDKMSSVLDITYKKPKGFEGSASASLLGANAYVGSSSGKFTQVTGFRYKTGRSLLKTTDTDAEYDPNFIDLQTYMTYQLAPKWEINFLGNLAINNYKFIPHTRETSFGTATNAKKFKVFMSGQERDKFETLFGALTLKHNLNDNTELGLQASAFTSKEEEGYDIAGDYWLGDAAEEGGGEIQKLSIARYNEHARNRLHSNIMNVGHYGVARIKNNTLKWGATVQLEKINDKISEWEKRDSAGYSLPQGGGNVNVIANLFSDNKLESTRISGYLQDVFKFRTKQGLFTLVGGVRGSYWSYNREFIFSPRASIGFIPNFDQNLTFRLASGLYYQSPFYKELRTTVQDEHGNSIIQLNKNLKSQRSIHVIAGGDYTFRASGRNFKVSADMYYKKLDNLNPYTVDNVKIRYYGENCAQGHAMGLDVKFFGEFVPGTDSWISFSLMKAEQSIRGSEYVPMPNSQGYNVSLFFQDYFPGYKRVKLNLKGVLSGGLPVTAPRTGYEDGYFRTPTYKRVDLGFSYQLAGGTDAIMDRGFFRNLKNIWLGLDIFNLFDIKNTSSYYWITNIDNHQYAIPNYLTGRQLNIRLIVDF

SEQ ID NO: 10897 - protein, 911 aa, Chthoniobacter flavus Ellin428
MNKLVFILLFFVTALASAQNGTIAGTIIDKDYNDEPVAFASVQVKGTTKGAQSDMDGKFTISIAPGTYTLVVTFVGMQAVETPVTVTAGNTTNIMIPMIAEAAALDDIVITVTKTRESAAALIEEKKKAVTIVQSIGAEELSQKGVSDAEGAVTKVSGVSKQQGVKNVFVRGLGDRYNSTSLNGLPLPSEDPEYKNIALDFFGSDLIESVDINKVFTSELGADVAGANVNIDLKGLSGRKDLAVSFSTGANLQTIGEDFKGIDGEGYFGFSDAELPVNNLNVYGFDNKLTASNQNNLINLGLSLKGGKRFDIGDNYLNVYGLVTFDNGYRFVDGTIRNTGSTGNVFLDQDFQKYQYETSQIGQVDLDYRFGKNKIEWISMYIHKNTQSFEDYNGFNNPEQDGDLVYVNRQQTNDNNLYVNQLLTHFELSDRLELDVKGAFNALRGSEPDRRNFEYLLRDGFYSPNIDSGGNNQRYFSKIQENDYNANVNLRYDLNTNDEDDRLNYFTVGGDVRWTHHVFQATIFNHTFDTRIAIDIDNPDAVFNQPNINNGNFRLETGRGSAINPQAFNPFYYIGDKVLFAGQGNYVKGFTDKLLMNAGLRYETVSQEVEYDTNIASSANEGLAEINENLFLPSLGFKYTANDKNIFRIAGSQSYIMPRFKETAPFRYDNPGGTATQGNKDLQISKVSNFDLAYEFYPAKGELFSLTGFYKIIDNPIARTEIPSGGNTLTYLNVGDQATVLGVELELRKNIFVKELPEAGYDVTRENKLAFGFNASYIHSEQDQVNPLAQFTNSTSQLQGAAPVLVNFDLNYNTYINKSSVNTALVFSYFSERVYSVGTRGFENINEIGVPTLDFIGSIGLTENSKLSLKARNLLNPEYRLEREGNGGLGNVILSQYKRGLDISLGYSYQF

SEQ ID NO: 10898 - protein, 1009 aa, Chthoniobacter flavus Ellin428
MNNFSFIKGGLALYCLIFAGFLFSFSSIYSRDSINCKSLFYQQHLIQGIISDGISPLPGVTVTVKSNRNLSCITDYNGQYSLKASPQDTLIVSFIGFKTALVPLNGRTKVDVKLLYDTTTLQEVRVNAGYYSVKESERTGSISRIGATDIEKQPVSNVLATMQGRMAGVNITQDSGTPGAGFQIQIRGLNSLRTEGNNPLYIINGVPYSSENIGYSNTTTGVPTPTSPLASINPNDIESIEVLKDADATAIYGSRGANGVVLITTKKGTAGKTKVIIAASSGFGRATRFMDLMNTQQYLEMRRQGFANDGITSYPASAYDINGTWDQKKYTNWQKELTGGTSVITNLQTTLTGGSQNTQYLLSGTYRTETTVLPADFGYDKGAFNFNLNHASEDKKFKLTFSTGYTFQSSLQAATDMTRTARNLAPNAPSLYNSDGSLNFENSTWQNPLASLRSTAEVKTNDLNMNSVISYQVKPQWEIKINLGFTDLNNAEMRLLPSTMFNPALNYNSSRSSMYSNLTQRQSWIIEPQLRWKHDFEESTLDILIGGTAQEQKTSRLYQFGRGFSSNSLIRDFLSATTKTIFLSDEIQYRYQAFFARANYNWNQKYILNLTARRDGSSRFGPGRQFATFGAAGAAWLFSKEKFLQNSTFLSFGKLRASYGTTGSDQIGDYQYLDTYVSSSQSYNGIIAMDPTRLFNPDFSWEVNKKLEIAVEAGFYKDCIFLTAAWYRNRSSNQLVGIPLPATTGFTSISANLAAEVENSGVEFTLRTVNLNRNELKWKSSFNISVAKNKLTAFPGLEGSTYANRYVIGQSTSIVKVYNYVGIDPVTGLYKIEDVNKDGIITSLGDKKTIMDLSPKYFGGLDNQFEYKNWKLDFLFQFVKQLNYSYTSNVPGGSPINQPSAMTDAWLQQGDVAQYQINTSGQNGNAVNAFYNYTDSNANIVDGSYIRLKNIALSYRLPLHNSKGVGCRISLLGQNLLTFTSYKGGDPEFKYTAYLPPLKVLTAGIELTF

SEQ ID NO: 10899 - protein, 712 aa, Chthoniobacter flavus Ellin428
MTDKNSLRTWARAQLLLGVAAAALAAPAGAMAQAAIAAPDKDVVTLDDIIVTAQKREQRLLDVPMAITAFTGEAIEQRGAASLQDLQFSVPGLSLVEQGPGQQRVQIRGVTTSNGLPTVGQYLDEMPISIDDQTQTLDLRLIDMKQIEVLRGPQGTLYGEGSMGGTIRFLTADPDLGQIGGSFEGQAGSVTDGATAWRVNGVVNLPLVKDRLGMRLVAGYENTGGWIDSSVTGKKDVNAAKILTLRGKLLAKFTDNIQASLLVLHQEQDQDYQNFGVSRKTSSRVAEQNNPKYDLANLVLKWDLGSANLTNSLGYQKAENNTVTDLSNTYVPLLPLLGVPAGLITSVGLGSTSDVDVLTDEVRLTSAVGGQFDWSAGAYGRHLKRTGTSRSATAPGSLAFNLISVTATFESKAWATFGELNWHATDALTITGGLRYFEETRTLESVNRSFGGLATASNSGKFSSLNPRLNISYDVSPTGMVYVSAAKGFRSGGFNLAATGGPPTYDPDELWTYEVGTKHQWFDRRLTFEGAAYYTDWTGVQSSFVPTGAAIGYVTNGGKVNGWGADVSMSARPATGLTLSATYGWNNLEYQGKTAEHAPGDPVDYAVRQSWSGSIDYRRPVVGNAEGFARLDYQHAGRSAIINRGSAVNVAIDPRDLVNAQLGVEFRRYEVSLFASNLFDEKTPIVPGPFGAIFQDIEPTPRIVGARFKATF

SEQ ID NO: 10900 - protein, 794 aa, Chthoniobacter flavus Ellin428
MTTEHTQSHTRLKPAFLKQKTLTLFTLSALSVGMAQAAENKVNKSELETITVTSQKRVQSLQDIPTSIQALSGDYLEQNSVDDLLALSENLPNVHITETSSSKRIFVRGIGSGTNSGFEQSVAMYKDGVYLGRGHQAKFPFLDMQRLELIKGPQSVMFGKNATAGAFSMISNSPTDVLEGNVSAEFGSDNEKRFTGVINIPINDDLAIRIAAFDHSVDGFLYNQARQSDEQSNDSSGARLSIDWQINDDINALFKWEHGEFESHGSRYQYIIDTPNRDLQIASDPTNPGNVGYRSLLLSDNSGLDYTSSVSGDGHPGGLNEQSKTTLDNASLKLTYNHGEYEFTSVTTYSEYDWDSTFDADFSEVPLIKQDYLETYNQFTQEFRVSSPIGRTLEYVAGIFYMSSELEHPNDILFGASLLIPDLVGTSLGVNALFDQDQQSYSAFTALTWNVNAQWRANFGLRYQKEEKEVSSVQNVYSVFEPNTPQAVQQFANAAAPTIAGQLSGAGVHNLNAKRDESHLSPNISVQYLGFKNTMLFASAGIGYKAGGFDGSGLNGSQGNTVDENSGFEFDDEKATNFEFGIKAEPIKNTLQVNATLFYTLYDDLQVSEFNGNAFVVKNAAETKVKGIELDSRWAINQSWQLSANLAVLDFEYEQYASASPTVMQSELLGQAFQDLTGQTGAFAPDYSGNIAIDYNTEVFSNLTLSSNLALNFSDDYFLEQDLDPIAKQSAFEKLNLRIELGSSEGDWSVALLAKNLTDKQTFSQANDVPVISYAHRFLSERGRSYHAQFSYRF

SEQ ID NO: 10901 - protein, 740 aa, Chthoniobacter flavus Ellin428
MSIPFARTALSCAMIGCSWTALAQNAPVTLNDTVVSASGFEQKITEAPASISVISREDLQQKRYNNLAQALGDVEGIDIGQGTGKTGGLNISIRGMPSQYTLILIDGRRQNAAGNVTPNGFNETSTSFMPPLSAIERIEVIRGPMSTLYGSDAMGGVINIITRKVAKEWTGSLTQDYTYQEDRDFGDTRNTSIYASGPLVDGLLGLQLRGSLFDREASDLSYGNGIEVSKRGPSPVEGRTHNLGARLSLTPHEDHDFGLDVERGRQVYNNDECQLGSLDGQNQECTASAATRANGYADELRFEREQIALTHTGRLGFGTLESSLMHNTTETIGRTIPGTIGTPTAVPGAIGGAPRELETTNLVLDTKLVAPVGESHIATVGGQWWKAEMDDGIAQTTFEQKTWAVFAEDEWRLREDLALTLGARYDDHEAFGGHVSPRAYLVWNTSENWTMKGGVSRGYRTPDLNDLHSGVNGATRQGQVITIGNPDLEPETTTSTEFGVYFDSLAGFNANATLFHNKFKDKIASGDPIQITGRPGIPDGSYAQQINIDEAVTQGLELAASWAFAPAWTLSANYTYTDSEQKSGDNKGEPLTNTPEHLANAKLNWQTTDRLNLWLKSEYRGERARFTSSYENLADNGRYSTNQSIYDTLGKNTKAYTLFHLGGSYRASENLTFNAAIYNLLDKDFVDGKAYGTYSYANSNPATLPTIGTAYGTDFSHSTAGTTGVMEEGRRLWLSANFTF

SEQ ID NO: 10902 - protein, 784 aa, Chthoniobacter flavus Ellin428
MKKRIPTLLATMIATALYSQQGLAADLASQCMLGVPSYDRPLVQGDTNDLPVTINANHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVSIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 10903 - protein, 700 aa, Chthoniobacter flavus Ellin428
  misc_feature (687)..(693): Xaa can be any naturally occurring amino acid
MASSASAQSTPPSQAETPETTTQSATALDEIIVTAQRRSERLQDVPAAISAFGGEQLDNAGVVNTRDLATVTPSLSFTLNSYAPQAAIRGIGTRGVNPGDEQVVPIYLDGVYQPFVVGALFELSNIERIEVLRGPQGTLLGRNATGGAINIITDAPQAGFSGNAAIGYGSFNERSANLYVTGGTDIVAGSLSLDYIQDDGYVYDLTNQRDFGSLDSFTARAKLQITPDEFTTVTLAATFADRYDDSSIANFALNGNSIARQGRPTLTYATGNYESSQDPGFAPRLTTDQKGLSATIVREFDAFTITSISGYQENRLSYDADVDMTPAPAFNLKSDQYDESFNQELFIASAGDGPFNWVAGLFYFNNSAGQDPRNLNGGLIFTDTHAEAWAAYVQGSYDFTDALTLTVGGRYSSDTKDAQARNGTNTQILPYVEESWDSFNPSASLDYAVNDQTKVYLRYATAFKSGVFNATGFAADPVDPEQVKSWEIGIKSDPAPWIRTNFAAFTTQYDNIQIFARSPDPNNASVILQNAATAEIKGVEGDVTLRPAPGLNIIVSASYLDAKYDEFPLAQSFIARPGGGNTAIIIDASGNRLTRVPEFTGSFSVDYSVPAFGGEVTASGNLYYNGGFSWGVDDRIVQDAYTTVNAQLSWTPADGRYKVALWGRNLTDSDHLLTVSSSVLGDQGAYXXXXXXXRPSCFLK

SEQ ID NO: 10904 - protein, 449 aa, Chthoniobacter flavus Ellin428
MFQLPKTRYSGLALATLLGSLSSPTTSASEMFAKDSPWMLGDWGGTRSELLEKGYDFTLGYTGEMGSNLHGGYSHDRAARYSDQFTFGVNMDLQKILGWQDTEFQLTVTERHGDNISNDRINDPRVGGFTSAQEVWGRGETWRLTQMWIKQKYFDGALDVKFGRFGEGEDFNSFPCDFQNLAFCGSQVGNWVGGIWYNWPVSQWALRVRYNLNDELYAQVGVFEQNPSNLESNNGFKLSGSGTQGAVMPIELVWSPRVNGLKGEYRAGYYYSNAKAQDVLKDSHGTPAAISGAAYRSSSSKHGLWLGAQQQVTSLATDQSRGLSLFANATVHDKKTNAIDNYVQAGVVYKGPFDARAKDDIGFALARVHVNPGYRKNARLINQANGLDDYDNPGFLPVQDTEYSAELYYGIHLADWLTVRPNLQYIRHPGGVSHVDDALIGGLKIQSTF

SEQ ID NO: 10905 - protein, 862 aa, Chthoniobacter flavus Ellin428
MKVKTGQRQLPLPTAQSSTLFPPGTQLFPFLFWWLVAASALSSSETASSFPQASSTSDSSTPLSDPPSTPTDISTPGPTAAGSSTPGGQQGSLPGMVVSTTAPGESMLPTATPTESGAYGQPLNVLDIPRQLFPVNQKILQTEGAGTQGFFDPVSTAFLSPGSTASAGNNLVIAPMIRGMPPLGFINGMQMAMHDGGWWNLPWNYNMVESFDVIEGPPNAVLGEFQPNGGAVNYITKQPYFDRFRGYVWDTTGMYENYLWGADIGGPIDKEKKIAYRFSYMGMENGSYYQYQYNDQQNFYLALSARPSDNYSVDFYSDLGTYNFDIMDFMNRPTNELINNDLYQTGALAPSQVAFGFPPFNTYAGPLVPISLRSTDMNPASGAQGITGMLQLVQNIVIDDDLHIRNNTFVFYIHNSFIDYSEMQDIDVPGDYEVYNRTEVLAALHPEEALFEQNIDAGLEFGFQRNLDYEASFLGIQNAWSIANPNNPSLANPNLWNAELSNAFVAEIKNPHAFGGGMWPIPSAPPGWYFQPLNGYSLTEDSQFWEVAPFYQHNIHFTDKLMLLVGGRATNLFISAQTPPGTPAFLSTGYDAAVLMPMVNVSPVYKPFPWMTAYFDFNWGYTSAVGDLGGYTPIYAGAEFRLVNQLIEGGMKFSLLKDKLYITTAGFEQNLYIPNVGLPPALAYIKGFELALTYQPTKNFWARIQYLLANGTEDWSGLPIGPFQFQTYSTSTALAQGLPLNNATSYPPGKYAFIGWPDQSLTAMVTYQTNMGLGVTLSALVLSNQYLDYSYNLEIPTEYVINGRLYYSTPRWDIAVNIYNLTDNRHLWFPFGPGATFGRTLNTEQIIAGLPFWVQGTVGYKF

SEQ ID NO: 10906 - protein, 978 aa, Chthoniobacter flavus Ellin428
MKTRLLILLLFLYVGGNLVAQNATITGVVTDSETKDFLIGATVMLKGSNKGTITDANGQYTLFIPKGKQTIQFSFIGYQTQDFDVDLKSNEVKTLNLVMRPDNHMLKEVVISAQAKGQTAAIKSQLNATGIMNAVSEEKLHELPDVNVADAIGRLPGLMIQRDGGEGQKIIIRGLDPKYNSVAINGMNAPSTSSTDRSTDLNMISPDMIAGAEVLKASTADKDADGLGGTVNLIMKDAPRDFKLNVTGETGYHSQINGMGRYKGGIMASNRFFSERLGVIFTASADQTDRSNDTFNAAYKVNGNTPTPGFDYTKPWITGVSLESNLEKRQRFNVNLNMDFDLGKGSKLKMSNLFSRMNRDRDIRQKRYDLEGTRLRFQQTDRNSHNTNITNMLQGEFNVLGATLNLGVGRSSSRTRTPYDHQMQFRLNAPFTADIDALSYQPPYLIANSKFVKEDDLTQYYLYEAIFNTEFAKETEYSAWLDLKKPFSFGEKVNGYIKIGGKFRQKERSLETARRYRRMDLSEGADPVFENMPDLTPSSFKNSYIGITDFLDSDYKPHDFLNNKYKDLCINFALDHNAMRNFYNINQDIYGKILTTKILKDYDGNENLWAGYIMGEINFGKYVTFIPGVRYDFSHLKYNAYSGSNVPDNEEKEHEFEYEKSSDSDKYGYWLPQIHLRVKPTNWMDIRLAYTETLSRPDYNLLAPRTIIKPNVNEVTWSRTNLKPALSRNYDVILTFYQPDYGLFTISGFYKDIKNFTYTRSAYMLNGTVTDPANFDLPMSLSGGSITYPLNSPYNATLKGLEFDLQLQFRKMRNFMKGVVFSANLTLMDSKMNYFETLKSRIKNPDFTPGGTEKPFLPTNSDIIYTDRLLKQPSLLFNVSLGYDYKKFSGRISCNYQDGVLIAEQHRQDAADVESTRPFVKWDMQLKYSLTRQFSLYATLSNFTQSSDRKRRDITNYPSRVEYYGSAAYIGFKYDIFK

SEQ ID NO: 10907 - protein, 763 aa, Chthoniobacter flavus Ellin428
MHNSQHASKLFRPLFLTVAISNIIWPEFTMAQTREFTYSATIPGPSSVALSDAIAGDGNYNATINVDNPDKPLEVYFGQTETLQKTYDIGNYSVDIYGQNTTDSSYTVFFGLAVDSNNAVSINNFSYNNNLKVGGDNHHHNSTALIASDGSKVTIDGKVYINSLVEMDTSGSETASIANNGLYATGMGSTITANNGDVYINTYAKNFLELLGENASYTGGGAKSDAVSGKHGGQVIINETGQYQVNLLGNLDLGNAFGLGSSITVVLNGSDSYWHGTEANEYNADSNTWAGILDVTLMNKAQWIPDAVNAEISALTLQNGGTVNLHGFNLHTNKSQNEGVKVYDLKGSDGIFLIDVNISKTDDQRKNDSDFIEVVSSSTGGSHYIEALNVDKLANLSEDIWVADAASNVSFKADDQIDVNNEYVYDYKPIIRSDIRDGDPLSQYGTNWYISGIDKKLSAVSDTVLANAGVNYATATARLEIDSLNKRLGELRNDQQENGIWLRYKGGEMKSKDTSHFKNQYDFYQLGYDNKDEYENGIWTKGIAAHYLDGKSEFDYGSGDNKSYGGSLYSSWNRPDQQDYVDLVFKYSHLKSNFDYRNTLGTGGHGTGSNSSWSVSAEYGREFSLDNGNFIEPQGQLVYTYLNKADYSTNSGLLVSQDNINSVIGRAGVRVGHRFEGKSNNDIYLKADLLREFAGDRNVTIRGKDTVLVDNQNGKDNWIVYGIGTNIQFTEDNNSRFYLDLEKSSGGDINTQWQVNAGLRWEW

SEQ ID NO: 10908 - protein, 734 aa, Chthoniobacter flavus Ellin428
MHGMAGSYSMERRSLNLHFMTCSKTALASSIALITSVVYANEAEVSQLPTITVNATQNSDALYTSKKVSLSGFQTGDVKKVPASITTITSERIADQHAKTLTDVIKNDSSLGDGYAAIGYYPNFVARGFALDLGSSYLINGHTIRGEQNVALENKEQVEILKGISAIQSGMSTPGGVVNYVTKRPADIKTITVDANSEGGYTLATDVGGFVNDSFGYRINLAHESIHPNVDHANGKREFGSVALDWKINERSKLLFDIEAQHQSQRSVPGYQLLDGQEVPTNVDQDRLLGYQSWSKPVVNNSVNASLKYQYAFNDQWNGSLSASQSRVVIDDNSAFPWGCYNDICEYSGLGNTFDKHGNYDIYDFRSPDDTRITNQFAAGLNGHFNTGNIQHQIAFELQRTYKTLKHHTPLNVAVGTGNIYEDTVDYSPSSESPGDRYKALESDQTALTVSDRVQFNDQWSTLLGGKLIHLDEQAYNSDGQQSRDTDLNKFLPQLALMYSPTSTTNLYASYAKGLSDGGEAPWFANNALEVLSPKNSEQYEVGIKQQIRNFLVTAAIFDLKQDNQYTTANSAGELEFISQGEQHNQGIELGLTGALTDTLDVSSGITYTKSRLVDIDTDSYKGHQTQNVPKVRATAQLSYKVPSVEGLRLLSGMQYSSSKYANKEGTAKVGGYSVFNIGAAYKTNFAGHDTTFRFNIDNLFNKKYWRDVGAFMGDDYLFLGNPRTAQFSTNFSF

SEQ ID NO: 10909 - protein, 657 aa, Chthoniobacter flavus Ellin428
MRASLFGLHCAASPTLRQRPSRANGIAMKLSRLALPLCLLPCAELFADTPDRDQALKLPEMLISANRQVEARNDSSAANTVFTREDIDRLQPTSLTDLLQRVPGVQVAQGGGRGNLPNIFIRGTNSAQSLVLVDGQRISSSSSGDSNLQFISIEQIERVEVLRGSRSVIYGSDAIGGVIQIFTRRGAGSGLHGRMRVAAGSNQTWERSLGLSGGDQQTRFSLGANLDETAGIDWTQESFPSDADHDGYRNKSLSFTLSHALNDDLEVGLNLLDNRGRTRYDNPFGRYDSSYDVFAQDPYTDFSVSSVSGYLDAHINDYWTSRVELGHSENRDLKRDKLSDERNVFNTYRDSLNWQNDLRLDEHNSLILGADWYEDRLNTSPARFAEDSRWNRAAFIQHRFRGDSFSTELGLRRDQNQQYGSQNTWSGTFTLPLNPDNDLLLSYSEGFRAPNFSDLYYPGFSNPDLKPEHSKSYELQWRNQLTQSTRLETSIFRTDIKDAIIYDRIAQRPENVGAARINGFEAALKQELFGWQTSIGTAIIDPRNRKDGHQLPRRARRTLNLDLDRQFDQLALGASWQLVSKSREDLSTKKQVPIGGYGLLGLRSSWAINQEVKLDLKLDNIVDKSYSRALYEYNGNDYGYRSESRTWMLGVTWTPEL

SEQ ID NO: 10910 - protein, 281 aa, Chthoniobacter flavus Ellin428
MKNALAGFLAVLLTGTSAIAADLYQAEPAPAYVDAPEVTVTQASGWYLRGDVGYSFNKLRGAHYYQGGPGGYLQDFDTATIKDSYVIGGGVGYQFNNYFRSDVTLDYMGKSDFRGSTSGFCGSVPGRCVSADLSSLSAYTLMANAYVDLGTYGSITPYVGGGIGGSYVKWDKLRNTSCSVNGLGCDPTTEHGGKGKWRFAYALMAGASIDVTCNLKADIGYRFRHINKGDMFAYENGGGPGRDKGLYSHEVRVGGRYVFNGCDTAQYMPPADIPLQPAVYK

SEQ ID NO: 10911 - protein, 734 aa, Chthoniobacter flavus Ellin428
MVLGWSRGVALTVALGSAALAGGAVRAEQASDLLKDQTQAQGLIEPRAVGEDLPEVTVTATKSREEQVYKVPLAVTVLSQQRASERDGTTIVDLLKGETGVWVQSSGPGQGTPFVRGVTGREVLLLQDGFRISPAFIRSGPNQYLALLDPYAFERLEVARGPVSVLYGSDALGGAVNVVGATPQFTGEATQAKGRVYAGYGTANAERSGRLEVSAGSEGKAFSLGLTYRGFDDFHLGGSPNPQLLFPNADPRLVSGSGYEYYAGQLKFAVNFDPTQRLVLGLEYNEVPRFAAIDSLIQGYGSAVIDASNFFTPQSRLFTTLTYEVKPRESWLTSGQLKLGYQRILDDRLRRSYSTRPSFPSFGSGVADAFYNSERNNSNLFGTQLTLESVAGRHTLTYGGEVYSDVIFSDTVRRFDAGSTAVRPSRYVSGSTFEQWGIFLQDYIRWSDRVSTVLGVRYSSVTARVPADGLRDSPAFTNNSSDFTYNLSNAFFITPEINYVLNVGRGFRAPNISDLSQAGVEGNFFNSPNPNLRPEQVFSIDTGFKFRTGTFTGELFGFWSKYSDRILTVLTGNTVAGLAERRQENAASQIIGGIEFGGQWRVIPELALLGTATWTQGDTTLNTGEVVPADRIPPFNGVVGVRYEPPAGKFYVEPLLRYAGAQNRLAPNNRSDNRINPNGTPGFFVFDVRAGLSVGESLWLRLVAQNLTNNNYREHGSSLDGLGTNIFFNVDYRY

SEQ ID NO: 10912 - protein, 366 aa, Chthoniobacter flavus Ellin428
MEEMMKKVMLAAVLATAGVAAHAQSSVTLYGRLDAGIEYMNGLPSANGGSTSRWRAESGNWGTSLWGLKGSEDIGGGNKIVFQLEGSFDTMNGNGPGAGSIWNRWATIGISNDTYGTLLLGRELAIANGVWDFDPFGQSSWSTASLVRGRNWNKTSNNISYQSPKFYGFDVYGQYALSNATNWNGNGSTSQGRSAGLQLTYTTSLFQIRGLYDEARDPANGKLDDVFNYSREYFAGVNVFLGQFKLQAAYQASHADGGPVVNNGITTTQQVWGGVTWQATPAAALIAAVYHVNANHGGGNANIFTVGGSYNLSKRTLLDVQVATVRNSKTANFGLNANPAGTDISTGNPKFGGSQTGVYAGIQHLF

SEQ ID NO: 10913 - protein, 243 aa, Burkholderia cepacia
MKRKLAITGAAALAFALAGGTAHAQSAGSFYVSTGWFHLSPQDSSDPLFVYGVGGTPVNQSVPNTGAGINDADTLGLATGYFLTDHISTEFVLGVPPKFDITGKGQFANFGVLGRAYQWSPALLLRYHFNDANAKFRPYVGIGATYVWFTGAKITNTAFENGVLGGPTSATTSNQWAPVFNAGFTYNFTKHWFAGLSISYVPVSVTATFTTARRTQVGTLTETSKAHISLNPIVTYLNVGYRF

SEQ ID NO: 10914 - protein, 649 aa, Burkholderia cepacia
MTRTARSLLLLSACTWAGTLYAQESDSYFLGTLRIETEEAQALLGNEVVTEEDLDNRNPQTAKDVFAGESSVTAGGGAPIAQKIYVNGIEESLLSVTIDGARQNKSAFHHTGNVLLDPELLKRVEVSEGIAPADAGPGALAGSIAYETKDARDLLEEGDNFGGMSSITGGTNGTGVRASTTVFGRQGGFEYLLSGTRQKGDDYEDGSGHTVPGTEADLTDYMVKLAYSAEGGGRLAFSASQTEDTGARSAQAGPGGILFIRPDFDSVVGRTSTMVDALSRRRSYTLTYTDETPEGWLNPTLQLAYNEQEIDASGVWGINESLSGTAKNEFDIGNGTLTAGLDFFHETARGLGRGTGLYGSSGKEELTSFGIFAQARQDLSDRVSVSYGARVDTQEFKGADGSKFTDTGASVNAAVDVILTDTLTFNAGVASSWGGYELGEAALVNFGGAWTYNGTTTSRANAARVGLRYASGPWEVSGALFYTEVKDINAVLPTGGDRGAIADVTSQGFDGSVAYSGSQGFVKVNYTYADVESSGSTIASTAYYLGRPVGHIFGLEAGYDISDQWRVGGTAQIALENDDTPTTLPSYEVVNVYGTYTPRQMDNLELRLDVYNLFDKTYASRSSDGVGLANVVPINEPGRTLALTAKIKF

SEQ ID NO: 10915 - protein, 386 aa, Burkholderia cepacia
MKRTTLSLISLASFAAMPVAHAQSSVTLYGVIDTSITYVNHAQGKDNAWMLGNSSAGNLAGSRWGVKGTEDLGGGLKALFQLENGFDPSNGRQGQGGRLFGRQAFVGLTSDRYGTLTFGRQYDPLVDLVQGITADNYLGSVFATPGDVDNYDNSFRVDNAVKYTSAVYSGLQFAAMYSFGGIAGSTGAAQSYSAAVSYNNGPFSVAGGYFHATNSPASNGVRNGWTSSSDGTFDGPINSGYASAHSFGIARIAGQYVAGPFTFGVGYSNAQYRRDASSVFGSNEHYNTGQGFVNYQATNALLVGVGYSYTRSGGDTSATYHQVSAGADYSLSKRTDVYLTAAYQHASGQTGDGNGGSMAAQASIGSYGYAGTSSQTMVNLGLRHRF

SEQ ID NO: 10916 - protein, 751 aa, Burkholderia cepacia
MASIKSRKHPAARRSNCSAAVALAFIALPGAAYAQQADDKAAKRADTLPQITVQGTAAENYKADTVASPKFTQPLVDTPQTISVIKKELLQQQAATTLEEALSNTPGITFQLGEGGNTSTGDTIFMRGFDTAGSIYIDGVRDLGSISRDTFNLEQIEVVKGPSGSDNGRGTSSGYINMVSKAPQLYDITAGSVIVGTDNRQRATVDLNRKLDLGVPGSAFRFNFLAQDYDVPGRNVVNSKRIGIAPSIAFGLGTATRTTLSYLHMEQDNIPDGGVPTFGMPGYSYGTSRLRGPAVKPSNYYGLNGDRNDVNSDMVTAKIEHDIAPGTTIRNTTRVGRSKQDLVVTGIGGVAEPSLGSSPSSYTVSRSRLGRIQTNDIATNQTNLTTEFDTGFIKHTLSAGVEFIYERQKIQSAVGASGLTAANLYAPNSNIVAAMPQHLGAYTDGNTFTTALYAFDTLKLSERWMLNAGIRWEKFKTETESKSHPRGSTVLNTDPDRKLSDTLLSWKLGAVFKPASNGSIYAGWSTSFQPPGGANFSLSTNSNNQASSNLDPQEGSNIEIGTKWDLFDNRVSATAAIYRSQNKKELISDGATPPSYSQLGKRRVDGVELGLVGMITPNLNITTGLAYMDSKIVRGTPANEGGVIVFSPKLTFTSWLTYKLPNGVTIGGGARYVDTAARSSNVTQAPTNLWTMPDYWVGNAMASYDVNKNLSLQLNINNVFNKKYISRINSGGSRYQPGPERNALLTANLKF

SEQ ID NO: 10917 - protein, 383 aa, Burkholderia cepacia
MKKSLLALVALGAFAGAAHAQSSVTLYGIIDEGFLFNNNAGGKHLYGLASGVMQGSRFGLRGTEDLGGGLKAIFTLENGFDVNSGRLGQGGLMFGRQAYVGLSSQYGTVTLGRQYDSVVDFVGPLEAGDQWGGYIAAHPGDLDNFNNAYRVNNAVKFTSQSYGGFTFGGLYSFGGQAGQFSKNQVWSLGAGYNNGPLVLGVGYLNARTPNQFGGMFNNGSASSSVSSPVYGGYANNANTYQVIGAGGAYTFGAATIGATYSNTKFKGFSAGPFVNQTATFNNGEINFKYQLTPALILGAAYDYTQGSKIDGNSAAKYHQGSLGVDYFLSKRTDVYAIGVYQHASGNVLDSNGNVLKATAAINGLAGSSTSNQVAARVGIRHKF

SEQ ID NO: 10918 - protein, 375 aa, Burkholderia cepacia
MKRKTLALSIAAAGLCAGHAHAQSSVQLYGLMDLSFPTYRTHADANGKHVIGMGNEGEPWFSGSRWGLRGAEDIGGGTKIIFRLESEFVVANGQMEDEGQIFDRDAWVGVEDERFGKLTAGFQNTIARDASAIYGDAYGSAKLTTEEGGWTNSNNFKQMIFYAAGPTGTRYNNGVAWKKLFSNGIFASAGYQFSNSTSFATGSAYQAALGYNGGPFAVSGFYNHVNHNGFRNQTFSVGGDYTFDIVRLNAGYFRYNGDQGPLGQRHDDSWTVSMKIAPKGALDYELGYQQMRIKNAANNADGFTPNANLGAFSLTNGVANGFKETIYGSVFYHLSKRTEVYLAGDYMKLHGGYTVSSTFGAKNQLELTSGIRTRF

SEQ ID NO: 10919 - protein, 801 aa, Burkholderia cepacia
MNPRFRLPPVCVLLFFATCQLFAQERYTLSGTISEAGSNETLIGVSILVPELQTGATTNEYGFYSLTLPAGTYDIVVRYLGFADIRQSVDLLADRRLDFSMSEEAEELDEVVVTEQAERLDIREPQMSVATLKTETIKKIPVVLGEADVIKSILLLPGVTNAGESSSGFNVRGGAADQNLILLDEATIFNSSHLFGFFSVFNPDAIKDIKLFKGGIPARYGGRVSSVLEIYQKEGNSKEFQINGGIGAVASRLLAEGPIVKDRAAFLAGGRASYAHLFLPLFDIDNKAYFYDLNTKLNYRLNDRNSLYLSGYFGRDLFSINDLFVNTYGNAVVNFRWNHLFSDKLFANLSLIYSDYYYGLELDFVGFEWNSGIRNFNVKYDLKHYVSDRLQINYGLHNTYYVFNPGKISPNSEESGIVEEQLTKKYANENALYVDVSHDISQRLSLGYGLRVSQFNRLGQDEFYVYEDDNPVFFDPFTLVYRENIPIDTVSADRFETLDKFLNLEPRVSVAYTLNEKSSVKASYMRMAQYLHLLSNTNSPTPLDVWTPSGPYTRPQIADQVGLGYFRNFADGEYSLETEAFYKEVQNRIDYIDGANLIANDAIEQVILNGEARAYGWEFLLRKNTGALTGWIAYTLAKSEQRTPGREQVTFMNRTVDEPGINFGEWYNTPYDKRHDVAVFGSYEIDDRWSLNANFIYQTGQPTNYPVGQFEFEGLVVPYYGLRNQERLPDYHRLDLSATLRPRVNPDKKVRGEWVFSIYNVYNRMNAASINFRQNQDTGRNEAIRTSIFGIVPSVTYNFRF

SEQ ID NO: 10920 - protein, 608 aa, Burkholderia cepacia
MEERSPGSYRLSIRGSLLRSPFGVRNVKIYFDDFPLTDAGGNSYLNALDVAAASNLQILKGPQSSIFGANSGGVVLISPQQSADSSSADLKLQAGAYGTFRQQLSLQQIYRNYQFNITQAYQRSDGYRDHSAMNRKYIQTLQKWDYASNSSLKALLFYSDIHYQTPGGLTAAQYLNNPRASRPAAGNIKSAIEQQAGIYSKTGYAGITHDWRISERVKHLVSVFSTYTDFKNPFILNYEKRKELSLGLRSYLQYEQRTADLNWATQIGLETMQTRSDIDNYDNNLGRPAAVQASDRLKTRTNFAFINVSADWNQWLLELSGSLNLNRYIYESIAPQAIAERSNTFDPQFMPRLALSYMFNPAFSARATASRGYSAPAAAEVRASDNIINTTLQPEYGWNYETGLRFQDPSGRISADLNAFYFHLKDAIVRRLNENDSEFFVNAGGTKQWGLESSVSLSLLQPKHSGWLRALKLNTAITLSRFKFEDYTDRGNNFSGNDLTGVPKQMIVTSGDAQLPAGFYFFLQHNYTSSIPLNDANTVYARRYHLVQAKVGMTSMRIGRFPMEIFMGADNLLDEKYSLGNDLNAAGNRYFNAAAGRNFYGGLSIHFQ

SEQ ID NO: 10921 - protein, 378 aa, Burkholderia cepacia
MKQTTKLAGLVGGAMLAIAGQQAMAQSSVTLWGVADVSLRYLSNSNAQNDGRFFMTNGAITNSRIGLHGSEDLGGGLKAIFNLESGVNLQDGSFSDSKRIFNRAAYVGLTSQYGTLTLGRQKTVLFDLLSDTYDPLTVGNYLENAWLPVALGAGLYADNSVKYRGTFGGLTIGAMYSFGTDSTSSTGAGGFSGQIPGHMGAGNMYGFSLSYIAGPVSVAAGVQQNSDNSNRKQTIYHANVVYAFSKAKIYAGYLHSKDDTGFVDAVLAQQPGLFANGAPKRTGRIDDGPFAGVSWQATPALTLTGAFYYDRMRNATIANGQLDSGNRYTVVGLVEYALSKRTEIYGTVDFNKVNGAATVEMPGRSNQTGVAIGLRNIF

SEQ ID NO: 10922 - protein, 358 aa, Burkholderia cepacia
MKAFARRASRTSVKLIAAAACVAAAAPVHAQSSVSLYGQVDEWVGATKFPGGDRAWNVSGGGMSTSYWGLHGAEDLGNGYKAIFTLESFFRAQNGQFGRFQGDTFFARNAYVGVSSPYGTVTAGRLTTHLFLSTILFNPFYDSYTFSPMVYHVFLGLGTFPTYPSDQGAVGDSGWNNALSYTSPSFGGLNFGAMYALGNTAGDNRSKKWSAQFNYANGPFAATAVYQYVNFNNGPQDLSSLVTGMKSQGIGLVGATYDLKYVKLFGQYMYTKNDQVAGSWHVNTAQGGVSVPLGVGNAMASYAYSRDAGGLDQTRQTWAVGYDYPLSKRTDVYAAYMNDHISGLSNGNTFGAGIRAKF

SEQ ID NO: 10923 - protein, 716 aa, Burkholderia cepacia
MKKLEALIGLITFTGLSFCVCAQEVTNSPARESEVTDRTSIKTSLKPVVVTADPLSGDQADIAQPVSVLQRERMQTRDLRNIGEAVSQELGVSSSDFGPAVGRPVIRGLSGARVRVLEDGIGTMDVSTISADHAVAAEVLFADQVEIFRGSSALLYGSGASGGVVNIVNHRIPERLPDEAGGDLYTHYNSVADDFTGAFRLNAGAGRFAWHLDGMKRHTGDYSIPGYAELKPGSDAKKGVLENSDVRTTNFSSGLSYVGERGFLGVAVSRFVNNYGVPGHDHDHDHDHDHDHDHDHDHDHDHDHDSHNHEQGKGARIRQKQTRFDIKGAVNHPLPGVQKIKTRWGYNNHVHKESEGDEVGTLLMNREWDGRVEMLHQPLAGWKGVLGFQYQNRDLATLGEEAFVPSSRMNSLGVFLLERRDVGRWHFEMSGRFEHQRTKRKDDGFETSHDAFSISGGVIRKFGDGYSVGGDISRTERAPALEELFSNGAHLATGTFERGDTSLTREKSSNFDLFLRKKGGSLDWTLNLFAKLVDDFIFQQELDLTGDGLPDRVNMEGRPDEDGYLLLKYRQNNANFLGMEFETIAHLLSDRRGKLDLRLWTDYVRGRLSSGGYLPRMTPFRFGGALDYAHGPWRGRIDVMRVHKQADIALLETDTAGYTMLNVQLDYRFDWGKMNYNLFIRGANLLNEEARRHTSFLKDRAPLPGRSGLVGVRVNF

SEQ ID NO: 10924 - protein, 1018 aa, Burkholderia cepacia
MSKRLLNYVIVLLVCLISSAESFAQGTKFQVKGNVTDASREPIVGATIKVKGTSQGVITNIDGEYSIDTRSNAILEFSYIGYVSQEVPVSGSKIINVTLQEEVSKLDEVVVVGYGTQKKISVTGSVSNVSTKEIAKIATPSLSNTLGGQIPGIVTRQATGEPGYDQASIYIRGFGTWTNRSPLILVDGIERDMNTINTEEVESISVLKDASATAVYGVRGANGVILITTKRGQLGKPKVTLRSEYAVLTGLRYPEYINAAEYAGLMNEARDNAGVANMAYTDEEIELFRNGSSPYLYPNVNWVDEVLKKNTTQSITNLNITGGTEVVRYFVNVGYTTQSGLYRDNGDNAYSTNSRVNRYNYRSRVDVNLTKDLSVELGVGGIIQNRNFPGKSQYDIFYAIRNTSPLAFPVKNPDGTPGASPTYLGNNPWGMTTQSGYETQNWNTLQGTFSARWDLSSLVTEGLSVSGRFAYDHYYSNNKQYYKDFEVKQYMGEDAEGNAIYNILRNENIKNVTLAESANRAIYYEVAANYDRTFGMHNITGMFLFNRRDYVNLRNTDRTGSVPYRRQGIAGRASYNYLQRYFAEFNFGYNGSEQFPKGKRYGFFPSVSLGYVLTNEDFWNRNWWISNLKLRGSYGTVGNDISSSTRFLYLTTMNMNVSAGYMGKEGNNYMAGIMEGQTGNQNVTWETAKKLNVGFDLGLFNDVVSLQVDIFKEKRDGILITRKTVPVLAGFSGASIPVGNLGKAENKGIETALEVKKRVANGLFYSLRGNFSFARNKIIENDEPKPKYEYQDARGRRIDQTFGLVALGFFKDQDDIKNSPKQTFQSTVRPGDIKYKDINGDGVVDEYDKVAIGDPRTPEIMFGFGGTVAYKNFDVSLFFTGAAKTSFFLEGATVYPFLNGEGTWNVLREVYDNRWTSETAATAKYPIVLNANSYNNYQTSTMYMRNGSYLRLKSAEIGYTFKGRLIDKMFMDNIRLFCNGQNLLTLDYIKIVDPESNNGVGNYPMQRTINFGFQINFK

SEQ ID NO: 10925 - protein, 872 aa, Burkholderia cepacia
MSRVMSNQLQKLAWMIGVALVLVNPPVLAEDSQKPISKISQLDDVEKPATSIKQWLAQSLIQITGVKSQTTGKGIEVTLETNQSDKLQLVNKSEGNSYIVDIPNAQLRLPSGDTFRQEKATAGISEVIVTNLDANTVRVTVTGETGAPQVELFDGDEGLVFGAVPTVTTTQTPQTQPTPVEPQPSTETQPEQPSAQGEPEAPIELLVTGEQNRYRVPNASTGTRTDTLIRDIPQTIQVVPEQVIKDQRVTRLRDALLNIGGVVQDGGFGSTSDQIGIRGFFGDGTFGGSILVDGFKDGRGGIRETANVERIEVLKGPASVLYGGVQPGGVINLVTKQPLRDPYYNAELSVGSFSTFRPSIDISGPLNSDKTLLYRLNSVYETSDGFRDFNQDVQRFFISPTLKWEIGKATNLTLQFDYLNDERPFDRGFLAFGEGIIDTPLERFFGEPDDVRKVEEIGLSYRLEHNFNDNWKIRNAFRYQSSDTFDYRAEPVRLNETTGILTRNFRSNDDYEENYTLQTDVVGKFITGSINHTLLFGVDLARFTSGGTQSRLPGVITPSINVFNPVYNAIPRPGLDELTNVVRNNQDRSTGLGIFLQNQIAFADNLKLLVGGRFDTVDQNSTDLRDGSESGRYDSAFTPRLGIVYQPIEPISLYASYSQSFQPNFGTRVDGSILEAERGTQYEVGVKGEFLDGRLAATLAAYHITKSNIAATDLDNPDFLLPIGEQRNQGIELNVAGEISPGWNVIASYSHIDAEITRDNDGLQGNRPANVPFNTASFWTTYELQQGDLQGLGFGLGLFYVGDRQGDSSNTYIIPGYLRTDAAIYYKRDNWRAGINIQNLFNEKHYLGANFGRVAIEPGAPLTVIGSFSVTF

SEQ ID NO: 10926 - protein, 906 aa, Burkholderia cepacia
MKPTALGSAIRSIAWAEVALTAALGTSAYAQTTPVDGSVAAEQTGSTAAAAPAPASGTAPGGQTVKKLDKFEVTGSLIRTSDKVGHTEVQVITAKEIQQSGYTTVADFLRSTSANSASSWGQTTMNSSAPGGAGIALRGLSEKYTLVLVDGQRVANYAQSVNFTDTFFDVNSIPLNMVERVEIVKTGAVSVYGSDAIAGVVNIITKKNFQGLQIDGQLGKAQHPGDGQGNFSVLAGVGDLNSDRFNITAAASYYRDSGSTLGDRDMTSAQDFTQYPGGLAAPLGPNQQSYWSLADGSKVPLSPCPPGSTTSATNCTYNPAASTSLIPSTTRLNAKVRATFKIDDNTQAYAGFWVSRNETIQLQGPASISSTTNIYNPSTGSVSPLPRTVPVSNPYNPFGVPTAINLTFPGNVVEADTVSTFWMANTGVKGSFDAGRFGAWDWSADYGHSQSTVDTTYHNRINVAGLENMLANGTYNFSNPASTPNGLKGVFTDDDQQAISKVDSVTAKASTSNLFTLPGGAVGLGLGTEFRHESSTINPQTLASQGVAAPANVQTVEGSRNVAAAFYQVDIPILRNLTFTQAGRYDHYSDFGGAFSPSFALRFQPVQMLTTYASYSRGFRAPTLVENSQAVYLAHQNLVDPNDPSGVPTKHFTTEQVEGNPNLQPEHTKNYNIGFQLSPDATTDIGAAFYKVRIDGVIGTDDPNAVLVANDPSRVVRNADGSVRYLVQKFVNLGALDTDGFDLNFRKAVRTKYGTFTLAGDWAYVWHFKLHSPGAAPQDFAGNNLALLQPFGASNPRWKGNTSLSWDYRQLTTTLTWQYTGPYTNAVAAEFGDGGTGSVASYSQFNLMFNYRGFKHWTIYGGITNLFDKKPPFDVEWQAVPDITGYDQSLYTDLGRFFQIGATYRF

SEQ ID NO: 10927 - protein, 462 aa, Burkholderia cepacia
MPSLPLHVIPRRPFTLMGAVQQATAAFMLVLSLQSAALAAGADTPATDIPEPERWNVHGQFTNVTQWHPSFRSPYSGTNSLTPDNNTKETVDVTLYLGLRLWKGAELYANPEIDQGFGLSNTVGLAGFSSGEAYKIGNNAPYRKLPRLFLRQVINLGGEQQAVESAPNQLAGSRSADNVTITVGKFSVADIFDTNTYAHDPRGDFLNWAVIDAGAFDYAADAWGYTHGLAVEWTQSWWSLRGGLFALSMVPNSVTIDTTWKQYQWVGEFEARHDWFGRPGKVKLLAFATRGRMGGYGDAVNLAQQTGNTPDTGLVRRLAWRPGVALNLEQEITSDLGVFARASMNDGSKETFEFTDINQSVSAGFSLKGNRWGRPNDTFGAAVVVNGLSRAARQYFAAGGMGVLIGDGALNYGTERIAELYYNWAAIKHLTLGLNYQYVVHPAYNRDRGPVSIVGARVHAEF

SEQ ID NO: 10928 - protein, 348 aa, Burkholderia cepacia
MTTPRFIRTAAAAATLAACGAAAQAQSALTLYGALDAGVQYLTHADGHRSAVRLQNYGILPSQVGIKGHEDLGGGWRALFKLEQGLNLNDGTATVPGYAFFRGAYVGIAGPVGTVTLGRQFSVLFDKTLFYDPLWYGSYSGQGVLVPMNANFIDHSVKYQSPTFAGFDVEALAATAGVAGNTRAGRVLELGGQYTSNGLSVGAVLHQAHGDVSAADDASARRRELGTLAARYAFATLPLTVYAGVERLTGDLDAARTIVWGGARYLTSNGIGLNAGVYHTDSHTPTIGHPTLFIASTTYALSKRTVAYVNLGYARNSGQSSQTVYEYDPTPLAGASQFGAMVGMYHLF

SEQ ID NO: 10929 - protein, 957 aa, Burkholderia cepacia
MSSTAAWAQSADAQGTAQTPPTTAGNNDAVTQLDTVTVSGYRRSIQFSTDAKRDSVGFADTVFAEDIGKFPDMNIAESLNRIPGVQLARDVNGEGLNIAIRGLGTSFTKTTLNGASIATASIGLNAQNQNREVDLNLFPTEFFTQLTVSKTPTASMLEGGVSGVVDMRSARPFDRPGVHFTYQAQADWNSTSEKTTPRGAFMGSWTNEAGTFGALFGVASVRSKLGVRGFESVGWTNPGLTYTQCGLAPPAGTPATNQPAACNVNGGGNWRIPDTVSATAGSGLTTGETIDAAWLLARNPGLSIDQISDALIPRLGRSVYMSGDRDRDASVMSLEWRPSDNMHFYLDTLYSEAERTTERISMNLIGRNGNMIPLGMQVDQNNVVTSATFANAQYFLEARPYHENVKFWSVNPGAELLFGAEQDIKLNVQANATRSWLARESPSILVTSPFTTVDYRNEGGDRPSITSPLDLNDPNLGWGWTGGRVNIQNEKRQTETRGARADLQFGEDKRNVKIGASYDMAERTIRGFDNSTAWEQVVCRGNGGNVCNGGAGSAIPNSALASYLKPGPDGFITADFSRFLADTNYYALRDAAPESNSANTGASTGGIREKNLGFYIETNAEADVWNRTMRFNAGVRYVTTDQTITGPVTINGVRSVQVLDSDYTETLPSFNVAWDVADKVVVRLSSSRTLTRPDPSAMLPNTNFSDPSAQTATQGNPNLKPYLSTNVDFGGEWYTGGEGYVGLTLFNKRITGFTVNGIRRIPFNDLGLNYDTLLPIQQAGLAQRGGPNAATVDVQTQVNADGVLDIRGTEAIWVQPLDRLFDGLGFSLNYTHVNQQSEGEGVPAVAVGVAPNLWNGTVYWEKDAASIRLSYTWNDDMVISGANQNGIPYARLNADARGQLDMSASYALDWLPSKPQITLNVTNITNEPLRTTFAWPNATYDLYEPGRTVMLGIRGTF

SEQ ID NO: 10930 - protein, 383 aa, Burkholderia cepacia
MKKTLIVTALSGVFVTAAHAQSSVTLYGLIDAGITYTNNQGGHSSWSERSGQINGSRWGLRGTEDLGGGLKAIFVLENGFNIANGTLGQNGREFGRQAFVGLSQDQFGSVTLGRQYDSVVDYIGPLSLTGTQFGGTQFAHPFDNDNLNNSFRINNSVKYTSVNFGGLKFGALYGFSNSNQFSNNRAYSAGVSYTYAGFNIGAGYLQLNNDISGLTAAAVTNSAGAVAGDNTFVGKRQRVFGGGLNYTFGPATAGFVFTQTRVNRALGISAGASGVSSGLGLDGTFARFNNYEVNARYALTPALSLAGSYTYTAGFLDGRHPGWNQFNLQTDYALSKRTDVYVQGVYQRVSTDGLGIGAYVNGLGGASSTNKQIAVTAGLRHRF

SEQ ID NO: 10931 - protein, 362 aa, Burkholderia cepacia
MKTFRTAATAVSFAAAAASPGAHAQSSVTLYGIVDTGIQYYNNAAGGGAVAGMPSLTGEVPSRFGLRGVEDLGGGYRAFFVLENGFAPNSGTLNYGGRLFGRQANVGIESPYGALTLGRQMNMSMRVLLNADVIGPSIHSMASFDSYLPNARSDNALGYLGRFGGVTLGGTYSTGRDDAGPAGPSATHCAGNVAGDPVACRQYTMMVAYDAPQFGAAASYDVMHGGAGASAPLSSPGYTDTRTIVDAYVKFGIAKLGAGWIRRNTAAAAHSQSDIFFAGGTVQATPALSFDAQALRYLLRGRFDSNLFVARANYSLSKRTMVYTSVAYMTNSALGTSAVAAGGTVGAGQNQVGVMAGIQQRF

SEQ ID NO: 10932 - protein, 784 aa, Burkholderia cepacia
MTVAFQLARASTIALAIATTAPSFAQATPSQAAVPAAAEDNSVAGVEEIVVTAERRAENLQRTPIAITALTANSLQSSGITDLRGVVQAAPSLYFAPYPSSTTTLVLFMRGQGIGDPNIITKDGGVGLYVDGIYQSRPQASAFDLADVERVEVLRGPQGTLYGRNTTGGAVNIISKKPTGELGAHGLLSLGNYDYRRALVNLDLPQFGTFKVKLTGLYSNRDGWANNAANTAGTPDAHDFQSDRKYAVRGAVRWEPTDGITVDYSGDYSDQRTTPVRYVTENAFAPFLFPGYTADPETAYRPVYLPYSHVKSDGHTLIGEWRASDALTLRSLSSYRHIKVRTYQDYTEAFLAPFFAFDQVGSKTYTQEFQAVGTIADQFKYVVGIYYFREKANHFETVDVGTGTPGQQVLVDRDTNAKSTSKAIFGQLTWTPEFADGKFDVTVGGRYTRDKRTADRIRTSNFFIGQTSPLVARRFNGPGATIPLGSVVGATDVKNSKFNPALTLSYRPVENVSLYAKVVTGYKAGGSNEASPTFTRTFGPETVTSYEAGIKSDLLDRRLRVNLAGFIAKYKDLQLDISADPADASLADTFNVGRATVKGLEADLTAVPIPGLTLSASYAYTTSKIRNVLAPAGSIFDPAVNPGSPVQVGDNITGYFVLPFTPKNSVRLSGDWVIGTFGSGDLAAHVDYTWKDKVYTTAGDGPSVPLGRDAPINKAYGLVDARLSYTIDRGGGRNISIGLWGKNVLDKRYPGFVIGSGSIIAGYPNQAISYGDPATYGIDVGFSF

SEQ ID NO: 10933 - protein, 447 aa, Burkholderia cepacia
MKIKVPLYLAAVSALSGSYAISAQAEDKPEGFIEGSSLTVLNRNFYFNRDNRDSTAPTYNSGKGNTNGYSEAWAHAIISKFNSGFTQGTVGFGVDAFAMIGLKLDTGDGRNGGRSSFDVLPVDNKGEARDEYTKVGGAAKVRLFDTIVKVGDVFPSTPVVASGDSRLLPESFRGVTVENTSIQGLTLQGGRLHAMSQPVSSNLNDNFVTFYGGPVNSPWIGYGGGDYSINDNWTVSVYASQLKDVWNQYYAGTSVVYPLSDDLALIGGFNYYKAVDEGKKRLGEFDNNIWSAKVGVRYGAHTLALSHQRNNGDDDFDYLRQSDSIFVDNSIQYSDFNSPKERSWMLRYDLNFTSYGIPGLTFMTRYARGSGADYSNANQFYMRTDDNGNPLDNQKRWERDVEVKYVVQTGPAKDLSFRLRQATTRATAFESDLDETRVIIEYPLSIL

SEQ ID NO: 10934 - protein, 160 aa, Burkholderia cepacia
MMKKTLLAVALLSASSAAMADSWIYGGASVGQSDYKGETDTSYSVHVGTGILPIIGIEAGVTQHGEFNIAGKDTKLTSYYAALKPSIDFGPLHVYAKGGIHQWDKKVKNGSDDDDYDLMYGVGAEYFLFGPMSVGASYMNYTTGKDDIGTFSLNATLHFL

SEQ ID NO: 10935 - protein, 1988 aa, Burkholderia cepacia
MNSMQKKKLISIAIALTLQSYYIPAIAAENNDDEKECPSNIASLPKEKRAKLSPTCLATLPENDNHWGWIAGGVAALVAGVAIGVENNGGGDSTHSYIPPTPDDGGNVTPPDDGGNVTPPDDGSDDNVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDDDTPPDDSVITFSNGVTIDKGKDTLAFDSFKLDSGSVLEGAVWNYSEQNNQWQLTTLDGKTLNVTGWDVTDANAAVIEGTQENGLYWKYDSRGYLILADDKTTVISGDDQAHTSDRGMDISGQDRTGVIISGDRTVNTLTGGSSVTDGAIGMVITGDGTTNTISGHSTMDNATGALISGNGTTTNFAGDIAVSGGGTAIIIDGDNATIKNTGTSTINGTGSTGTVIDGNNARVNNDGDMTITDGGTGAHITGDNAVIDNAGDTTVSGTGSTALYIDGDNALIINEGNQTISGGAIGTRIDGNDARIANTGDIAVDGAGSAAAIINGDNSSLTQAGDLLVTGGAMGIITYGTGNEAKNTGNATVRDADSVGFVVAGEQNTFKNKGNINISLNGTGALVSGNASQATLDGDINVTATEDGDNVYRGATGLDMTGNNNTLNIIGSVTVNGDYDKDSVMAGSSDTLMGMSISGSNNAVDLSGTLNINVSDMSNVNEQYLNTVGLDVAGDGNTVDLAGGININYTEDADGLESAVTGINISGDSSVTLSGESTLNIATVPGGAVTLANVRNGGNLTLDQNSTVNINETVILSNYYMTQALLTASGEGSSINNQGTVVDDGAVALLLADSGAQAQNSGKITAYATTGTSSRNAIAAANGQGSTVNNEAEGTITLVSSLTPFSNTGAGNFPLIWYKNTLYAMLAEDYGEVSNDAGATIYLQGAGVYGVSASKGTALNAGDIYLDGFVPTLDDENNITDKTYWTPPKLYVTSAAMVAGTTDSGYGDATATNTGTINVNNAGFGMMALNGGTAINQGVINLTADAGVEGTDPNQLVGMAALNGGTVVNDTTGKINIYADYGKPFLTDGNSLIVNYGTVCFGDDCQDSDEYNPTNSDVSIPYTDGATLADTGTSTTLDNKAVVTGDVNNAGVVGGESITVLDSGTLTNNDSGVINSNTTVSGNLVNDGVINGTLTQNGGDIVNNGTIDSRSLTTNGVLTNGTDGTMTSGAKVTGANSAIINDGTFYLGSATDAKNASMLEINDFAQFFNTGTLILDNNKNAIHLNANNGTLYNTGTMELTATSNKGAINYWGAGAAFINDGTVNATTAALAYAGGGAGSAPEKHAFFWNQSNGVINYDADNGRAVDFSAYNNYVAVNDGTMNISGNNAYGMYGGKNAQLVNNNTINLGTEGTTDTGMVAMALDKNATADAVIENNGTINIYANNSYAFSVAGAGHVVNNGTVVIADGVTGSGIIKQGDSVNVEGTNGNNGNSDEAHYADYTLPGTPVEPGSNTTSGSAAGDTSGASNDLNGYVVGTSADGSAGKLKVSNASMEGVGINTGFTAGTADTTVSFDNVVEGSNLTDASAIQSTSVVWNAQGSQDSDGNVDVTMTKNAYADVATDGSVSDVAQALDAGYTNNELYTSLNVGTTAELNSALKQVSGSQATTVFREARVLSNRFNMLADAAPQIKDGLAFNVVAKGDPRAELGNDTQYDMLALRQKLDLTANQNLTLEYGIARLDGDGSQKAGDNGLTGGYSQFFGLKHSMAFDEGLAWNNSLRYDVHNLDSSRSVAYGDVNKIADSDARQQYMEFRSEGAKTFSLMDDALKVTPYAGVKFRHTMEDGYKERNAGDFNLSMNSGSETAVDSIVGMKLDYAGKDGWSATATLEGGPNLSYSKSQRTASLQGAAGQSFGVDDGQKGGGINGLATIGVKYSSNDTALHLDAYQWKEDGISDKGFMLNVKKTFR

SEQ ID NO: 10936 - protein, 726 aa, Burkholderia cepacia
MSTLSLPARRLTPIAFGIALTCALATSAQAQQAASATAVAPDTSVLPSINVTGAAEPLPGDLAPTYAGGQVARGADYGVLGRQKASDVPFSMTTYTSKLIEDQQARTLADVLDNDPAVRSATGYGNFSQVFVIRGFQLAGDDVSLNGLYGITPRQLVQTDAVERVDVLKGANAFLSGASPNGSAVGGGVNLQLKRADDKPLTRVTVDGSVSGSIGTHVDVGRRFGSEGQFGVRVNQSISGGDTAVSDERHRNNVTAVSLDWRGDKLRLYGDFLYQRERIDNGRPVVLVSGNQVPAVPSATHNYAQPWSFSELEDTVGIVRAEYDFLPAWTAYVSAGARHTNEHGDYYTPTYSSSGTTGSRLSVPHKEDAQSAEAGVRGRFTTGPVSHFVTAGASFIRIDSQSAYTMSSAFPTTLYDPAPVAFPPTAYAGGDMSDPGTVTKTWLRSVAVSDTLGFLGDRVLFTIGARRQSISVDNFDYTGAVSSTYSDAITTPVFGLVVKPWQNVSIYANRSEALAQGEIAPNTARNAGQSLSPFRSKQVEAGIRYDTSKYGASLALFQIEKPMAYTDPTSNLFGANGTQRHRGVETAVYGEPWKGVRLIAGATYINATLQNTAGGANDGNRPIGVPSFLLNAGAEYDVPMLRGLTLTARWIHTGPQYVDVANTASIQAWDRYDLGARYATALFGRKTTFRATVRNVTNKSYWSSTTGGYLTQGDPRSVWLSMTTDF

SEQ ID NO: 10937 - protein, 1745 aa, Burkholderia cepacia
MNHSFRSIWSEAAGCWVAVAETARARGKRSGSTSGTNRRASRDAIRLAPLRAAMAGAAFAALSAGAAHASTCGNGSAVASGGSCTVGSFSPTVNDNLAGATTVTGGDTVAATGAWTSQNGGDAGYTRVPLGTTTIVTGNPDQPLVSLGGKTQSVSTPDSITGTHASVATYNSSAFAGSTLGATYVPLYHDVDGNQYLNTRIGTVERSGGTLNVSLGNAANAPDAAGNAITIAAKQTDLAFADGTGTASSVVNWNSRNQVLFTTGDYVEAGGAVGNLQLDVPAYAGTFTAFDGSRWRVDDAASLAAYNDFLVRSVRSGALGSQAAYDSAFSQAVTFSRQTFQYANDVSAGDKNTLPIDHLAALHGTGANATLHIGRDGQIDFRGTSAIESSSAALAENGAQFVNDGSLSGDFTLVRLLTGASGVNNGVISSGYAAGENFDTAGAAPPENFGFHAYTEGNGVYANGAGTTFVNNGVMNVAAWTLDGNRPTLLSYAIAATDGATASNAGTLNVGVNATTLDSQVIGGLADGGAFTNEAGGTIYVGRAAQYRPGAAAADVALSAHGYGILLGASGTAANLGSIVIGSQTQNGAAMASIGSSSGTLRNAGTIVVNGAAPGTPLANVGMLAADTAATVTNTGTITLNGVNGIGIMVVGTGSTATAATSTGTIDVAGGLDAASDTRNYGVWAEGPRAKATLDGALDLTGNGAIGAHARAGAAIDVGANAVPRFTSGTNQIGFYVYGAGSTINVAAQRLSVDTDDSTLFRIAAGAAYTGASAAGTLTTDVNGERARGVLATGAGTTLSTGSATYNVRGANGIAVAVEGGAHGTIDAGATINLNAAGATAGVVDGQAHDLAGANAGAPVATVLGNDAAVMSSSAGVTGFVARNLGTLENRNAVLLTGVGSTGVAIGALGTVDNMSTIRVSDGTGALVQGASAVLNNAGTIGADDGVAGVHLTGAGASVVLSGAGTIVANGSAHGVLIDSSVANGALAAGATSIAVGGGGAGIDNLGTNTTIVLSGTQIGTTGNGADGISSTGAGTRIATDAASVVRTAGENARGIVVAGADATLAADGTTVSTTGAGAHGLVVGGGATALLSGAKIAAAGAAADGVVAQNGGRIGDTGSTLTSAAGNGATVDGGGVLALTGTTLHGATAGLLSVDSRASGATSSVLVDGGSVASVAGPAFAARGGAVDIAVRNGTIVTAGNGTLLDLANGSVARFDASAVTLAGDIVSDASSTGTVSLTNGTTLTGKIDPVALNVDATSAWRITGSSVLSSLNNAGLVAFAAPSGAPTAAGSYKTLTTGGYVGNGGTIALNTYLGADASPTDRLIVNGGAASGTTALKIANTAGSGAQTTGDGIPVVVTANGGTTAASAFHLAGPVQAGAYEYRLYRGGQLDANGWYLRSQLDPSNQVIAVGPLTAGGGAGTLAYRPGVAGFAMTPLLNADYGFSTLGKLHERVGDVYNVDKQAPGNRDGVWGRIGGQSFDANAGRFAADERTLFAQFGKDWTLDQAPGGGSTHAGVTASIGVSNASFSDPARADAPGLSTSTGSVEMHAQSAGGYWTRYLTDGTYFDSVGQVTHYGNRYRDSYGNDASQNGFGIALSQEAGKPFGIGATPIAIEPQAQLMYQYLKLNGFNDSVSAVSGTTSHALRGRLGVRMFRPNLGASALGAATPYFTADVLHDFLSPGQTVVGGTPFATHLGRTWYELGLGVTAAFGKSGTLYANVKYARNIGGDYRRGVTGQAGYRYSW

SEQ ID NO: 10938 - protein, 688 aa, Burkholderia cepacia
MLKLTIPALAVGAMTAAAAATEAARAADAPTDDAAVLLPPVEVVASPLTIPLVIVTDPKTPRQPLPASDGADYLKTIPGFTSIRSGGTNGDPVLRGMFGSRLNILANGMPTLGACPNRMDAPTSYIAPESYDKVTVVKGPQTVLYGPGASAGTVLFERVTPRFERPGMRFDGSVVGGSIGRNDQNVDVTAGTPDVYGRVSANHAHAQDYQDGNGNTVPSQWDKWNADAALGWTPDDHTRVELTAGTGDGYARYAGRGMDGAHFRRETFGLSFDKRHLGDLLDRIEARVYYNEADHVMDNYTLRQPDPTSSMPMRMASEVRRRTLGARAAATFRFGDDFKLVTGVDAQSNRLDARSAMGRQNYGDQPWDAQATMWNAGAFGELTWYASDASRVIGGARVDYASARDKRATTSGMMATKPNPTFDDDRARVLPSGFVRYERDLASLPVTWYAGVGHAERYPDYWELFSAKRGPAGSVNAFSAVQPEKTTQLDIGAQYKGERVDAWVSAYAGYVRDYILFNYAAGMMGPTTQATNVNAQIMGGEAGVSWRPVAPLRVETSVAYAWGRNATSGDPLPQMPPLEARVGLEYTRGAWSAGGLWRIVAPQHRYALNEGNVVGKDFGPSAGFGVLSLHAQYNVSKKVQISVGVDNLLDKAYAEHLNLAGNAGFGYPANAPVMEPGRTAWVRVSAKL

SEQ ID NO: 10939 - protein, 369 aa, Burkholderia cepacia
MKNHKSLAILIPMLFAGSTAVNAIEIFNKNGNKLELYGSINPNHNFSNEFLSTKISSKEDNTNAILGLSGKIKITDKLSSYAQIEYKNNFFMPEDLMNKQQPNTVRLGYAGLKYGNLGSIDYGRNYGVIHDAQSLTDHVPYINKKSIFAYNDNYMVGRNHSLLTYRNNNVFGLVDGISFALQYQDEIKNRDLNKGKSSSGWGASLKYESDSGLTAVGSCFTSERMISSNKKDLKNTSVDSYGLGFKYDANNVYVAAFYGSARNLMPYNMHISDSFINETQNIEAIAEYSFDSGFHPSLSYLDSKGQNSNSPKKELDLAKQINISTRYEFNKNVSTYMNYKINLLKENDFISQNQIPTDNTIGAGVVYQF

SEQ ID NO: 10940 - protein, 387 aa, Burkholderia cepacia
MKKLALSTLSLALLGAAGAAHAQSSVTLYGVIDTSITYIHGNAGQGNNSWSMGSGNLQGARWGLKGTEDLGGGLKAIFQVENGFNSTNGALGQGQRMFGRQAFVGLQSDQYGTLTLGRQYDPLVDLVQAVTADNYFGSVFATPGDVDNNDNSLRVSNAIKYTSPVWGGLQFEGMYALGGVAGATGKGQTWAAAAAYNNGPLGVAAGYFHASNASALNAAGQRTGWAGTSDSIFDGDSGTTFINNAFTSAASIGIAQVAAQYAFGPVTVGAGYSNAQYKADANSTFGTNQKYNTGRGFVTYQASAPLLLGLGYIYTKGSGNNNGKYHQVSLGADYSLSKRTDVYLVGAYQHASGKNADGTDAQAAIGSYGVAGTSSQEIVALGLRHKF

SEQ ID NO: 10941 - protein, 809 aa, Burkholderia cepacia
MAVASRKEAVRGQGAESEASAGGSTRTVRALPVCRERRERTVAAINLTPFINLSYPASGSYCGDNMVTKSDNGCLVSVLAGALCMGLPGLAAAQSQEDGVVVLDAVVVDGQSGVADTAASAGTATASPVVSSASGGAAYVQAEATSATKGAASRLETPQVVSVVSQAQLEDQGVRTIDEATRYASGIRSQQFGANNRVDWFTIRGFPAEQDGLFLDGLSLFSTAFASWRIDPAALDRVEILKGPASVLYGGTSPGGLVNLVSKNPVTEPLFSLTAGIDEDGQAYSMIDMGGRLTEDASLSYRWNSVILGGDTYADIGEEFRGVVAPSLTWAPDADTTLTVRGYYQSEDSNNLPGFLPYDGTVRPRTFGRIDPKLFTSDPSVDEYSREQAMIGYEFEHRFDETFTVRQNLRYAHTRSTYDYVYPFGYASDLSFLNGLSGGTSDELARLHFRTTPEADSFNVDTQMEARFATGAFDHTLLAGLDYRDYRIDDVQGTSTLYSRLNINDPVYGINIGPIDNIYIDNTQTLRQTGFYAQDQIRFDRLVVTLNGRADIIDTALDNNLGADAEASDTYFSGRAGAAYVFDSGIAPFISYSRFVTPVLGVDPDTQRPFEQGEGEQYEVGLKYQPAGFDSFVTASLFDLTRSNVLVNDVAGGRAFTQIQVGEIRSRGVELEGTLALTDGLTAVAAYTAYDLEVTETSDINQGLTPVAVPEQFASLWLDYKVQSGWLKGLGVGGGVRWTGKSYADLANTLEVPDFTVFDAAISYERGNWRGQVNVANLADKRYVASCNGETSCFYGDPRKVTASLTYTW

SEQ ID NO: 10942 - protein, 255 aa, Burkholderia cepacia
MNTARLNQGTPLLLNAVSKHYAENIVLNQLDLHIPAGQFVAVVGRSGGGKSTLLRLLAGLETPTAGDVLAGTTPLAEIQEDTRMMFQDARLLPWKSVIDNVGLGLKGQWRDAARRALAAVGLENRAGEWPAALSGGQKQRVALARALIHRPGLLLLDEPLGALDALTRLEMQDLIVSLWQEHGFTVLLVTHDVSEAVAMADRVLLIEEGKIGLDLTVDIPRPRRLGSVRLAELEAEVLQRVMQRGESETRLRKQG

SEQ ID NO: 10943 - protein, 363 aa, Burkholderia cepacia
MTKKTFLALAACTLPAAAFAQSSVTMFGLMDTGISYVSNQGGHGAAKFDDNIFFPNLLGFEGKEDLGAGTRAIFRLVNQYSLGNGSIIGGGLFARTAYVGLQNDRYGTLTLGNQYEFMVDALAASGNEIAQDLVGLYGFRNGPFDRLGLPNNPTGAFDWDRVAGSNRVANSVKYTSPSLSGLTFGALYGFGNVAGSIGANNTVSVGASYDHGPFGAGAAYTNQKYGAADGLPPTSVRNWGAGVHYTVGTVTGKALVTTVHNARNGAGAWSAEAGAAWRPSPVWVIGASYTYMKGNDTLDDAHAHQLLAAVQYWLSKRTMVYVAGVHQRASHGSNAQINGVMDANGASSGALQSIARVGFSTRF

SEQ ID NO: 10944 - protein, 941 aa, Burkholderia cepacia
MMRFKPSLLTLALVAAGASMHSYAADDVKEKDLKAKDAEIEVIQVKGFRTSVIKSLNEKRFGDTVSESISADDLGALPDQSIADALTRLPGVTAVRTGGQASGLNIRGLDGDFVFATLNGHEQVTTGGKRAIEFDQYPSELISQAAVYKTPKASLIEGGVAGTVELKTADPLKNDKDQSFNINARGSFNDRADEISDAEQYGNRLSLAYQGKFLEDTLGVAVGYAHLYQPYVASQFIGLRFNDDKKDVNGDGVTEAISEGFELQQKGGDDTRDGYMAAIHWQPSDSLSVKGDLFHSKFTSENFARGFRVKSLKNGTISDAVVENGSMTGGTVSVGTDSTDDFSIFVINDNDSKYSELTSGSINLEWNNGGALTVAADVSYSKADGEFVNGGTRAILYDDIGNEVRSAESVTYQLNGLSPADVSFTNDYTNTSTLGLKEVGMWPYNQQNDLIAYKLDFNYVLDTSFVSSVDFGVRYAEREFNAQRSQAGYGFEYDKNPSNQPVLALNGDMAKVVDFGGELSGYPSFLAIDFNKALELVNAQLAATGQSPFTPTANWSNNWTMIQSGAVNEDVLAGYVQANLDFDIGDVKVTGNLGVRVVHTDQSSTGLQQVGYGLGEAITDEQGVVSTDYIRNEVGQTYTDYLPSLNLTFHLTENDQLRFAAASVMSRPPINKLKSGMGSWYDNASTEGYKKYNAWGNTSPLLDPFYADQYDLSYEHYFEESEGAVVIALFYKDIKSFINDFTIQNYDFEANGFIVPDTIIDNGVEFPVVKNEGQYQTAINNDNGGYIRGIELGYTQVFDFLPSPLDGLGFTGSYSYSDSEVEFTTDLSGSNLTIPLPGLSENVLNTTLFYTLDGFDTRVSMRYRSGYVSEQVAVESQLAFFDAETIVDYQASYALDNGLKFLFQINNLTDEPSKTYFGEEHQTGTIQYFGRQYFLGLTYSL

SEQ ID NO: 10945 - protein, 390 aa, Burkholderia cepacia
MKRIRTFALLALPASLHAAGAHAQSSVTLYGIADAGIAYVHNVRNANGSNASNLVRFSSGNLSGSRWGLRGIEDLGGGLSALFQLENGFNLGTGALGQGGREFGRKAVVGLASNTYGTVTLGRQYDPVVDLVQGLTEDNYFGGVFATPGDLDNYDNSLRVSNSVKYTSPLISGFQFAALYGFGGVAGATGSGRTYSFGLSYANGPLSLGAGYFFANGGSTVASGVRTWSSSSDTLFNTVINQGFSSAKSIQIVRVAGQYVAGPATFGLAYSNTQYGADTLSAFTQNAKFNNGSAFFNWQFSPALRAGVGYNYTSLTGPTAAHYNQVNLGADYALSKRTDLYALFGYQKASGNTLNASGAIVKAAASVGSYGVNSGTDTQELAIVGIRHKF

SEQ ID NO: 10946 - protein, 689 aa, Burkholderia cepacia
MPAPTAGAARPAFAGAQDTRERLLADTQSSATKTSTPVLETPQSVSTVTRRQIDAQNPQTVGNALRYTGGVLSEVDATTRYDSVFIRGFGGFGTSTNFVSFLDGLKLPRGQAFAVTSIDAFLLDRIEVLKGPSAVLYGQISPGGLVNLASRQPSDSSYNEARIEGGSYGRVQSGITSQGALDAAHQWLYSISAIGRMSDTRYDGVQEQRYGVAPAITWRPDTDTQLTVSGFYQRDPKGGYFNSLYPQSLAPAAYRPYLNRNLNIGDPGFDRFEREQSAIGYVFDRRLNDVVSVHSALRYAKVDTDFQSLQMAAGLTAAGTIPRAAIRSIESVDGVTADNRLRFDFRTASVEHSVIAGWDQQNSHSSWIYQFGAATSLDVVNPAYYQPVGTLFPFINNDQSLSQTGLYVQDQMKLGGFRLTLGTRHDWTAQTTDNRISATRQSQDSDKQTYRAGLLYLFDNGLAPYVSYSTSFEPVIGVGSNGLPFVPTTGEQYEGGLKYKPAFADMLFTAAAFDLRQQNTLTPSSVSGFSVQQGEIRSRGLEFEARGKVNANIEIIAAATVLDTRITRSTDLTAIGKRPQAVPTHFESLWANYSFLTGGLAGLTVGGGVRSVGPSFGDDVNSLVSPGYVVFDAALRYDLVNLTRGWKGAELTLNVTNLFDKSYYTSCSSNFYCQYGNGRLVLAGLRYRW

SEQ ID NO: 10947 - protein, 354 aa, Burkholderia cepacia
MKRKALALATLGCVASGGAAAQSSVTLYGLVDSGIEYVSHAGPTGSSVVKMTSGGKNTSRWGLRGTEDLGGGLKAIFTLESGIALDTGKLDTDNTLFDRRAWVGLQDKTLGSIRMGRDFTTTYDFMLPFDPMGYAPNYSWATSATATGGRKDGMFSRSTNVLRYDGKFGPVKVGGTMAMGEVPGSFKSSSKYDLGVGYEAGKFAAALTWDRQNGAGTSTTPADSVDYIQGIHAGASYDFGSLSVYAGYRNYRKTFTTSAAKQLSDMYWLGAAYDFTPAFTLYGAIYKQNIKGDTDADPILFSLRAQYNLSKRTMAYLSAGYAKARNGQNVSVSRDNIGYANNQVGVTAGLQHRF

SEQ ID NO: 10948 - protein, 379 aa, Burkholderia cepacia
MKHTKALLAAGACVLAATGAHAQSSVALYGIVDTGVEFVTHANAAGDHVVRMPAVTGEMPSRWGIRGNEDLGGGYQAVFVLESGFNVRGGDLGQGGRLFGRQAFVGLKGGFGTLAFGRQYTMTYLALQGADIIGPDIYGLGSLDAYVPNGRADNAVTYIGTYRGVTLGAAYSFGRDGAGTGNSPGQGTCAGQVPGHAVECRNWSAMLKYDSAYFGAAASYEEQRGGTGAAANFFDGVAPVAFTSSAGKDARVHLSAYAQAGGARVGAGWIGRRVSTGSPAAAGAHSDLFFVGASYTVKPYLIVDGEGYRIVNSAHDTRATMATLRTTYLLTKRTSVYAQTSYLWNSAHARYAVSGGGPGTTPGEGMGQLGAMVGVKHLF

SEQ ID NO: 10949 - protein, 274 aa, Burkholderia cepacia
MKKLIVAGVVAGVSTLASAQQAGDNVATLGWLHIMPQDSTNGLTTNLANMPINGPLRLPGSFTSPGTSLTVNNADTVGLTLTHFFTDHIAVTSVLGIPPEFSLTGHGVIRPPGPAGALGNVDMDKSSNQPAVKNARQWSPTVILQYYFNSPTARFRPFVGIGVAYSWFSNIELNGNFAKDINENLGSVLAAGAGKPGPTSVEGKASSSFTPVYNVGASYAISKHWGLTATLTYMPLKTYSSLVIKAADGSTLATTRTRLKADPLITFVGISYKF

SEQ ID NO: 10950 - protein, 775 aa, Burkholderia cepacia
MIRRLTFCLPLLGAFAPAALAQVVPSASIVRVPRVNVIAATPLPGSAISRDRLPQATHVLGPAEIDRTGIPSLTGAILAAVPSASINDVDGNSFQPDINFHGFTASPVTGTAEGVAVYLDGMRFNDPFGDTVNWDLIPPEAIRSASLQPANPAFGLNALGGALDVTLKNGFTAPGGVVTLSGGSYGRMAGSLEYGVHHGGTAAYLAADVIHDSGFRQTQTSRLARIYADLGWRNARTELHLGVIAADNALGNPGATPVQALNYDIASIFSGPNTVYNKYIATRATARYALNGDTALDALAYFADLSQRLPNGVTEELAACPGQPGILCNAGTSDVVTTRGGAAVPDFLNGGIYSGLVNEGIDQQAYGASVQLINDSRLLRHPNHLTIGASFDGSNTMFNAFTQIGGITPVTHLFIGPGVTVDQPADGVNPVQVATTTRYFGLFFNDVFTLAPRLDLTLAGRFNNAEIDLADKLGGPVSGHHAYDRFNPQIGLTWHALKTLDLYGSVDETNRNPTPTELSCASAANPCSLLNFFVGDPNLKQVVARTFELGARFHLARFAGGTLRWNVDLFRTDVHDDIIYQSTLYNPNLQYYTNSGNTRRQGIEANLVYATPRLNLRLGFAHIDATFQNALTLNSPSNPAADANGEIHVVPGDRIPGIPANRGTIDLSYQLTERLLLGTTAILQSSQYRFGDEANLTKPVGGYAVFNVYASYKLTPRVTVFAMVDNVTNRSYQTYGGFGPVSDVPWNFVPGGVTDPRTANPGRPIAGYGGVRMTF

SEQ ID NO: 10951 - protein, 1104 aa, Burkholderia cepacia
MIKAFPKKIFKTEKKSLAKLIITSILFSPSYVYGISKKYNPEFYLNWGFNSISSKNAYDLGYTGENISVGLVDADFPSGISDLNNKLIYVNDKNNIYSHTDAFMINDQIPSNFHISDYAFGVKHAVIISGLQNGKGIIGIASKSKIYAQDDRNSLYGLIDNYPVRVINHNGTLEKDQDYDVSKKNVQLISINNIDNSHSSIDSLNYKEKTNKATPLLFLTSTKIAPGLTIKNFVDVENDSISLINGKKIPINMRDAQLGIMGQLHSIKSSSKKNILNVFPVGDFNHYNQPGILAGLPIVYPELIKNTLAVSNITPVRSQGLNITNPDNIFITSSGDKYQHISYLDKPYLREVDLAVGEIDYLWELKNNQLIRTNVILNDEFTKKTLHTTSSQCGYAALWCVSAPGTEIYSSTLRTSKIDDQMNLLHEDYGYSTGSSLSAAHTSGAAAVLMQRFPYMDSADISLVLKTTATDLDEHGVVANNPKIIDRYFGWGEINLANAIKGPSMFASANDVEVMLADDLKTELGDDLKLLTESFGSGMFIANIQQGAIYDKGTPRERSCNTTECLYDKWENDISGSGGLIKRGTGTLELAGKNNSYTGTTEIEAGQLIISGSTRSDINVYNTGILSGSGSASNIHIYQGGTFAPTQYGQLSTFTIDGDITFDRNSTFSAQLAPTTNQIDQLAVTGKVYIDNAAINLYSQESSQSLTASDMQTYQGKYYTFITAEQGIEGEFSNDTINVLKTDNVTPEIFKSKDTNAYHLIFDNKNKSESTLTDLDNKMTLHHTTFKPYAKAIQQKAKKASEIHSSIIAEQFNNHRRVRDQITEHLNEREPQTDGIHTWASILHNSSYAENYTHRHHGLIIGSNKTINNWSIGMIGAYIDGNLRDQNHNSAHQSSHHIGGYTEYSKDNWAFVNGATYSFDQYKTLVADTYDGQFNADYHSHSTQIFTTLSKQFNWNTIQIEPTGSLSYTSIWSPAIKQSNGFYQLESAKTRNHILSSSLGSKIAKTWKFDDKLAIKTYVGAAWLHTYGDAQNGGSFQYNTNNPLINNQVDGAKSVIPMIKNGTQLNVGASIPLMENAEMSVNYSGVLSKKYQEHGGTLNIGWHF

SEQ ID NO: 10952 - protein, 395 aa, Burkholderia cepacia
MKAPVNRYAILILSAASLGTTAAHAQSSVTLYGVVDDSLAYVNNQQGHSNLYMRDGNLYASKFGLRGDEDLGGGTHAIFDLQSGFNLNNGAQSAAGLIFNRQAFVGLRNDHYGTMTAGRQYTPYFLFVGPYASSSWLTGATGAHPGDIDGLDTTTRVNNSVTYTSPTFAGLTASAMYAFGGIAGATGKGNTFSAALRYANGPIGVAAGYLRINSSGSSAGFLNPATAASGSFAVSVLNQGYLTAKAVEQVAAAGNYTLGDLTVGLNYSNVKYLPGNGSAFTDTAVFNTYGALAAYRFTPVFSVAGAFAYTLASKANGVNSAARYQQYSLKESYSLSKRTTLYALQAYTHSSGQTLGAQGAGHVIDAAPIVGDSQQLTPSTTHGQFVGMAGIAVTF

SEQ ID NO: 10953 - protein, 464 aa, Burkholderia cepacia
MGNRDTRRPRARPGTVRPLSRWLGATLFACAAAAHAAPQPDGDAPPRWQAGADGIGFWPGGDAAGFDASAWMTDAGPARGARNEASGDERQPDTIPLTARKITLGQRTGAAARACEAAGDAGADGIGFDDGRTGGGCDPAATHDAPAGDAAARGVVHADRMPYELHPVDPSRLPDLPAAQAPPLLEQLMGDDRNMVGLGWHFVGTTGRSTPVTTRTDALGLNSFQNAGSSLSLSNTNTLAFTFTHFVSEHWAAELGAGIPPVLTLRGHGSIALPLDRIFAGVHGRFPLIDLGNTQSNPLATTRAWLGSVVFKYYLGERDDRFRPFAGIGVSYTRFTNTNLNPVFQRKLASLGGLLAAGADIGSLQSLLLDPALFQRIWDAGGDLLLSGRTNVSAKVKSVWEPVFTVGASYQITRRFWLTGMVTYIPLRTRITLDINQPNRLLASNTFDISANPVLATVLLNFRF

SEQ ID NO: 10954 - protein, 372 aa, Burkholderia cepacia
MKSRTGGAKTPMKPIKRIAAAAALLPGLAAAQSVTMYGVVDTGVEYVNNIGAAKDNVLRVMGNTGMVPSRWGLRGTEDLGGGLKSVFVLESGFFPDSGTSSMGGRLFGRQAFVGLSGRWGQIAFGRQNTMLFWSYLDSDILGPNIFGSASLDNYMTFGRADNAVSYKGTFGGLTVGATYSFGRDTVSAGPSPAGTNCAGENAADKRACREWSALLQYQTDWWGVAAAYDENRGGPGAFGGLTNSGLTDRRATVTGYAILANRAKVGAGVIRRDNEGSATPRSDLWYVGGSYDITPAFNVAGQVYSLRFHHSANKAMLYALRGTYAFSKRTSVYGTVGYVDNSGQSAVAVDGAATPPPGASQAGAMLGIKHIF

SEQ ID NO: 10955 - protein, 559 aa, Burkholderia cepacia
MRKIVLASVVTSLVGCSMGHRDPVEAKQALNQAINETNSRQIDQLPPSVEADLMPDMDTLTASEPKTLQRFRIQAEDVEAKAFFASLVQGTEYSAAIHPAVTGRITLNLTDVTLDEALGVVRDLYGFEVVKEGKVIQVYPAGLRTVTIPVDYLQFKRTGRSLTSITTGTITNTDTNNSNSSSSSSSSISSNSSSDGSSSNSNSNRSDARGGTEIETTNESDFWPLLEKAVAQLLGGSGGQTVIVNPQAGVLTLRAYPDEIRQVNEFLGISQQRMHRQVISEAKILEVTLSDGYQQGINWSKAFSSNGANYKIGSGSITQDSNGNPITSVLPGLDAIGNLLGGQSNVVISSGSFDAVISFMATQGDLNVLSSPRVTASNNQKAVIKVGTDEYYVTDLSSVVGTGDNAQASPDITLTPFFSGISLDVTPQIDDQGNVLLHVHPAVIEVEQQTKKILYRSEEIELPLARSSIRESDSVIRAKDGDVVVIGGLMKSNTVDQVSKVPFLGDVPALGHLFRNTTKLTQKTELVILLKPTVVGVNTWQKELERSRSLLQEWFPDSQ

SEQ ID NO: 10956 - protein, 820 aa, Burkholderia cepacia
MKSATKSRHGTLYLAAPLKLQPLAHSVRLAVFSMAAVALTLGTLALSNEALAQTAQASPAGKRYNIPAGSLEAALTSFAKTSGVLLVYPPALVEGLNSPGLQGEFGINDGVARILQGSNLEIVNNGNGKYTLKKQTTPDSGLLPAVTVLAANESYTQSLQSEGKAADGYRTKSVSSMGALGNMDLRDAPFAVNVISQELIQNIQAQSPDDVYKISPSTLSQTPQGSGWAPMVKIRGFGSYDRAEDGLRRSYGFAVSMEDKERVEVLNGLSGFLFGAASPGGMVNYVNKRPTKERLNSITVGNYGGSQNYIHGDFGGSFDADGKIGYRVNLVRQDGETAVDDQKIDRTLASVALDFNITNRFKVELGGSYSDYKMQAPTAYWFFDDGVPRIKAPDSSKNWGQPWIQEEMETKKLMAKATFEANDHLTLRVAYIREDQDRPKQDHTMNSVSSPAGYSQIRIHSGYSKTQSESKQALADLSFDTGSISHKVTLGYFGYADSQWQTSYSPNSGWQGPYGFGTPTHVAQPAWPAVPPNSMYYASRVTNDNFMIGDLVKFNDQWSALVGVNRSTIKTISREQDGSANPEQPDYKRSRNSPSASLIFKPVPWLTTYATYIEGLEQGGTAPLTATNPLAIMPPMQSKQKEIGVKAELGGVLVSGALFDIEKASEFTDATGTYRQDGRQRHRGAEVSAFGKLTNAWSVVGGVTMLTARLEGGEFDGAAPPNVPKILAKLYSEYALPFATGLSVSGGVYHVGKQWSSETNTSRLPAYTTIDLGMRYVTKVSGRPLTLRLNVNNVTDKDYWLNSYYLGTPRSVAFSAQMPF

SEQ ID NO: 10957 - protein, 406 aa, Burkholderia cepacia
MKKRVAFAMTAVGLAAATAAHAQSSVTLYGIVDNGIAWQNNSSAVGATSGGHSKVQMSTGVWAGSRFGLKGSEDLGGGTKAIFQLEAGVNTANGSSQWTNGIFTRQAWVGLTNATYGTLTAGRQYTAYYTLLSPYSPTTWLTGYYGAHPGDIDSLDTSYRANNSLVYMSPKFYGFTVGGSYSFGGVAGATNRGSTWSAAIQYLNGPAGIAVGYQKVNNSTLGGGVWGANSTVQNGLTAAGDGNQPAVSSINNGYATAQSQQRIAVTAGYQFTPAWDISASYSNVQYTPGTGSFFRNKAIFNTAGAVLHWKAAAQWDFAAGYSYTAATQSNGITSSAKYHQVTLSQYYSLSKRTGLYAVEAYQHASGNTLNGRGNAIISATTSIGDGVGAGSKQNQIGVGVGMIHRF

SEQ ID NO: 10958 - protein, 722 aa, Burkholderia cepacia
MPSRRTPCRARTLHPWRMPLPALLTLCVASGAHAAGAEPVAPAPAAAPAAEHELPAISINASAAVDPTIGYQPRTTNIAGGDARALKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTNHGGSNAQFDLTGPLGKPGQVAGGTLAFRLTGEYDTSRYWRSFGRERNALIAPALSWHDANTSIDVSYQYVDYTMPFDRGTVLVNGQLDEALRYRRYEEAWSQSSGIQETLRTRIEHRFSDAWRVRATYGWGRDRYDQFITRATAFNSRTGALTRSSDANLGRNDSDQIATLGLLGNVTLAGMQHAIYVGGEYERQRSFRGDTIRGKATTGFNLYDPVYGLLAPGGMANAKQSDSRSVVHAYSTIVQDSVKITDRLTAVGGLRWENWQQESGMGRPFVFADRSRGSVWLPQFGLAYALTPALTAYANVSRSFKPNVASNVAAPLAPEYGRVLEAGLKFSLKPAITGTLAVYQIDKRNVAVTVGDLTSTIGTARSRGIELDVAGQITRHLSVIGSYAYTNANDRDSNTPLVNVARHTGSLFAVYDTAIANLPGRWRFGGGARLVGARSGDTANSFTLPGYVSVDAFAAYETTIGKFPTRFQLNVKNLLDKTYYPSSNSNLIVAVGEPRLVTLTTTVSF

SEQ ID NO: 10959 - protein, 942 aa, Burkholderia cepacia
MNKQISKLILLILLVCGSIASAQVVKGRVIDESTEEPIKGALIEILGTEFTATTDAEGFFNFASGIPQGDQKMQVSAADHYNRTLPIVVNELTPVNIDPLYLRVDFSDQEQTAGVISLTENDLSDDQNAANNVSGLLQSSRDIFLRAAAFDFSATFFRPRGLNSEDGRVLINGLTMNKIFSGRPQWSNWGGLNDLQRNQNFTMGLSAADNTFGGLGGVQSIDMRASQQREGSRISYAAGNRSYTGRFMATYNSGLKSNGWAYSISASRRAGEEGFIDGTVYDANSIGLSVEKKVNDNHFLNFTGMYTPNRRGRQSPMTEEVKNLRGITYNPNWGYIDGEKRNSRIREIEEPILMLNHNWQINEKVKLNTNVGYQFGRIGNTRIDNGGTRLVTLDGQDSYIGGARNPNPDYYQNLPSYFLRNGLDYSNAYLAQQEFVSNGQLDWDALYRANASFTQQGGTSVYAIQEDRIDDDLLMVNSILTADITDNILFTGGVSYRNLKSENYARIDDLLGGGGYLDVDFFAQETSNITQDQAAQSDLNNPNRIAGEGDRYKYNYDILVDEIDAFAQAQFKTKKVDFYIAGNITQTSYQRDGKYRNGNFADNSFGKGEQLDFTNFGIKGGATYKLSGKSFIDFNGAYLTDAPTIRSAFPNARQNNNTTTGLESQTVYSTDISYIYRSPIVKARLTGYFTQFKDGTDVGFYFVEGLSGAPTQDGNAFVQEVMTNIDRRNIGGELGLEVQVTPTIALKAAAAFGTNTYSNNPNIYLNSDDFPNVDLTFGDGTTNLKDYHIAGGPEQAYQVGFEYRDPDYWWVGATANFFSNSYVDVAPLRRSENFVTDLDGLPVSNYDEEIARGLLKQEKFNPYELLNVVGGKSWKIGDKFVGFFATINNVLGKEYRTGGFEQGRLANYQDVLDDSNNPIEVFAPRYFYGNGRTYYLNVYLRF

SEQ ID NO: 10960 - protein, 370 aa, Burkholderia cepacia
MKTLYKLAPLAMLGAFATHACAQSSITLYGLISAGVGFATNQGGKNAWQALSGTNQNPRWGLKGKEDLGQGLSAIFQLENGFNVMTGTAAQNGREFGRMAYVGLSDRTYGSLTFGRQYDAIHDYIGPVIIASNGVNIGDNDNGYNDIRVQNSVKYVSPVYYGLKFTALYGFSNATGFANNSAYSFGLGYEQGPLRWSAVYAQYNHPYSATNQDGAIANDYASPLLIFSKSAMSPAAYASRQRIAGTGGFYTIGRAQFAAMFTDVRYDYLDNTHLHLQNLGVNVVYTMTPQLFLGAAYAFTNGKYDVIDKRPKWHQVNLQADYYLSKRTDVALTVIAQQAAGDADHAQIFAYARSTSTRQMMATVGVRHVF

SEQ ID NO: 10961 - protein, 392 aa, Burkholderia cepacia
MKKTLIAGAALATLAGAVQAQSSVTLYGLIDTGLTYTNSQITGTGAGGHSNWQMTSGGVQYSRWGLRGAEDLGGGLRAIFTLENGFNVNNGQLSSSNRIFNRLAYVGVSSRDFGSLTLGRQTDDMVDFLAPLSLTGTQYGGTHFAHPFDVDNLNDSFQINNSVKYQSPDFAGFKLGALYGFSNQAGGFANNRAYSVGMSYMWGPLNFGAGYLHLNNSARTPAQLNTNGAVTDTLGASVSGLLTPTAVPLGALASRQQTWGGGVNYAFGPLVAGFVYTQTNLTELFLTGFNTHFQNYEGNVRFALTPAVMLAAAYTYSRAGGNAGGGAPHWNQVSALANYAFSKRTDVYIQSTYQSVSARAGNPLGVAWINGVSSPASTSNQVEATVGLRHRF

SEQ ID NO: 10962 - protein, 387 aa, Burkholderia cepacia
MKKTIVAAAALGMFGTAAHAQSSVTLYGLIDAGITYSNKVATTGGHDKLVKYGDGVASGSRWGIRGTEDLGGGLKALFVLENGFSSGDGSIGQGGAIFGRQAFVGLSKNGIGSLTFGRQYSFSTDYIGANYSMGSQTPAGNYAYHINDLDQLTSSRINNAVKFQSANFAGLTFGAMYGFSNSTQFAGTPTTTGANGSQGSSSAYSFGANYAQGPFGIGAAYTNIRFPNGAQPAFGVSIANVNTQGLRDLETVGVGARYAIAAALVWANWTHTKFVPLSGETSKLNNYEIGGRYAFTPALSGGLGYTFSKLDGRYDGKWHQVNAAVDYALSKRTDVYVSAAYQKASGSNTINGRVVPVQAEIGSSGSFIGNAGANTQFVTRIGLRHKF

SEQ ID NO: 10963 - protein, 633 aa, Burkholderia cepacia
MNPPRGISLRPMKDAVDMFLRTALLGASALVITASFAQAEDTLTLDPVEVSGLRPIEFDRLTSSVSVLTADDLAIRLSPNPADQLRAVPGVAISRAGGVGALTQVRMRGAEANHTLVLFEGIEISDPVNGDTDFGLLTALPTGRIEVLRGASSSIHGSDAIGGVVSISAAREAGLNAFAEAGSFGTVRGALGLSGENFGGAITGFTTDGVDTSGTGGAKDGSEALSGFVNGKVDLGADWSLSLIGLARGMESEFDSDTDFDGLLDDEDRRTEADQWLVGGALSGVTGPLDHVIRASFNEVKRDNFSDGQKTDVSKGQRTKLAWLPSLANGAHSLTGILDYEREEYDRTDVQYAGATDASETFESIGVGAEYRYSAGAFDASASARFDDNDGRFDDATTWRLGAGYAFEQVGGRVRASIGTGVKNPTFTELFGFFPGSFIGNPDLKPEESTSWEIGWEQTVGPVSYSATYFEADLENEIYTAYNPDFTSSPANRATDSERSGVELAARWQALANLAFFGQATLFDSQDNNGVDEIRVPEATASLGADWLVNPNGFRLGAALDYVGEQGDTDFGPFPSRPVSLDAYTLASITAEYPLTERIAITLRGQNVFDEKPTDIYGYNGPGAGVFVGLKLK

SEQ ID NO: 10964 - protein, 368 aa, Burkholderia cepacia
MSSNLLSRSNGSLGNQHSFARKTLPATIGIVLSLLAAHQASANTAGLNFYGRANVSADFLDNGTDSDLNVSSNSSRIGVRASTDIAEGLKGLLQVETQINYDNGSGNLANRDTFIGLEGGFGRVRLGQIDTPLKQIRSAVDFFGDQIGDLRNVTRLNGSTGAPYTSQDFDARFRNGVYYNTPAFGGGFVFNLHYTPQVNEGANLEEDTAAYSTSLTYEAGNLYFSVATEQWETTNDSNALRVGARYKFTNLTLSGLFQQATIKNQALEEDVQTFGIGASYKLSSTWVAKGQIYTLDPKDRDDSGTTLAVVGADYILSNQFRLLFAYAQADNDELARYRITGGGGYGDAVATTVGETASGFSLGLRYDF

SEQ ID NO: 10965 - protein, 362 aa, Burkholderia cepacia
MKLRFGVLAMLAVTQGAWAQSSVTMFGLIDSGITYVSNEGGGKNVKFDDGIFAPNLFGLRGTEDLGGGYRATFALVNQFSMANGSIVGTGIFGRNAYVGVESDRFGSITLGNQYDFMVDTLFSKGNAISRDISGLYGFRNGPFQRLALPGNPTGAFDWDRTAGSKPIANSVKYSSPTVAGFSGGVMYAFGGVAGSVGADNAVSAGVNYELGAFGVGAAYTNEKYGPAPGVPSTSVRNWGVGMHYDFGVVTAKALMTTVRNSFNDAGVWMAEAGGLWRIRPDVVLGAKYMYMKGNEAVNDNHAHQISVALQYLLSKRTMVYVSADYQRANSGANAQVNGVLDPNGASSSASQAVARMGLHTVF

SEQ ID NO: 10966 - protein, 470 aa, Burkholderia cepacia
MKFKSLPMFALLMLGGCSLIPDYQQPAAPMQAQWPTGQAYGGQGDQRSIATALPKAKEFFKDPALVRLLDAALENNRDLRIAAKNVESYRALYRIQRAERFPTLDGQASGNRTRLPDDLSPTGDSRIDSQYQVGLVTAYELDLFGRIRSLSNQALEKYLATEEAQRSVQIALIGDVATTYFLWRTDQALLELTEATLTSYVESLAMIESSAWAGTSSELDVRQARTLVNQAQAQQALYTRRIAQDVNALELLLGSKIPTDLPKNSPLAMSALGKVPAGLPADLLLNRPDIRSAEHQLMAANANIGAARAAFFPRISLTASAGSASSDLDGLFNSGSDSWSFAPQISVPIFNAGKLRANLDYAELQKDVGVATYEKSIQTAFREVADGLAARGTYGKQLSAQSELVDNYKAYFSLAQQRYDQGVDSYLTVLDAQRELFSSQQKLLNDQLDQINSEVQLYKALGGGWSVSQN

SEQ ID NO: 10967 - protein, 433 aa, Burkholderia cepacia
MSRLFAGRSGCSSRVVQSAVAVVAMVGIATEASAMSRSNNVGMHVGDRPMGMGGAAAGISDDPSGLYYNPAGIVYGHAPNLSASVNAFHITSNRYADTLGEGSDWERNSDEFLPNFFGTTQPLGPVTVGFSVVVPQSVREEQAQTFDADAIERDAVQAFSINVDNEDTINRLGPSIAFEVNDRLSLGASLHLHQHERQTITTQVLLLEDEATSARDYEVQNQYVTSEQVGVSWLVGAMFTPLERVAIGVSVRGTEIFDATNSTQTLCHGADVEAYEADHFCQSGSVTFQDRTEDSVREAYPVETRVGAAWFATQRLLLAADVIHSSGFGGREPVTNFAAGAEYYLTADWAIRLGGFTDFSNVDEVAYDGFDHSVDRFGGSLSLTRFTQNTSVSVGVTGSYGTGEAYIIDDPNVGAQDLTSTTATLFLATSYSY

SEQ ID NO: 10968 - protein, 694 aa, Burkholderia cepacia
MRDLPRLPLRPLSSLSLMLCAAVAHAQTDAPAASGTPAAAPAPLAPIFVTANPLGDTELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGVTGALDARYGGANSVRAGAAQVEGGNGRFAFHVDAFDRETSKLRIPGYARSSQQRAIDGPDTPQPEGNVPNSDGRVHGGAVGASYTWADGFAGLSYSGYESNYGSVAESDVRLRMRQERLAFASEVRNLSGPFTKLKFDFAYTDYRHKEVDNGETATTFRNRGYEARIEARHRKIGPFEGAIGVQFGQNTFSALGDEMLVPSTRTNSVALFGLEEWQVVPALKLSLGGRFEHVKVDPDPAGVEKFAGAQPRDFNAGSLSAGALFSLTPVWSIAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGVELDGKWRAFSRRGHTVDLELTADYTRARNVDTGQPLPRIAPLRATLAADYGYGPFGARAQVTHAWSQHRVPDDDFSTDGYTSLGVMLTYKFRVGPTHWLAYLRGDNLTNQEIRYSTSVVRGFAPQGGRSVMAGLRTTF

SEQ ID NO: 10969 - protein, 642 aa, Burkholderia cepacia
MNLRHLLATSAATALLSPIAHAAGDTTITQPRPSADGTDLPTIAVTDTRHLPESFDQRYATTQVLTRADLDRLSPSEPSITQALAMLPGVTVSQTGGPGSSASVSIRGSSASQVAVFIDGIRIGSPTTGIAPWADLPTEAFERVEVISGPAAASFGANAMGGVVQLFTRRAAGQPNQTSVSFGGGSNKTFDTQLRTSGTVPSTGPLAALGGLTYSLGLHSYNTAGIDATRPVLPYHEDGRNPYHAQDLDARLGYARDNWSISTFALYHRSDLSYDNAGYANRELDHQLTTGIAFHLDITPDTQFDQSFGYANDRQFLYASDPAIQTDRIDSQRISSSTSLTHQTHGFHLFGLPLSGETKVAYDFTREQAFLPIDVPDGVPTRNDSAFSLHQSATLGSVTMFVAGRHEIIAGKAVNTGNAALSWAITPVYTARVSYGNAFRLPSFNDLYYPGYGNPNLNPERSDSVEAALDANTAYGTFSAAIYDTRVNNLIAYNPATFSPMNIGRAHIRGIDLSYKGTLGRTTPVSIAVGILNPQDETNDSWLSRRPRQTVSVNIDHTWDELHLHALSTGASLNYGGTTFDDPANATYLPSYLTVNLRASYKINAHLTVSATLSNLFDRQYVTAYGYNTLGRTAFGKVSYTF

SEQ ID NO: 10970 - protein, 757 aa, Burkholderia cepacia
MHCYTLARRPICAALFGAFGLSAAPAHADSSPQGATPPSAVLTAAAASARGEAALLDPVTVTATRTATAASRTAASVSVITDEDLEEQQATNIKDALRYEPGITVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSIYGKPYYFSFRPSYDSTDRSIGATVSAAGGNDRIQGMIIADGRRGHEVDTRGDNNSASTLRTTSNPQDVYSESLLGKLVLTPTTRDTIKFTAETVQRRVSTDVLSAINAPATLGLTTHDRLERNRFSVDYDFRDDAFRWFQTAHVQFYYQDAKQDQYAFETRGRLPSRSRDNEYKERTFGGAAFAESGFSTGPLAHKLLYGVDGSLSRVTNLRDGTVPGVGEAFPNKAFPDTDYTLFGAFVQDQIGYGRLLVTPGLRFDTYRLSPTENDPLFTGKAVSTSANELSPRVAVLYEITPAVIPYVQYAHGFRAPTPDQVNSSFSNPVYGYTSIGNPNLKPETSDTFEAGLRGKAGTGYGVVRYSAAAFTGRYRNFISRTTIAGSGRPVDPFVFQYVNFADARIHGLEGRAEWVMPNGITLKTAMAFTKGSTQNDGAASQPLNTVNPFSAVFGVRYEPTERWFVQTDLLFQAAKRDKDVDKSDCSNKACFTPPSSFVVDLRGGYRFNKHVSATIGIRNLFDRKYWNWSDVRGIAADSQVLDAYSSPGRTVAVSMKVDF

SEQ ID NO: 10971 - protein, 935 aa, Burkholderia cepacia
MRRARPSNMMLSGADDQRLQFASPIIYTPALGAALILALTLSAPGQAAQVYANGTNEIAPGTVDTGNISGTNGVGLYATRGGTINSTGAVQVTTGGTGAYGVHAYNNGSVTLQTGSTVTTTGSTAYGLYTLTNGRITATGTVILVAAKTYAVDATQGGKIVLIDSTVNSGGTGLFTLGANGDGTSITATNVHVRSEGAAVEVDRNSLISFTGGSVITTGASGHGLYNIGSGAELQASAATITTQGYNAHGVFAASGSMTLKNLTIETQGQTAYGAYATGAVQVDLSGGRIHTAGKDSLGAVAQNHAQLQINDVSLVTDGDNSHGLLAFNSLANPGTKLSADKVSVTTLGANSHGAVLVGGAEMTITGGSSITAQGANAFALFAQARDGNKSVARVADSSLRSTQGVGVLVFGTTLDITLTRSQLSGQNAALDVRSASGNSGHLTLTADASTLTGRATLDALSTSELSLSKGSAWTLTGDSRITRLNNRDSSVQFQSISGHATDAASYRTLSTGHYTGQNGALRLNTYLAGDNSPSDKLIIDGGVADGQSHVRINNTGGPGAQTKGGILVIDAINGATTTTDAFALEGRAVAGPYEYRLLRGATDGSNAEAWYLRSEKINNQPDEPLYRPEVGAYLANQFFAQQFLTHTLDDRRGDQPASPAQATQRLPHASWLRMTGAHAKGNTGDGNHSAKTDVFTLHGGADLYEQASADGQGKTYAGLMASYGVGSSRARADGNPYRANGRSQAWSLGAYGTWYGNDLTRLGPYVDTWAQIGTFRNRVEGQLLEKEKYQAHGWALSAETGYAAALSGRWVIEPQAQLIYLGYRQSGFTENTGVRIGSANADGLLTRLGARLYHQADTFQPYLAANWWRSSIEPTVRMDGKRIDNMYPQSRYELKTGLNARLAKSWTGWTSLSGNWGKQDYREYALRAGVQYTF

SEQ ID NO: 10972 - protein, 356 aa, Burkholderia cepacia
MDGDTFMQRKAFLVGACVLCATPAHASSVTLYGIVDSYVEFDRIGSLSSMRQSGGGASTSRFGLTGVENLGGGTSTKFVLESGFSPADGSFQGGTLFYRQAYVSLQNTRYGDLRLGRQYTPAFYVVYDGDPFGLNERLSPLALLATSTDTITSNTTPPIPRFNQAASYLSPDRNGLRVMATYGFPTPNALSTQAGRNYGAGLQYRIGGLYVGAGFQGDTSAGNLAPVISPSTTRHYVFAANYAFAHVKLYAAFLYGVGTAARLPAFSTASVGASINVGALDRVLVSVVRRDVKGSANDATALGVGYDHPLSKRTSLYARYLYMKNSGDARNTVVAGLQPQPGGTEQVFALGIVHRF

SEQ ID NO: 10973 - protein, 492 aa, Burkholderia cepacia
MMMKKQKKIGTASKMLLAWGLPALAGVSLTGVAHADDAASAPLTVAQAAPAAGSGASVAQATTPNAIVNAEATQAVTPPDEPSAQSKSSGFIADSHLDFLFRNYSDILDNKGGPHRHAWVQGVMANFESGYTAGLIGFGVDASLYAGLKLDGGAGAGNMVHVAKGGGGSNQLAWAYPGIYDVKARISNTVVKYGLQAVDNPFMEQHDNRALPPTFLGATLVSNEFKNVMLEAGSFTKTDARGHTTLTNLTTQYGGTRINRLTYVGGTWDYSPNGEVALYANQADDVWHQYYASVKHSIGSPQTIKWTGFGNVYSTHDTGDALQGKINNNAYSLSLAAQHGPHELLLGFQQVLGDQFFDYLNETNGIFLANSMDVDYNAPHEKSLQLRYTFYGKDAGLPGFKAMVWGVTGWGADGSAGAANDPSKSSIYWSNGAPVQGRHHEFGFIPSYTFQSGKLKNTKVTFIAMWHAGSAHYSDATNTEYRLVVNLPLHAF

SEQ ID NO: 10974 - protein, 376 aa, Burkholderia cepacia
MNHPNGRADQLAVPRATLVAALLACASLPALAQSSVTLYGRIDTAIEYANAGPNHVTRMGSGNLWASQWGLKGVEDLGGGYAAIFKLEDGFNAASGALSNSSALFGREAWVGITGPFGGVQFGELYTILHTTLVTYSLPGLGAGLAWGNATNNFVGPAFLRVRNSMRYTSPRYAGFLLRAMAARGTNGATGQPATLGDTYGAGLNYARGGLSVDVDYMQQKFSPVAASALGATSTAANGNYTLGAISYDFSVVKIAALYMRHRGGPDVGAAIDSQSAYPHSDTMELSATVPIGRASLLLSIGHYRKVADSDGNADSYGIRFDYPLSKRTVLYTGAAMVRNGAHARFVVNGAAGGGVAVAKPGATASSIVAGILTSF

SEQ ID NO: 10975 - protein, 812 aa, Burkholderia cepacia
MRLKVYNTLIFILIATTTIAQSNLSGTISSQDGKALEDVEIYLREANQVASTDAAGKYRFENIENGTYNLIVFGLAYELVEQQIRIEGETVKDYTLTPLGESLSEVVLTSRREKIFALRSLKKVEGTAIYAGKKSEVVLVDQLTANLAANAPRQIYSQVVGLNIYENGDAGLQLNIGGRGLDPNRSANFNIRQNNYDISADVLGYPESYYTPPAEALKEIQVVRGAASLQYGTQFGGLINFKFREPVKDKKIELISRQTAGSYGLLTSFNSLSGTVGKLSYYTYFNYKEGDGWRPNSQFNSRNYFAHVAYELSERTTLTGELTLFNYLAKQAGGLTDAQFIEDPNFSNRDRNWFDVDWKVYSLRLDHAFSDKTDFSLNVFGLDAQRSAVGFRTNRVSQPDDVEEPRELLVDNFTNWGAEARLLSRYRIGDKDAVFLIGSKYYDASNSQQQGPGTTAADADFSFATEQFPNYERQAQFDFPNKNLAVFGENIFNLTDRFTVTPGFRFEYIKTASAGSYKDIVLDLAGNVLVNQDLADNRDFERDFLLLGLGTTYQLSPAVELYGNFSQNYRSVTFNDIRVVNPSFVVDEDIKDEEGFTLDIGARGRIDNKFAYDVSAFGVRYDDRLGEVLFEDTDGSIKRRRGNIGDAFIYGLEVFTDWNLRNTFFESHKEFKLNLFTNLALTSSEYLSSEEIGVEGNEVEFIPDVNLKTGLNFGYKNLTASVQYTYLTEQFTDATNAPQDVNDNQRGIEGSIPSYGVLDISAAYSWKQFKLEAGLNNALDESYFTRRATGYPGPGIIPAEPLTFYTTLQIKL

SEQ ID NO: 10976 - protein, 727 aa, Burkholderia cepacia
MVWGLFNLTDTFRRAVAVSMCLAATAISPARGQAEPTEAGIAVYRPEAFAEFLPRNALDMVYRLPGFSLNGGDNVRGLSGAAGNVLINGRRPPRGSGSLQSRISAIRVEDVIRLELIEAGARDVEMQGYPLLLDIVTAQTSAARVDGRIEIEPREDGGEEYQGELAVSISGGRSELEARVDLYDETRTDYGSVRTSTADEPGARVSSDELESQTRRDWLAVARFHANPRNDFAFSLSTERRDNTSTPVLDSQAPTGTVETGASESIARFGSARWRHDLTDTVELIGLVTRRQGEAVASDSFLSSGVTSQSDSTRETEETAVRADVRWRPSRSLTLETGVTWAANMLEGRSSAYIDGVEQDIDGDDAQVEETRSALLASATWIPTSRVSTTIGTRFEQFSLDTSNQGGASLSLTDIAPRADINWSLSEGWTLRLSSERNVGQLNLDQFLASTDLNNSLNTAGAATLEPQRDWTHAVTLEHRSGERDLLRLEAATQEIENPISSVLDGQGSLRPANVGPETIQWVNAQFELELDRYGLDGLSVEGSANRRWSDRVDQLQGFARTTSGHRDYNIKLVIRKEWSEGRYMASFEVEDRAPAMHYWLTEIREENNGIRLRFESEWRPGPEWRSGFFMRWNGDRRDTIQVFDGVREPGADPVLINTIDRSEGVFASVWSEWEVRRAGFLRLSLRSGRDESGVSRVDSPAGAFLDQIASQSDNVPSVNVRLRFQR

SEQ ID NO: 10977 - protein, 351 aa, Burkholderia cepacia
MKKMIAATLVGALCASAHAQSSVTLFGRIGGGVRWVNGLPGGSQIGFNNIIAGNEFGIRGREDLGNGLKALFVLDGAFNSGTGALKTSGTLFSQAAYVGLAGDFGRLTLGRQFNVAEDLGIALDPLGGRGQSLAVEPGVLFDGNFFTLDSRFNNTIKYLGQVGGLRFGANYSPGGVAGRSHAGTSYSTAAMYTYSDLMGGVSYAKTYSPDGSQSAQTIQAGGTLQLGRARFYLSYASLNVRANKAGAPSRRDDIPSFGVVAQPLPSVQLSAAAFYDRARNLGNVSGADGHKLTTYAIAEYFLSKRTELYVEIDRNGLTGAYMRDPATIAALNLRRGASATTGVSIGLMTQF

SEQ ID NO: 10978 - protein, 366 aa, Burkholderia cepacia
MKKHTLAVAISCALIGATAHAQSSSEKEIWGGVFGEYYSVYPDKFEPNTDYDSGLGWGGEIGVKLNPDWGFRFEVAKLDIDADTGNGNITGERIGVDAMYFINQSNYYIFGGLKNQRFDESYRMADLGLGAHWQLNDKWKVITELAGYYDFGQGNPEYSAKLGLAYSFGKTGGKRVSKDSDNDGVIDQRDLCPNTPYGTSVDVDGCPMTAVDSDNDGVIDAKDACANTPMNDKVDDKGCSIFTEESKTMSLKIMFDNNSSKLKNIDSASVQEFVDFMRRYGTTNAVIEGYASAPGTDAYNMKLSVERAQNVRQYLVAQYNIAGSRLEAVGYGETKLLDSANTREAHQKNRRIEAYVTATVKIAVSK

SEQ ID NO: 10979 - protein, 386 aa, Burkholderia cepacia
MKTPVRLVMMSGALLTASHAAHATEVTLYGLFDTSLTVVWNADAQGRNLVGLGNGNLLGNRFGVKGAEDLGGGLKAIFTLENGFNPNTGALGQGNRMFGRQAFVGLESARWGTLTLGRQYDALADVAWPITGDFYFGSVYATPGDVDNYDTSSRTDNAVKYTSPVVGGFQFVGMYALGGVAGKSGAGQTWSAGLSYNHGPFDAAGGYYHAANRASLANGVRTGWNGTSDGTFDGSLVNGGYISAKSIGIARGALRYTFAPFTIGIDYSNAQYKADAMSAFRSTQKYDTARGFFNYQATASLLVGVGYSYTKARGDTSATYHQVSAGADYVLSKRTDLYAVGAWQRANGEQRTLDGGTQAAQASIGSYGYGGTRTQGIVNLGLRHRF

SEQ ID NO: 10980 - protein, 672 aa, Burkholderia cepacia
MKKAVLMVLLLAAVRPAIAAETIASSDQSATPVFTAGEIVVTGKSANSSETVPAAEMEMLDKQNLSEAADLLPGVTISNVGGRNEGMIYVRGFDMRQVPLYLDGVPLYVPYDGYVDPNRFLTMNLSEVSVSKGFTSVLYGPNTLGGAINMVSRKPEKKLEGNVSAGGSMGNDEIDAGFESVNIGSNQGKWYVQAGLSVLSRDFMPLSSSFEPVANEDGGERGNSDTRDRNATIKIGYTPNSTDEYSITLNSQHSVKGVPLYTGSNPNNKSRFWRFTNWDKTSLYYIGRTSLGEKSYLKTRAYFDNYYNTLESYDDATYTTQHSNKAFSSRYDDHTVGGSVEFGTSIAQSDILKVALHDKYDMHNEIGNTGEEPLKFADNTFSIAVENTWNASKNLTLIAGVRQDFRSTIEAQEFTDNTHTAIHSFDLEDNRAANAQLAMVGHLDACNTLTSYVARTTRFPTLKDRYSYRMGRAIANPGLDPEQSLNYGLDYAFTPSGKFSLHASVYRSKLDDTIQQVNNVAYDTATSTWLWQMQNTGKSTFTGFEYSMDWQPEAWLKAHVAYSYIDRQNDSNPDLVFTDVPKHKLNGSVQFLLNKETWVLVESEYNTKRYSTSDGKYTASPYGLLNLHINAGLTDALSLHAAVNNLFDRNYEVAEGYPEAGREYIASMNYAF

SEQ ID NO: 10981 - protein, 362 aa, Burkholderia cepacia
MVKHAAATLLGALAVAGAWAQSSVTLYGSLDAGVAYVNNVGGGAKWSMIQGNTQPDRWGLKGVEDLGGGLKAIFQLENGFYTNNGQMAAAGTMWNRQAFVGLNSDRLGALTLGHQTPFNFDWLDPLSSAFLAQSWYAFHPGNLDQLADTSTVPFNNSVKYRSPVFAGFTVGAMLGFGNTTNFSTGRTMSFGVNYANGPFKAAAVYSNEHDQAFPMATVGGIAGPGGTFQGMPVASYVAKKAQNMGAGLSYRFGPLLVHGLYTRVKLQANGHSDTFQSYDAGANYQSSPFNVIAGGAATSTLAGRRWTQFELGDTYSLSKRTQLYVNVLYEHASGNAKAAFFTAGASSTANQVIVLTGIHHSF

SEQ ID NO: 10982 - protein, 352 aa, Burkholderia cepacia
MNKTLITLLVSGLLAANAQAAGQDNTWYGGAKLGWSNFYGVDHNQAIKDDYAISEEDKNDVGAGAFLGYQINQNLGVELGYDWLGKYKYTATDKLIPTDISRDEIKAQLAQLTMKIGLPVSESLDLYTRLGGAYAWTDSKQLDNDNGAAFVGALGAEYAFNRDWAARLEYQYTTPLGDKALDKTGAELDNGLLAVGVVYRFGQVAPVVAAPVPAPAPEPVVVDKQFTLSSDVLFDFNKATLKPAAGQALDNLYSQIEQARPKDGVATVIGYTDRIGSDAYNQKLSEQRARTVADYLVGKGLPAGKVNVEGRGKGNPVTGDSCTSKSKKELIVCLAPDRRVEVKVEGISEVQQ

SEQ ID NO: 10983 - protein, 402 aa, Burkholderia cepacia
MKNGRRLTAAAAMLGCLHAHAQTSGSVTLYGTVDTGIIYSTNQQFTRADGSTGGGHAWQMGGGNLVPSRFGFQGAEPLGGGLDAVFTLEQQFLSANGQALQGGTAFSRQAWVGLRQEGIGTLGLGRQYDSYTDMLGAYVSSNNWSTPYGSHLGDVDNLNAAFNFNNAVKFTSADFNGLTFGGTFSFGGQAGDFSAKRGYAVAATYTRAPVAFSVGYLDLHQPLDAALGGASSYIGDFACSNPGAMYCLLQDAGSMRAFGAGGSVTLGAATVALTYTHTRLGDSRYFSTAAQPRTQAFTFDIGELNVTYMFTPALQGGVAYIFNAAHTDGRGTTRYHQVNVGANYSLSKRTALYAVAIGQVASGTGLGTDADGNAANYAQIPVLANSNSSRQLAVMAGIRVNF

SEQ ID NO: 10984 - protein, 747 aa, Burkholderia cepacia
MKSRPDELKLGKFTTLCSVLAASPAFAADGTPPPAPAGTEGHLAPIEVQGKAEHSYKADFSASAKFTAPLVDTPKSVTVIPQELIQNSGASTLTEALRTVPGITFGAGEGGNPLGDRPFIRGYDTQGSMFVDGMRDTGATTREIFNTERIEITKGSDGAYGGRGGAGGSINLITKAPHLGTTAAASAGLGTDRYRRFTADGNWQFADHAAFRLNLMSHNNDVAGRDAVNNERWGVAPSIAFGLGTSTRVVASYYHLSTDDLPDGGIPYYYGFNLPKGVATDGPAPVDRHNFYGLTNRDFRKTTSDISTLKIEHDITSSLTIRNTTRYTESTQDYIWTQPDDSQGNVVNGKVWRRANTRNSSINSIANQTELFGEFRTGPFKHSFTTGIELSREWGKRDTYNVATANGKICQNGIGAASGYNCTSLWSPNPNDPWAGSITRNNDYSHARTVTKSIYGFDTIEITPRWQVNGGVRIDDYSTRFTDTKANGGKTTTRDDTLVNWQAGLVFKPAQNGSIYASYATSSTPAGMLLGEGSESQSLTPGRGGVGSNADQLSPEKNRSIELGTKWNVLNDKLALTAALFQIDTTNARVTLPNNQYAMVGNKRVQGLELGVAGQITKQWQLFGGYTYMKSELRDNGKDTASNGNQFPNTPKHSFTMWSNYDVTPKFTVGGGAFYMSQVFGDTANQHAVPSYWRFDAMAQYRINKKLDLQLNVNNLFNRTYFDQAYPAHYASIAPGRSAFVTLNARY

SEQ ID NO: 10985 - protein, 701 aa, Burkholderia cepacia
MSRRNWAAAPMAIVVGTTGMGAADAQETALPTIEVSAQRATAPFRTRESTSATRSEADVMEIPFAVSSVDTKLIQTVAATRGDDLYDWVAGVSRQNNFGGLWDNYAVRGFAGDGNTSGTDYLVNGFSWNRGMSVPRDTVNLERMEVLKGPASALYGRGDPGGIISYTTKQPQFARANTIGVSAGSYGALRQTLDSTGPVTKSLAYRFVAMNENNGSFRDTVSSKRYLFSPSFTWDIGADTTLHYEFESARQRAPLDRGVLAVNGQLGVIPASRFLGEPRDGDYDVRNTGHQFTLEHRIDSSWSINAGVAQRNTDLTGRSSEAFALQPDGRTLWRRYRQVAFHSNDLQGRLETTGAFRTGSIGHTLVMGVDAYRFNYDQFVTRSTPSASVPYAIDIFDPVYGQPAPTPRTATNLLERDDGQGVYAQDTLAFGPHWKILAGLRWDRFHQSIDNRLKGMTTSQLQTAVSPRIGVVYEMSPAWSFYANTAYSFRPNNGADINGRAFDPEKGHGYEAGAKWAGARSLTTVSAFYVTKRNVLTADPANAGFSRAAGEVRSRGIEFEWSGDLGHGLRGIANLAYVDAEVTRDSVLAPGSRLVDVPRLSGSALLMYETTLPFADKAGAGAGVIYVGRRAGNTANTQDGFELPAYATVQLNGYLQVNKHLRASVVLNNLFNRTTYVSSYNSLWVTPGAPRSLLASLAYSF

SEQ ID NO: 10986 - protein, 394 aa, Burkholderia cepacia
MIKKTVVLGLVSIGSVSAHAQSSVTLYGVVDAGFAYTNNQGGASNIQQTSGKLSGSRWGLKGVEDLGGGLQAVFTLESGFRPSDGGLGQGGRLFGRSAYVGLASKGLGTLTFGRQYEPITDLVAPYSGSGFWSPATHVGDNDNMNQSFRLNNAVKFRSDTIAGFTADLLYAFSNQANGGAGTGFSNNNAWGASANYVNGPLSVGAGYVRINHPNSTSNTSGAVGGATSTTGNDYSGAFFYGLNGGVLKQQIGVAGANYTLGRATLGFAWSHTQLDYLDGSSRKFNNYDVNARYQITPAATLIGVYTFTDGRASGLPGTGGQTLKPRWHQFTLGFDYALSKRTDLYLSGIYQLAAGDPSTATAGGYRSIAAISNIGSASSTNRQVAFVSGLRVKF

SEQ ID NO: 10987 - protein, 719 aa, Burkholderia cepacia
MLIAAHPGAAALAGTAAKSGAQKNDMQRNENVREDTRRLAAGAPPAGGELKAISVSAPKDAADDPSVATVGKMPLALREIAQSVSVTTRERMEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERKLGGGWKAKVSGEYQAVRSDLKYAGAYGAIDRATGAGGTLMGSAYQFSSYSRSVDANVQGPVRAFGLTHELLFGATYASSSSGQLTAPLLAGADTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 10988 - protein, 873 aa, Burkholderia cepacia
MKQIPLILAMSLAFAAAAKGESAPDMQAAVNFDSAMLWGGANGADLSRFNYSNALRPGNYIVDIYANNYPLIRQQVRFVAAQTSGQGLKTAPAVACFTYGQLEAMQVRLRALDPALVADLKSSGRCEVLGKLFPDSRESFDFGENRLEVSIPQAYTINRFRRDISPDEWDSGITAFRLGYQYNYADYIGGLRAGRRLDLNLYSGFNFKGWYLRNSSTLGWGQGRFTRRSQRTSLQTDIPSWRARLVFGDVFSSGEYFAPYSMRGMLVGSDTAMLPYSERLYRPTIRGVARTRANVKVYQAGVLVFQDAVPPGPFAIDDYSPASYGGDLRVVVTEANGAVQTFTVPYASAVRLILPGQTQWSFSAGRYRNYRNDGQDRPWVTQVTGRHGVADGVNLYGGLLIAQAYQAGLAGLSWNTPWGAMAADATLSRSQLSTTGNANGSSLRFSYSKTLSGTNTAIRLATLRYSSSGFWNFADAVNAGPAETNGRNGRFGLYSLLGRERPRGDFSVTLSQPLGGYGSLYVSALRRTYWGSSRVDQQTQLGYSTQVGRVGVNLDVSRTENRRSTEHQVMLNLSIPLYGATSSGVVTGSLARTGSAPVQQSVNYSGMSGERDQYTYGLGVQRAGTSAQYALNGSWSGTYGEVSGQLTHGRSYSQYQINGSGGLVAHAGGVTFGQYQAGTIGLIQAEAAAGAKVVNTRNAAVDRSGYGLVSLTPYSLNEVELSPQDLPLDVQLESTVEQVIPRAGAVVALRFPTRHDVAAMLVAEPGSEGALAFGTEVRDGAGKVVGVAGQGASALVRGVSASGTLEVTRANGSICRATYDLKSAGHAVHGLPRIALACAPQGGGERGARAAVQAVAQPAPISISGKDHEPDIR

SEQ ID NO: 10989 - protein, 775 aa, Burkholderia cepacia
MKILNKNTLALAISSLAFSSSAFAEDNTIELQGSDMSIEEVIVHGEIGYRNRVDTIEQVLEYDRGYFERFEPSSAGDALKRVPSVTFLSDVTESDGARLRGLNPGYTQILINGEAVPGIGQDRSFLLDRIPAELIERVEVIRSNSADRPGDALAGAVNIILRDSYSLDGAYVKLGGAIYSEEEEVKESLAAVWGGELAGGRAVIGVNRQGRLNPKQKNSLRYSDSPENNANFATEEFDNREDQSDVRDSTDTSLNFNYQKMLMDGSELKFDGVYVDTDRTEKERSFEYDNPTATTGPVNEGGNLLTDNQQLQDIEQSNASFNVAYSFSMLDGTSEVKAGFAQFESTNDNRESEIDFEDAQSVIEDERELEVFEDEEINISFSHERSLNEMLTLKAGIDLRSKTRDTSIKAGDNERDITTSGWDQFASNSPLSVANSIDDLEAIDGGLNSIEEDRMDIYALLEGEVGALQWETGVRFEKTDTSIEDKNLDQTVDNDYSQVLPSLHIRYAVTDSDRIMLSLAQSVRRPDFNYLTPATLEGEFEDNDLRGNPNLEPERATGLDLGYEHRIGRKGVMGINFFYRDVSDKIELANTQEDSVTAIEDNEPGTFVYEPQNIGDGTVQGVEVDLSMPLSILALDNTGIFVNYSYIDSEVEDELGKRAFNDQPEWVYNLGFIQDLPNIAASFGATYREQGDAYGRFIAEEITTSYGPDLEIFIEKRWPSMTLRFVGSNLLDSSKDESFNKFETIADQQSRSFDEYELETEEAGPVYRLSLRMAL

SEQ ID NO: 10990 - protein, 388 aa, Burkholderia cepacia
MKNKKINISVIAVAAFAASSAAMAQSSVTLYGMLDAGIGYTSNINGHSRFGLDGGAAGSNKWGLRGQEDLGGGLQAVFKIENGFNIATGGIGGQGPIGTTRSLFNRQAYVGLASSQYGALRMGRQLDAVTEMVQVLTGDAISASTFSTPGDVDNNDNTTNQNNAVKYISPIIHGFQAEAAYSFGGVAGSTGSGQSWSAAATYAQGGLTVAGGYFRAANQGENGWTNATAQPSFGGALGYPSSGYNGGNAFKSAGIAQVAAQYEVGPYTAGLRYSNAQYKGNDGQPSIHFNVLGALLQYRVTPALSLATGYTYVYGSAATPTQAAEGRTMASINQVSLGATYSLSKSTALYAMGAYVHAKGAQASAADFGNTSSGGNQVQVNIGMFHGF

SEQ ID NO: 10991 - protein, 418 aa, Burkholderia cepacia
MGSNIHGISCTANNYLKQAWNDIKNEYEKNQTYSITLFENTLVCFMRLYNELRRKVNEEDTPCLECESLEKEFEEMQNDNDLSLFMRILRTNDTQIYSGVSGGITYTIQYVRDIDIVRVSLPGRASESITDFKGYYWYNFMEYIENINACDDVFSEYCFDDENISVQPERINTPGISDLDSDIDLSGISFIQRETNQALGLKYAPVDGDGYCLLRAILVLKQHDYSWALVSYKMQKEVYNEFIKMVDKKTIEALVDTAFYNLREDVKTLFGVDLQSDNQIQGQSSLMSWSFLFFKKQFIDSCLNNEKCILHLPEFIFNDNKNLLALDTDTSDRIKAVKNFLVVLSDSICSLFIVNSNVASISLGNESFSTDEDLEYGYLMNTGNHYDVYLPPELFAQAYKLNNKEMNAQLDYLNRYAI

SEQ ID NO: 10992 - protein, 527 aa, Burkholderia cepacia
MWTARTIFAPREDASLRRRVGVSPAARRGRRVGSQHKKRSAMTQHRSMKRVARAVVLAWGLPMLAGVSIAGAARADDAAPAAPAQAPLAATLAQQATTPNALVNADATQAVLPQPPMSSQAKSKGFIADSHFDVLLRNYADVLDAKGGPHRHAWVQGVMANFESGYTGGLIGFGVDASIYAALKLDGGAGGGNMVHVAKGGGGSNQLAWAFPGIYDVKARISNTVIKYGLQAVDNPFMEQHDNRALPPTFLGATIVSNEFKNVMLEAGSFTKTNARGHTTLTNLTTQYGGTRVDRFTYVGGTWDYSQTGSASFYAGQADDVWRQYYGSVKQSYGSPQTVKWTGFGNFYSTHDTGDARQGKIDNNAYSLSLAAQHGPHELLLGYQQVLGDQFFDYLNETNGIFLVDSMDVDYNAPHEKSLQLRYTFYGKEAGLPGFKAMVWGVTGWGADGSASAALDPTRSSIYWKDGAPVQGRHHEFGFIPSYTIQSGKLKDTKITFIAMWHVGSAHYSDSTNQEYRLVVNVPVKVF

SEQ ID NO: 10993 - protein, 386 aa, Proteus mirabilis
MVVKSVCVGLFGVCSLAQAQNSVTLYGVLDEGIMYQSNVAGRKRVSLDSLSGVMGSRWGVTGVEDLGGALHAIFTLESGVNLNNGQAAQGGLLFGRQAFVGVKSDNWGSLTFGRQYDMIFYFPEPLTAEALVGGAPAGHPGDGDNACNTVRLNNSVRYMSADIRGVNFGGEYSFGGVAGNFTSTSGYSVGAGYTNGPLKLGAAFEYFKNPTAAPSTGFFTSYRTGGSPLQGALNKGYVPAKAYQSAVVGANYTIGPVILAASFSNVQYANLGPSLAEGTAIFNNYDVGIMYRFNPTWTVAVSYDYLHSNGVQNAAGHIIGNQHFNQVTISTDYFLSKRIDVYFGIGWQQASGTSSLGTPAVANIANMNDSSNNRQVLARAAIRHKF

SEQ ID NO: 10994 - protein, 762 aa, Proteus mirabilis
MAYDFAMQSSARRARHPLAAACALLCASAALAQEPGQAAADAADVANAGDADTQLLAQAASGARTRAPALKEMVISASREVQDPDTLPMSIDVIDAGRMEREQASDIREMVNLLPNVEVPRAPARFSLAASPAGRDQNSGFNIRGLDGNRVLMLVDGVRLPRSYSFSANSFGRDYLDLGLVQRVEILRGSTPALYGSDGMGGLVNFVTVQPDDLLGKDKRIAGRVAAGYDGSDNGRKLGATVAGRASPEWAWLLSAGLGRSHALENMGTNNVTGAARTTPNPEKDRSESLMGRLVFTPSAVQKHVFTFENVDKRADYALLSARSATVANSDSRTDMKRWRASWQGQWQQLGTALADELQLMASYQKSDAREFVTETRIGLPYRERDVTYDEDAIQLHAQASRLLRWSSSASGKFTYGLDYLRNKVVNAQNGITPPVGESFPLKRFPDTTESATALFAQAELHNGPWSVTPGLRAEHYSIKPRQSGFVPAVVSNSDSALSPKLGVMLQASPVWSVYGNYAAGFRAPNAGQINAFFENPVAFYRNIPNPNLRPEKSQTFELGLRGRLDRLRLDAAVFTGRYKDFIVDQQLVAGQPGNAANPAIYQSINVGRARISGFELKADYDWGRWAGGDWQTRLAYGYTDGKDTQSDKPLDTISPQQLVLGVRYERSAVGVQFNVSHWSGKKAGDVSNGSAAWLSPSATVADLSAQWRIRPDLRLNAGIYNLTDKKYWRWADVRGLAASTAIADAYSQPGRHVRVSMVKDF

SEQ ID NO: 10995 - protein, 672 aa, Proteus mirabilis
MKLKRHPLAWAISLALVPAAWAADPVELQSVVVSASGLAKQSHEMTTPVAVMENDELVLRREATLGETLESLPGVRSSSFGAGAARPVIRGLDGARVKVLSDGVELLDASTISPDHAVTSEPLLAERIEVLKGPATLLYGGGAIGGVVNVIDKKIPTRVPEKGYEGELELRANSVANEGAGVFGITAGSGNFAVRAEGTKRQADPYEIPGSPNKQEGSYNDTDSFNLGASFIGERGYIGAAYGEQNNRYGLLAHEHADCHTHGSDWHCGGHDDDDDDHDHDHEHGSVPYVDMRQKRWDLRGELSDPLPGFELARLRVGHSDYQHKEIEGGEVGTRFNNDATDARLELTHQPLFGWRGVLGAQTLRRDFEALGEEAYVPQTLTRNHGLFLLEEYTAGAWRYELGLRHEWQDIDADGRPDTDHSGTSMSAGAVWTFAPQYSLGFSLTRSQRLPSAEELYANGPHAATRTVELGNVDLKEETSHNAEVTLRKFAGRTTFSLSVFRNEVDDFIYAADTGNDIGGGYREIEYRQQDAVLTGAEGEVRFQATDATAFTLFGDHVRGKLRGDGGDLPRIPADRLGVRLDQSFTPALNGQLEFYRVQRQDDLADYETETGGYNMLGASLGYSGSLSQTDYLLYLKANNLLDEKARQHTSFIKDEVLLPGRNLTVGVRLAF

SEQ ID NO: 10996 - protein, 470 aa, Proteus mirabilis
MIRKSACSVAALLALAGATPAFATNGMNLEGYGAKSMALGGAGMAFDTGNSAVMNNPATLGFMKEGVEEIGLGLRGLHPHIEIENGGISDKSDATSFFMPSISYMRRDGRITWGAAMLAQGGMGTEYGDDSPMFAFGTSMMGTPGVALSGKDIRSEVGVGRIMFPVAYHLTDDTTIGASFDVVIANMDLQMDMDGAHFAQMMGGVGGSVGGSMAGTLQSMMPTMVSDINYTRFDFSNDNPFTGKARGFGTGLKFGITHKFSKQLTFGASYHTQTRLSDLETNQAKLSFDGEGPAFAGGAVSVNGKIKIHNFEWPATIAAGLAFQPNDRWLIVGDVKFIDWSAVMDTFSTTFTADASDPYFGGQTLDVSLDQDWRDQTVWSVGVQYKATEKLALRAGASFANNPVPDQFLNPLFPAITTNHYTCGFGYKVNDATKVGVAFSWAPRVEETNGDQTVISHSQTNWALNLVHEL

SEQ ID NO: 10997 - protein, 374 aa, Proteus mirabilis
MITMKLRVLSFIIPALLVAGSASAAEIYNKDGNKLDLYGKINGLHYFSDNKNLDGDQSYMRFGLKGETQITDQLTGYGQWEYQVNLNKAENEDGNHDSFTRVGFAGLKFADYGSLDYGRNYGVLYDVTSWTDVLPEFGGDTYGADNFLSQRGNGMLTYRNTNFFGLVDGLNFALQYQGKNGSSSETNNGRGVADQNGDGYGMSLSYDLGWGVSASAAMASSLRTTAQNDLQYGQGKRANAYTGGLKYDANNVYLAANYTQTYNLTRFGDFSNRSSDAAFGFADKAHNIEVVAQYQFDFGLRPSVAYLQSKGKDIGIYGDQDLLKYVDIGATYFFNKNMSTYVDYKINLLDKNDFTKNARINTDDIVAVGMVYQF

SEQ ID NO: 10998 - protein, 742 aa, Proteus mirabilis
MSKKFRAKVLAVTISTILLSTAFNTAASACPPYIPAGSTCDAIIASDGKAVTLASDLYVTEGNGLTYTGSTPFVAQYIRKNITVVGENAYAIYADGNTFFNNNINLEKGINVISENGTAIKIDGSFKQPAVPNIGISIKDGSTVKGKENAIDFSEAKTALRIDVNGNVYGNIIGNGLEGNKVNFAYQSGAQQGLFDGYVISGVEKIENWGNLSIIAKDKTIFWSGDFNNKKNAILNFKIGNSANLNTPLLLIEGKTVFNTGSKALFSYVGSNINDIVNKDIILIQSNGGMSGTVEVGQGGVNAVSDLSPLLKQIDSWITTTDPVVNGGIQGNQLVVRYGVNYEGGDNFVNIAKQGGISEQRLQAASYIVNYALSEYNKTQSVRSGELLALLTSAGNSNTGDDGANSSVVDNGSNGIARLVEQLTPNAEGSEVRAALRVVDKMRDQANNRSFYLRNQETATPWNFWAQTLYTHGRQGNEADIFGYQTNAYGINIGMDRRFRDEALFGVAFGYQNSHININGYGNTKDVNSYEAMAYTGWFNDRYFINGNINMGYNKNSSTRNIGSLNGYQGNTKAEADYNSLQMGYQASAGITFDLDIVKLQPRVEYNYQWFRVEDYAESGSPASLEVDRQSYSVKHLGAGFTAFNTYDLAFGKFTPSLSLMGYRDLNDSEVITETAGLVMDQGKGKGRFTITGDSIGNDIFEAALKSSLTLKNNIILDGNLNYYKRDGYNEGYIGLSVSKYF

SEQ ID NO: 10999 - protein, 720 aa, Proteus mirabilis
MIIIFIIIFMHYLIDFDFFNKGSSIMRIKPLASLVLSCLGATSFNVFAEDVMVVTASGYEKKITNAAASVSVISQQELQTNKYNDLGDALRAVEGVDVESSTGKTGGLEISIRGMPASYTLILIDGIRQNGTSDVTPNGFSAMNTSFMPPLSAIERIEVIRGPMSTLYGSDAIGGVVNIITKKSTDKWSTAINTGVNLQESNKWGNSTTANFWSSGPLIPGSLDMQVRGSTTQRQGSSITSLSDTAETRVPYPTESQNYNIGARFDWKASANNTLWMDLDTSRQRYDNSDGQLGSLTGGYDKTLRYERNKVTLGHDTALTFGTWKSSLNWNETENKGRQLVSSALTPDQAWRAGDDRELKNTNVILNSVLLTPLGESHLLTVGGEYWDARMKDGVVLASSGEKFHQKSWATYLEDEWHILDSLAFTVGSRYEHNDVFGGHFSPRGYLVWDMTDEWTLKGGITTGYKAPSLSQLHNGISGVSGQGTINTVGNPDLKPEESTSYETGLYYDNGNGFNANITGFYTEYRNKIVSYSIDDNTSSYTNSGKARTDGVEFATSFPLWLDNLSLSLNYTYTQSKQKDGDNKGAPLSYTPKHMANARVNWQTTDDLNTWLSARYRGKAPRFTQTYDNLSAVQQKVYDDKGANLKAWTVLDMGLSYKLTKDLTLNTAVNNVLDKDFSDVKLYQSGRSSTYAGDYFQTAQSTTGYVIPGRNYWMSLNYQF

SEQ ID NO: 11000 - protein, 447 aa, Proteus mirabilis
MVMNQKNLFTRSALAVAVAIISSNAGAAGFQLNEFSTSALGRAFSGEGVVADNAAVGSRNPAAMTLFDRPSFSIGAVYINPDVDITGKSPVTGKSTNAKNIAPTAWIPNIHFIMPIDDQWFVGTSVTTNFGLATDFSNNYEAGPIGGKTDLTTLNFNLSGAYRLNDHFSFGLGLNAVYADAKIVRHAGALSYMLDQHPKMPKGLVKPTDEVANLEGKDWGYGWNAGIMYEVDENNRYSLTYRSKVKIKFKDGDYKNDVPVQLGQMLQKAGVNLPATGGQTIGGRLDLNLPDIWEVSGYNRVAPKWAIHYSLAYAGWSEFNELKGTRKKDGAVLFSKHEGFKDAYRIALGTTYYHDDNWTFRTGIAFDDSPIPAENRSISIPDQDRFWLSAGATYAFNKDASVDVGVSYMHGQKVTVKEKLSEALPNAYEFEAKGSAWLYGVNFNYAF

SEQ ID NO: 11001 - protein, 366 aa, Proteus mirabilis
MMKRNILAVVIPALLVAGAANAAEIYNKNGNKLDLYGKVTAEHDFVTSGDNTNNGDATYAQLGFKGETQINDQLTGYGQWEYRAYASSAESEQGANNSNRTRLAFAGLKIADAGSIDYGRNYGIVYDVESYTDMAPSYSGMTWANYSDNFMTGRTTGVLTYRNTGFFGLADGLNFGIQYQGKNDRNNAATSNGDGAGYSLGYDFGEGFSVIGAYSNSNRTLRQKLDDKGDRAEAWAVGAKYDANNLYLATVYAETRNMTREADDSFANKTQNFEAIAQYQFDFGLRPSLSYVQSKGKNLTARGTFDGGDADLQKYVEVGAYYYFNKNFNVYVDYQINLIDNDAYARNVGIVNGRDDQVALAATYQF

SEQ ID NO: 11002 - protein, 353 aa, Proteus mirabilis
MKKTAIALAVALVGFATVAQAAPKDNTWYTGGKLGWSQYQDTGSIINNDGPTHKDQLGAGAFFGYQANQYLGFEMGYDWLGRMPYKGDINNGAFKAQGVQLAAKLSYPVAQDLDVYTRLGGLVWRADAKGSFDGGLDRASGHDTGVSPLVALGAEYAWTKNWATRMEYQWVNNIGDRETVGARPDNGLLSVGVSYRFGQEDAAAPIVAPTPAPAPIVDTKRFTLKSDVLFGFNKANLKPEGQQALDQLYAQLSSIDPKDGSVVVLGFADRIGQPAPNLALSQRRADSVRDYLVSKGIPADKITARGEGQANPVTGNTCDNVKPRAALIECLAPDRRVEIEVKGYKEVVTQPQA

SEQ ID NO: 11003 - protein, 648 aa, Proteus mirabilis
MKKLRWRLLVSVCVLNGAYFSTGAAAQDSVDASEELDPVVVYSFNNDRFAVAADRNTSIYVSRQAIEAAEMGTLRDVFAEDASVTVGGGIPIAQKIFVNGVDALNLNMTIEGAMQNNRAFHHVTANAIDPALLRAVRVDAGIAAADSGPNALGGSIAFQLIDALDLLEDGETMGGKATLSVDTNGNTFSQALTGFAEHNGFDILAFAKNAKGQDYTSGGDWEIPGTGANLQTGLLKGGYTSDTGHRFEVSGMMLKDKEERPYRANFGSLTNKPNDTIRLYDTTRKSFSFRYEHLEPTDLYDPEVVLGFSENNIDVPVPYGSKGTSNTLNGKVANTFHFSEDIGFTTGFDFYRKTANYEGPSSDLEEVANNFGGFGQVRWTPLSALKLSAGLRVDHQRFEGLGDFDTSVTGLSGNGSASYEILEGLKLKAGYATVFGGIALEDNYVFDASWDYSGIKPSRSHNITTGFEFERSGFLLSGEVFRTDISDARSKVENVDVLTEGFNLAAGYKWSSGAAKITYSNTRVEVDSDAASSDLATDFAAPLGQVIAFNVSHKLENYDLTVGGDVQAALDYDTGSSDSNRTIDGYAVVGLFAEYQPEQIDGLKLRFEANNIFDEDYSDRGTYGGDYQTVNTLKEPGRSFSLTANYRF

SEQ ID NO: 11004 - protein, 272 aa, Proteus mirabilis
MKFNAFALAAAVGVVATPAFAQTVPAQTAPATAPAAPQVMVSAPMTAAPVPSVNIHAPASGRCGLFQTCANTRIGLGKGDFIVRLSALGVLPEDRDSSLSLNGAHLGGRVKTTRQVMPELTFEYFFTDNLSVDLIAASTRHEIAAEGVPGLGKVDVGSAWVLPPTVTFAWHFRPHKRFNPYVGVGATLAWFHDISPANNGLTQKVNIGVTGGPSVNVGFDYQVVGNWFFNFDVKQMFMRVHVWAQDSAETTKITAHDSLDPTVVGAGIEYRF

SEQ ID NO: 11005 - protein, 363 aa, Proteus mirabilis
MKKNLIGFAVASAFAFAASTASAAEVAYDGAWYALPGVNVMHADSDLEAEPRSVGGFLKFGKEISEHWDVQIGLSHNSADSDLQGVSGKYRQTLFGVDALYFFSRDKFRPFLLAGVGAGRNNVDYTSDVTGADLGDKKTSWMANVGFGAQYLFNENFGLQADLRQVWSRAEYAGSSGIIDTHTISNTYLNLGAIFRFGAPKPAPVVEPTPEPVAVAPEPEPVVEPAPAPVGPAEPAFEKVTLSSEVLFGFDKDNLKEEGKAKLNADVVEKMKAHPEVELVLITGHTDRIGDETYNQKLSERRANTVKQYLISQGIEESRLHAVGKGESEPVVECAGVRGKKAIECLQPNRRVVVEIEVQRASE

SEQ ID NO: 11006 - protein, 215 aa, Proteus mirabilis
MVYGGITRPIGEQNMKKLALAAMIGMLSAGAFAAQGDILARFRVIDVDPSSSWDNSAVAGLNVEGKSAVAPELDFTYMITNNIGAELILGTSRHKVTTNAFGDVGKVSVLPPTVTLQYHFTPEAAFRPYVGAGINYTRFYSNGLQLPNGTKLDVKNNSFGPALQIGADYAVNKSWFVNVDVKKLWVKTDVSAAGTKLGTLKLDPWVFGIGVGTKF

SEQ ID NO: 11007 - protein, 288 aa, Proteus mirabilis
MDILQSSSAAPLAPREAANAPAQQAGGSFQGERVHYVSVSQSLADAAEELTFAFSERAEKSLAKRRLSDAHARLSEVQAMLQEYWKRIPDLESQQKLEALIAHLGSGQLSSLAQLSAYLEGFSSEISQRFLALSRARDVLAGRPEARAMLALVDQALLRMADEQGLEIELGLRIEPLAAEASAAGVGDIQALRDTYRDAVLDYRGLSAAWQDIQARFAATPLERVVAFLQKALSADLDSQSSRLDPVKLERVMSDMHKLRVLGGLAEQVGALWQVLVTGERGHGIRAF

SEQ ID NO: 11008 - protein, 937 aa, Proteus mirabilis
MSQSLRMRSLLAMGASMTVLAAVAAPAFAQTTPAPQQGGGNVLEELVVTAQKKEEALQDVPIAVSAFSQNSLEAQKIDGGPNLQQAIPNVSFAKSNFTNSFNFAIRGIGNKAVGVSTDGGVGVHENNAPLQSGNLFDAEFFDVERVEVLRGPQGTLYGRNATGGVVNIITAKPVDTFEANVRAEYGNYNSQKVRGMINIPILGDKLAIRAAGNYLKRDGFVTNTFNNHKVDDRDLYSTRVSVMFNPIDSLRTNFMWEHFKEDDSRARVGKQLCTKDLGPATVGGVASGSARNFLTQGCLSASLYGDSAYGTVNTSGTLTGELGNLVGFTSGDANAGDTASHNLREIESLLDPIYRSKSNIYQFNLAYDLTENLTLTAMTSYSKGDVYTKLDYNRNVSTVPFNSTPFTPGGFFADPQVGATNKFTTLDVSSGWSKQWSQEVRLQSNFDGPLNFNVGGIWFDYKTVTDYYVIGNSLTLSALALNYQNTGNPSCNPVTLPASCIGIDANATPDGSGHNYYDNRSPYHLKSNAIFGELYWQANEKLKFTLGLRRTHDDKIQKNYETVLLAPGIGLEQDPTTPQNRTVFNELTGRFGFDYKLSDDNLLYAFYSKGYKGGGSNPPAAAGGAGTQATFAPEFVNAFELGSKNTLMGGSVMLNATGFFYDYQGYQISKIVNRTSVNENVNATVYGLELESVWSPIHNLKLNANIGYLHTKIGSGVSSIDTMNRTQSNPAYQVVKAGPSIPGVAVGSNCVVTAAGIATVLSINPALGATVPFACGGKAFYQGFLQLQGVPAPFAAAAANAMFNYGSGYSIEGKAADLSGNELPNSPHLTASVGAQYTWDFADGWSATLRGDYYRQSKQYTRVYNTTYDQLKPWNNANITLKIEKPEWGLQIDAYVKNLSNKTPITDAYTTDDSSGLFTNLITLEPRLYGVSIQKSF

SEQ ID NO: 11009 - protein, 463 aa, Proteus mirabilis
MENKFFKVSAITAAMVGALSAAPAMAEDPIGPEYSGEVSEFFSESTISGNLNFMMRARDRGNVDANGNNTKKVTNLDHGSVFANLGFNSGYIGGVVGADVVIYSTFDMWNNGGPDHEMNFWGVDNPYDKNPSDSGCSGTWDSDCTDNGVSFATASAKFKFGDSATAKLGYFQPSVPSSLGVNWSFAPGTYMGGEVGATFGDLSLGLVVADEYKAPWFKETYEFQTTNGEDAGTLYSIGGRYAMQNGISVDVGYGALTDGDRKNFHVKVKGTTDGGLYWSPQLYVVDDDEQYDSTAFQAAMLTAFSSGQYSYRAEATYTAAESVDSALAGNMAYRLTSQYGGSNGAYDIWWNNRSDFNHDGEIAFFLSAARDFSDIGGKGFSAGVNGAYGFGSEAQGFEDLTEYSYSFFANYAIQAGALKDANVSFYYTNYYNDTDAPNWTGYTNLFQDEEDFKLMLTIPFSVK

SEQ ID NO: 11010 - protein, 859 aa, Proteus mirabilis
MRIHALLLGAALAALPAAAQTPSAEEPPAAGVLTRAPELLAFVPAEYPPDAEEKGIEGSVELAIVIDERGEVQQAVVIDPGPHPGFAPAALHAVQQFRFRPAEIDGAPAPVEITYRYDFVLRRAPPPPPAPAPLVLSGRVIERGTRAPVAGASIDVSGVAAETDADGRFEVRGVAPGVARVRVVAPEHEPLQLEELIEAGKRREVEYRLSRRSYDPYESVVRGERPRREVSVHTMEVEEIRTLPGTQGDTLKVLQNFPGVARSPFGIGLLVVRGSEPSETNVYLDGIPVPLLFHFGGVTSVVSSDVIETLEFLPGNFAARFGRALGGTVDLRTREGRDAFHGAAQLDLFDGRLEIEGPVAGGTGFVAVRRSWVDAVLALALPRVAPDTADELRVAPRYWDYQAKLSRPALGGTVTLLAYGSDDKLEFVESGESSGRPTFYLSTVFHRLGARWRRPLGAANNDLVLALGRESFDVLQSSNFGVLTEVRSLTVRDTLAWRASERLTLEAGVDAILRSLDYSIYAPPLSAPGTIGEFDEERPETTVGESTRISWLAPGGWVEADWRATGRLRLVAGLRVDADSRLRGRRAWVDPRASAFYDLRPGTTLSAAAGLFGSAPQPQDATETFGNPDVGPQRALHLALGVRQALPWSARLEVTGFYKRLWDLVVVTRATDENGDLQQVSNEGRGEVLGLEVMARRELARGLFGWLSYTWSRSIRQDDPSMPSYPEWHPFPLDQTHIFSLVLSYRLPGDWILGTRVRGVSGNPYTPFEGSVYDADSGRYQCIPSARRYAGRLPGFFQADARVDKRFVYGSWMLSVYLDVQNVTNRENAEFRFPSYDCSQTYAIPSVPVLPAFGLRAEW

SEQ ID NO: 11011 - protein, 3122 aa, Proteus mirabilis
MKKSKILRKFLTTASLCGTLFTSSNAAGATIPNLGSVSLSTGAGLVGGVFNNGDIIQIAVGGIGIKISADKANAVVGGINTLIALPAFGGVEVSQNVSIGPLSATVGLTPNFGPLKFISNNVTSIITGVGNQTFNNIDFAGKNSTLQINNGLNITTQIDNTVAGNNGIITFAGTGTISNNIGLTNSLSQINVGNGEAQIYMPGAGNSIINAANINLTNNNSILTLFDGNVTTLTGNINNTTGVDGQGILNLAHDLASDNIITGDIGNIGSLAAINVLLGSATLNSTILKATNINLQSNTSVLNLDDDIIVTGNINGANGVNGTLNFIGNATLNGNINNLNILQCSGGNGKILDLQGNITVNSIVFADSVLASGTISVNGLLNVGGITFNNSNASGGTLIINTENTINVALLNAIKAKIQINANLTINDPSAGDIGDIRIANNTTYTIDAANGNVNLLNNGAKIIFEGADSELDLVNTSNINDRQFTFYNNLNKSGNDEYGIVRIGATTKDLTIENNGGPYTIGQDNTHRLKEFIVDGAGNIVVDNTVFTKLLSMNSTGQVTFNQALDLGAGGNIAFGKDGTLVVNGVTGSVTTSANNQGTLTINSGNINGTIGSNGSSLKLVNIGANLVTFSANVFAPVVLTNAGSALTLADGVTLTGAVTTNNNTKGILSLGVGSNVTGQIGANGAALEKINIGAGASSLGSNIYVGSTVLTNQTSVLTLNNNVVVNGNITTTAGNDSGKLIFAGDGSVISNVGANGAALEEVIFNGVDNIGGTANGAVFNVANIAANATVTELMTGDLVYNAAGKVTATGGLTGNIDFQNNAGTFNLGAGSTLTGTVTSTGGVNGTLNVSDAGIITGNIDNLNILEFSGSTGTTLDLQGNTRVNSIVFTNNAAASGTINAGGELTLGSLTFNANAVGDVLVINAPSTINGAILNGLKGKIEIKANLTINDPSAGEVNEIDIADNTTYTIDAKNGNIDLLKNGAKIVFEGADSRLDLINTSVTDDRTFTLYNNLNKSGNDEYGIVRIGATTKDLTIANNGGPYTIGQDNTHRLKNFIVDGAGNIVVDNTVFTKLLSMNSTGQVTFNQALDLGAGGNILFGADGELIVKGVTGSVTTSANNQGTLTIQSGNVTGTIGANGSSLKLVNIGANPVTFSDDVFAPVALTNAGSALTLADGVTLTGAVTTNNNTKGILVLGAGSSVTGGIGGNNAALERVTLGAGASSLGGNIYSGAVALTDQTSILTLQDGAVVNGGITTTAGDGKSKLIFAKDGAVTGNVGAVGSALEEVVFNGADNIGGTANAETFTVANAAANAVITGLATGTLKYTDTGTITANGGWTGDIDFNNKAGTFILGANSTLTGAVSSTGGINGTLKALGSGSITGVVNGLDIFEFSGSNGTAFDLAGNTTVNNVLFTNSNAASGTININAGLNSGQITFNMGNANGGTLVINAPTTVGDIVNAANGNIIINADFTITDPDAGGIHNITIKDNTTYTIDSINGNVDLLANGAKIIFEGADSELDLINANDRTFTLHNNLNPSNAQDEFGIVRIGATKKDLTIANNGGPYTIGQDNTHRLKNFIVDGAGNIVVDNTVFTKLLSMNSTGQVTFNQELDLGADGLIVFGDVGTLIANDDVTGDIDFHGKAGTFELDDGATIDGSVLGTGGVAGTLNFIGDGNVTGNIGTDAANSPATINIQGDNTKNITIANDIFVGNINFTNGGVLQLSGNLTTPNIDFGAKGGTLEFNGNNTYNLNAVIANGQNGILNVFTTLKSTDASIGTVKTINIGKVGTPQNFTVQVNNGNLALLSSPNSSINFGDADSQLILSAPIDQTVTFANSLNGIKTGGGIVTLDGNGNNLTVSGNNGATFGTVGNELASLNIKGKVTVTNNLDVQNIQQLNINNGAVFTDQSLTSAKIANISIGEVTGSATYALDAVNSDFDLNTGGIVFEHQDSVLELKNSSNANDRTITLTAALDPGNDQFGIVNLTTDTNKLTIDNNGNAAYTLGTVNHRLKQLTFSSTGNGAIALNVGINVENIALNVKTIELGVVNANVLFNKNATYTATGDINGNVDFQGNAGVINLNDGIKIDGIVTSTGNVNGTLNWGGAGEVTGLITNIAMLKAGAGDVLLSAGGNYSITEIQGNGNNDLTFAANSNLTGGINTSGGQAVNLVFQGGGSVSGSVGSNAAVGDITIQAGAVNFGSTVKSGNVILSNGATMQVNNNVTATDISGENANDGTLKLNNLAPINITGTLGNNNTIGTIEVANNDATVTGGLKAQNINFSNAAQAATLTLGAAAQVTNITTAGNNIHTLAVTDLDTGNGVIGAANNRLKAIELTGNGTVTVNSKNFYSGITTANNGQGNVKLNIDGGIVYDLGSKLGSLASVQVSGNSTVKGDVYSKDINVDAGKTIDFDRGNNNTNPKNLAVPGAIVDLDVLPRSLSLFNYLTDIKADNLNFADATTTANFKDAVLIDAPINNGGTFKFNENVWLKQEITNAKSIEIASNKFMLLEKNIKADTLIADEANLVLLNNLEMNTNLNVRDVVLDVATYELKYTGNVTHNGLLTIITHFDTALQKGGHILVGNGANVDMSGLDNLIVKIKSRSDITKITSNTKHQVVALEAGGAFTPAPQAKVTIDASGEQNRFVKWVSDANGLVLLANTDNEGGDGGNGGDNGGGDGGNGGGNGGGGSGGGGNSGGGGAVSIFDPSPILDDTKNNQVASGIANQLINNVKGFGNNTDSGKLLNDLGLISPSRVSEALDRLGHRTNTNGINEGVGEFNGIEIEDLLTDIAINMDNLTSERIGNRLEELGDENTLSGQNEPNSNQNRRRRTSTTNNQAAVAAGDEDNIGTGIWGIPFYGKATQKSKNGSSGYKSNTGGGIIGFDYNIDNSIVIGAAYTMADSKVRHKNDKNGDRTKAKSNIYSIYGLYNWLTNNFFVEAIGSYGRNKVKNYEKRLTSTNDQTAIGKFTNTFYSGELLGGYNYLMSHLTTITPMLGIRYATFKNNSYKENSTTFQNLSIRKNSYNKFETILGLKGVTNYLVQDIIVKSELHGFINYNFKGKLPNIDARLDGIDGPLTTVRFKPAKITYNLGGGISTKYNMMEFGIRYNLSLAKKYMANQGSLKIKVNL

SEQ ID NO: 11012 - protein, 780 aa, Proteus mirabilis
MADRSNRVAIIALALSGAAFFGGVPAVAATADAGVQAEPEGADIIVTARRREETLQSVPIAVSAISAATLERRQIDSVAQVGEAIPNMTYQTGAPTGTGASTPSVFIRGIGSAETSLGTEPGVGLYVDDVYIARSVGSVLDLVSVDSVQVLRGPQGTLFGRNSLGGAILIRSRRPADRLSGSVELKTGRYDRADIRASLDVPLSDTLRTSLSGMRERRDGYVRNLDGDKANGNIHREAARFVAEWQASDMLKIDVNADMTRIRESAPPSVLLGLVPTIPGTPVPSSIQEISNLQAGCFGGSVLADSGNPRCIDQGAILGPFRTLGGYSTDNAIFDSQGSRPFGNASRIDIRGVSGRLEWTLSPELSFKSITAYRTLDAFWTSNSDHTPNPGIETKNDQDQKQFTQEFQLLGKTGSLDWVLGAFYMHETGDALNVVAFPQVIFRSGGGFKTDAIAGFAQGTYRITPALNLTLGLRYTDERKKYDTLANQQIIGVIADPVSRTFVDLRATPIPFVTGSTPNLAFTEFTPHANLSYDWSSDLMTYVSYSRGYKSGGYEQRLAPGTPTIPSFRPEYVDSYEAGLKATAFDRSLTISAAAFHAKYKDLQISVVDGPAPTLTNGGDATLNGAELELGWRPVRGVTLTGFASYLDAGYDRLTPRAIVSGIRLGSRLPSTSRWQFGGSAGFDVPLTGSLSLRPNVDWSYRSAQYLDSANERVLRQKGYTLVNGALTLASTAGWSVSLSGRNLLDRTYLVSGLAQYNIGEIEGQYARPREWALGFKYQF

SEQ ID NO: 11013 - protein, 1037 aa, Proteus mirabilis
MKTQLRKTALSLAIAACVGVSGAAIANETTSAIKGQIMGPNGNPAQGTKVTILHVPSGSVKSTEVNAAGYFTAKGLRVGGPYKVVVDSDVYADQTFNNIILNIGSDYPVNVTLAPQSNIEQIVVTGRAISTMSGGTGPASTFTLNDLENQPAINRDLKDIIRIDPRVAVDDSRGSINCGGGNPRFNSLTLDGVRMNDNFGLSSNGYPTIRAPFSFDSIEQVAVELAPFNVQYGGFTSCNINAVTKSGGNDIHGAVFYDYTNDSMKGDKIEGEKVDNGDFSEKRYGFNVGLPLIEDTLFLFTSYEKLEGVAQFNYDPLGSSVSSADLERIQQISQTVYGYDAGGMPASSPVEDEKILIKLDWNINDSHRANLVYNYNDGYTLSQSDTGSTRLSLDSHFFEQGAEFTSIVGSLYSDWNDSFSTEVRLGKSELDARVNSLDAASSFGEFQIEATDGGTVYLGPDDSRQSNDLNYDTITAKIAGTYYLDQHTITAGFEYEELEVFNQFVQHTEGEWRFASIDDFENGLASRVYYNNAAGTNNPADAAANFSYSQNTFYVQDEYSFSNIDASLTFGLRYDSYSSDDKPTLNQNFTDRYGFSNQSTFDGIDLIQPRVGFEWYATDALEVRAGMGLFSGGNPNVWLSNSYSNDGITNIGLRMNNVDLFNTPNVNGGKPGFEVPQELFDGVAGVVPGSGDASVKAVDPGFDIPSEWKYSLGATYTTEDEYVIALDYLYTKKRNAAILRDIALRPSGDVSFDGRPLYESIEGRDGDLLLTNVDGSSGQSSVISAAISKAYDNGIKVQFSYAYTDSDDVNPMTSSVADSNYGNVATANPGNPGVASSDYEIPHRFTLNLGYTHEFFNGYNTRFNLFGEAYKGLPYSFTFNGSDGAFGDANSNRSRQLLYVPLENDPNVIYNMSAAEITEFNEFIASQGLKRGEIAGRNAQNADWFVKFNFKLTQEIPGFMDGHKGEAFFVIDNLTNMLNDDWGVLKKGPFVGSRMIETDIDAQGRYIYSDFNPNNANTTVQRDASLWEMRVGVRYTF

SEQ ID NO: 11014 - protein, 860 aa, Proteus mirabilis
MPYRQLLIVSSSLLALVPAAAWAQAAETTSEAAGGIEEIVVTAQKRAQNVQDVPIAISAFTANALKERAVADVASLSNIAPNVTLDAGTPFSGSSSVLSAYIRGIGQNDFAANLDPGVGVYLDGIYLARTVGANLDLPDVERIEVLKGPQGTLFGRNTIGGAISVVTRDPGREFSFRGDITTGRFNRLDINASVDLPITDTVGLSLTGSSRKRDGYLKRIPFPNAGNFATDPNAAFRSNGYDSSSKEGGQSEWSLRGKLKWEASERLTVRISGDYLRQDQQGTANKLLATTEDQPYVFAPTADRALVIPGLGATALYDGASGLAPNGFNFAGLYNFCIGSTPGEIAARNATALCGARGTPLNPGQVIGGLAGVNVDADPSNDRLPFDGRYLLADKDKSYATGLNFSRMRVWGLSMTLDYELSDAMSIKSITGYRRLRWETGLDADGSPVRALEFSFSLRNWQFSQELQLTGHAFDEKLKYVVGGYYFKERSFLSDYVTFDQGLLQIYGPNLLHTKNYAFFGQVDYELSPLISFTLGGRYTKESKDFNGGQSDLNGFNYKLFNCPVYGDPCTTALGFPSPSEPLRYYVPQTQYRKFNNFAPKLGVQLHPTDDIMVYGSWSRGYKTGGWTTRLSNPLPTAASFSPEKAESFELGVKSEFFARRLQLNAAVFTTRYDGIQLNFQQGVSPTIQNAGDARIKGFEVELVAAPAAGLTINASVGYSDAYYTSVLPQAQVAPNPLQAGVFPGAPLPKTPKWKFNVSPRYEYLLPNDGALIALVDYTRTSKVWNDSERAYALLRPSTDQLNASLSYRAPGNRWTFTVGGVNLTNDRYLVSGGNQTAAGLLFGTYNRPTEWYARVGVKF

SEQ ID NO: 11015 - protein, 712 aa, Proteus mirabilis
MKLTPIYLAVITSIGLSGHVAAEQKVSLDNNENIEKIEVTGRYIQGYNPHSVSGASRLDLAISDIPQSVSVITSAQLDDFQIKDINSALDTATGVNVERIETDRTYYTARGFDITNFQIDGIGLPLTSGNNHSDEDTAIYDRIEVIRGANGLMTGVGNPSATVNFIRKRPTADNMLSLSTSYGSFNDLRLEADGSARLNDTFAIRAVAANQTKDSYLDRYQTDKDVFYLFLEANLTDDTNVSLSHSYLNNDAKGNNWGALPLFYIDGSATHYARSTNTSANWSNWQVVKNNTVLELSHFFNDNWRLRATYSHKTTDEDTELFYVFGTPDKATGLGLTGYGSEYDLDDKHDLFDVYINGDISLFGREHQLVFGLNHSKMSYIDSSLYDYSTGNGFPVMPDLNSWDGNTSMPTFKDNPRGSDVSREQQAAYFTARFNLIDDLHLMLGGRYNDWQQQGITYETKQDADDNEFIPFAGVVYRLLPELVAYTSYTETYMVQKELDINNRILDPVTGESREIGLKSELFNGNLIASLAYFDVKQTNLAKPDPITALLPPTEQRYIGIDGIHSHGIELDIAGEIYPGLNTSIGYTDFTITGDDQVSAYTPSKILKLAATYEFSSIDGLSIGMNARWQDDISREQGVVTAGFNKAGEKIITTQEAYAVIDLMAKYQFNDNLTLALHAKNVTDEKYINSLYWAQGYYGAPANYGATLSWKM

SEQ ID NO: 11016 - protein, 1121 aa, Proteus mirabilis
MNRKMKSVGMWLLLGSLSTGMAYADLSKNESEIDIVQQSGICQGIVKDATGESVIGASVIVKGTTNGTITDIDGNFSLSNVKKGDVIEISFVGYITQTIKWDGTPINIILKEDTQTLEEVVVTGYGGSQKRAALTTAISKMDDQVLKNAAMSNAGQALQGSVTGLRVINTTGQPGAEPDITLRGGATITGGNSKALIVVDGIIRESMSDINPSDIESIQVLKDAASTAIYGARANGGVILVETKSGKAGKASVNYKFKLGVNFARYGYDFCNAHDYLYYNRLGYKRYTNNVPGAASVDTQTGYGTQNDLIDVKYLTDENSHLRNEGWLVMDDPYYEGKQLLYKDYSGQLDDAVFANTALTQDHYVNITGGNDKGTYMASMGYYNEDGQIKGTGYKRFNGSVSGTYKIFPFLNVKAGATYTWSQQPSLWIGSYELFYRTRSQRPTWNPYNEDGSPASGWGTGDGNPEYYRDKLTSEDGTRKATYNFGFDLDIIPKKLTFSGNSSLYHYDYQYETFNKSYQTQTSSTPNNTRDASAKIERYTQIQVNGTLNYKDTFKDKHNLDVMVGSEYFGYNEFMMEAKTQNSPTDDIPTLNAGATRTSTTSEKTGYRIASVFGRINYNYQMKYLLSLVARYDGISRLKDNRWGFFPGVSVGWNVTEEDFWKESKISEVISNIKPRLSYGVNGNVNGIGNFDIYGIYKQIGAGNYDGATAYYNSSLINTGLRWEQSRSFEAGLDLGFFNNRLSFIFDYYNRTTDDLLTDVNLPAYTGFSSMKTNLGKLRNSGFEMEVRANILSNAKGFNWEVSANLTSVSNKVLKLPTSDKPFNQIDGYEVAAGLYNPETGETPTKWIGGYREGGKLGDMVGYVQNHIFRDWNDVKANANMVIDEVANLYGPGMANEINPQTGVTYAESNGWKPIEPGDVCWEDINKDGKINSLDRAVVGNIFPKVTGGFSTTLSYKNWSLYARFDYAVGHTIYNDLKARSLGQYQGQFNIIDKVHDTWSETNPDTDLPVFTYADQLNKKNITRSNNGTTAVDNNSSRFYEKGDYLALREITLSYSLPKKWIGKAGMQDASVYVTGQNLFYITGYDGVSPEPAVSTVYGRGIDNGRYPTPRTLLFGLSVTF

SEQ ID NO: 11017 - protein, 919 aa, Proteus mirabilis
MKKQLLLTTSLAPLFAVGVLGGSPAHADCSITGNTTGISCSSGSISSATATVGDGPGANGSATLSGVGASWTDTNEVSVGRDGGVGSINVSNGAALTTRRLALSTGSWEAGSGGNGSLVVTGPQTVWTSTGGVDIGRTAGATGSLTISNGAAAYIRNTGIYTGAGAEITIRDAGTHVEIGDPNNSSAAAWLSPSGGTVNVLNGAYLYASGIYVGPDGSNLTTMNISGRGTIVDVAERIYVGGQNGGRDVDPMNGNGILNVTDGAVVTSASIGAGMDPHSQGTINVSGNGTRLWAKANVAGNAPGNVYAGFNGNGTVVVSNGAELKADNEIRIGYDTQGQGVLAIGAASGQAAAAPGTITARRIVFGSGTGQLVFNHTSSNYTLASDIIGNGSIQAIAGRTTLTGDSSQFTGTMQVSGGILTMTGVIGAVMAVESGAVLTGSGTVGGVDAQAGATVAPGNSPGTLTVTGNYQQAAGSTYNAELVPGSTVSDRIAVGGTATIAPGAILKLTKYGTAPYALDARYTVLTAAGGVNGTYVLTGDTSVSAFYSLIANYDPNNVYLQAAQTRGFTEVALTANQRATAGVLQAMGSGGLRAGVAASPTDTAARAAFDQLSGEAFASAKTALLDDSRFVREATSQQVQSALRGPDTAVWARAYGSWAKADGNGNAADVRRNAGGVLFGADGELFNALRLGVVGGYGSTSINLDGGRGSVTGDSYSVGVYGGRAWNALAVSFGANHAWHNLSSTRTVALTGFADRLTADYNARTTQVYGDVGYTVDLGRAALQPFAGLAYVSLDTSGFTERGGAAALRSAGDNVDATFSTLGLRANGALTLGTTAVTANGMVGWRHTMNSVIPTATNAFATSNAFTVSGLPLAKDVAVFEAGLGTALNPSTALSVNYSGQVGSSISDHGVRANLRVTF

SEQ ID NO: 11018 - protein, 402 aa, Proteus mirabilis
MKFKILKKALLCLMPFCCGIYLNAAGFALYEFSARGNAMGGAVLANKAEPASIASNPALITQLEGAQIQAGVTAIIVEGSTSLNNDKRDLETGVFYLPTFYFTKQMREHIVLGVGFFSRFGLGGKYKDYGTWLPAISERQSYRMDLVTYSFNPVMASQVTDELSLAGGFEIMYASLTEEKGPGNANRIEIEGDSITWGANFGLHYKPEWADKWAAAVTYRTKTRHLASGKVTGHGLYSPATGDATAALALPDQLAFGLSFTPTERLILEAGITGVFWSSYKQLKIDYDDLSKGSSNEYKHYRDVFRLSSGMEFAVTENWDIRFGYVYDESPINPDFMDTMVPADDRHIFSTGLGYKRSNWGADISYSYMYVKDLSGTTEHGTPAKYENARSQMIGLSLKYAF

SEQ ID NO: 11019 - protein, 543 aa, Proteus mirabilis
MHVPAALWMGTGLWLGLAPATIAFDASTIRQVNAIANEDLPAAQVTSITQLSDVRPTDWAYQALQSLVERYGCIVGYPDRTYRGSRALTRYEFAAGLNACLDKVIEFAASKEDLDTLKKLMEEFQAELATLRGRVDSLEARVTELEATQFSTTTKLQGEVILSLDRAFGPSGLDTGTSFSQRVSLNLNTSFTGKDLLKTRLRSNSITSPGLRDFNGGVPGSGIISPAAALDYDNATNAPNANFFLDTLLYTFPVGDVKFTVGTSNLQVEDILSTTGTFYAPYISYFFSTPIPGIYGDADTTNSAGAGFNWQLSKNFNFGAAYINQNGPTTGGNLASDPTSGVFGADSQTTAQLAFKNDSGTFIGALAYAYRKGPDLATDLSFLPSQFGGVNFGTPRALAGLGLGSSGSDIVSTNNIGLSLGWAVSDGFTISGSYGISFGNGFGANNTVQSWTVGFTFPNLFADGNEFGFAVGQAPYVISDSRGAAFQDSGNFAFEVYYKLQVTDNISITPALYAITNAGGGLSFPDSANGDFIVPVIKTVFTF

SEQ ID NO: 11020 - protein, 388 aa, Proteus mirabilis
MKNKNIKVSVIAVAAFAASSAAMAQSSITLYGMLDSGIGYTSNINGHSRFGLDGGAAGSNKWGLRGTEDLGGGLKAIFKIENGFNIGTGGIGGQGPIGTSRSLFNRQAYVGLSSDQYGTVRLGRQLDAVTEMVQVLTGDAISASTFSTPGDVDNNDNTTNQNSAVKYISPLYHGFQAEGAYSFGGVAGSTGSGQSWSVAANYAQGGLTVAGGYFRAVNQGANGWTNATAQPSFGGALGYPSSGYNGGNAFKSAGIAQVATQYQIGPYTAGLRYSNAQYQGNAGQPSIHFNVLGALLQYQVNPALSLATGYTYVYGSAAAPKLAAEGRTMASINQVSLGATYSLSKSTALYAMGAYVHAQGAQASAADFGNTASGGNQVQVNIGMYHGF

SEQ ID NO: 11021 - protein, 279 aa, Proteus mirabilis
MNNKKSIITGTVFASLLLLSSIESFSAVNHNHIRANTSGIYIAGQYRPGISHFSNFSVKETITDTKQLVSYGKTPNSIDLKTHSNFTGPYTVKFQDNAASFSGAIGYSYPEGSRLELEGSYEKFDVKDPKDYSAKDAFRFFALARDMESENPNATKYTVMKNNGLSVASIMINGCYDLSFSNVVVSPYICAGIGEDFIEFFDTLHIKFAYQGKLGVSYYLSPKINIFVDGYYHRVIGNKFKNLNVNHVVILDQSPKATSAVATLNVAYFGGEAGVKFTF

SEQ ID NO: 11022 - protein, 311 aa, Proteus mirabilis
MNKEALAKKGAGALALLILSHPAVANNNTDTAGNVTVSTSLGLLNAESIESVYQSSEPNQKLSQLNWEANNTPIVKMDIAWDALPRLTLTAKGWSTLSSGQGVMDNYDWLTPQQTQWSDWSHHEKTNLNYANEIDINANIWFLKQYNYRVGPILGYQENNQSWTACGGNFNYNNGANIFTAPDGIVGVGYKQKFDMLYIGLAGSYRYQQLEFNALLKYSNWVNANAYDNHYNRKVSFKDSSKNSSYYSAVIDVGYYFTENTKFFVEAAWNQYSEGRGETQTLNYATGNVGSSKSGIEYQSQTLTVGFQYKF

SEQ ID NO: 11023 - protein, 165 aa, Proteus mirabilis
MGILGALGLSLSSFSASADFYAGALVSYSNAELKSSSSESVKEGSPFLLSAQAGYFFNDYIGLEGRYGTSVQRDSGLAVDSALSGFVKLNMPVSERVALYGLAGYSSVQLDLQNVGSHKEQGFSFGLGMHYALNNQSAVIFEFVDNVSEDQVRLNSITLGFQHRF

SEQ ID NO: 11024 - protein, 350 aa, Phenylobacterium zucineum
MSRITTTVVTLLLTTAAFGQAKDDAGDGKKLDKQTMEIKDYLPEIHGTIRGKYEYQTETGESRFEVRNARFSVSGNVHPLVAYKAEIDLSDEGSIKMLDAYARVFPVKDLNFTIGQMRVPFTIDAHRSPHQQYFANRSFIAKQVGNVRDVGLTSAYRHKGDFPFILEGGLFNGSGLTNQKEWHKTLNYSIKAQLLPGKNWNVTLSTQMIKPEDVRINMYDAGIYYQNNRFHIEAEYLYKMYGHNAFKDVHAVNSFVNYDLPLKKVFNKISFLARYDMMTDHSNGTIDETTRTLIINDYARHRVTGGITLSLSKAFIADLRLNFEKYFYKKSGIPKESERDKIVIEFMTRF

SEQ ID NO: 11025 - protein, 436 aa, Phenylobacterium zucineum
MGRACTALSLCPKKSFCYITSGFIRSSRGHRHQKQSSARHNKFVILGDLLMKKSLLALVALSAFAGAAHAQSSVTLYGIIDEGFNINTNAGGKHLYNLSSGVMQGSRWGLRGTEDLGGGLKALFVLENGFDVNSGKLNQGGLEFGRQAYVGLSSGFGTVTLGRQYDSVVDFVGPLEAGDQWGGYIAAHPGDLDNFNNAYRVNNAVKFTSANYGGFTFGGLYSFGGVAGDFSRNQTWSLGAGYTNGPLVLGVGYLNARTPSTAGGLFGNNTTSSTPAAVTTPVYAGYASAHTYQVIGAGGAYSFGAATVGITYSNIKFMNFASTVFPNQTATFNNAEINFKYQLTPTLLAGAAYDYTQGSKIAGSSAAKYHQGSVGVDYFLSKRTDVYAIGVYQHASGNVIEADGNTVGPATAAINGLTPSSNRNQFAARVGIRHKF

SEQ ID NO: 11026 - protein, 334 aa, Phenylobacterium zucineum
MAAPHHRPFWFGQRIRRQRQHRSRPGRVRADGCCAGSQAASSGQPPACAAHGRPDRPGCGELSLGARYVQLDERSFDRDGQLERRTRKDTVLPQAALLFKPQQNMSLYASYAKSLAAGGTAPWFADNADEILPPTDAYQLETGAKIDLQGLRLGAALFDIRQAYQFTQPQADGGLLYVQQGRLHNRGLELSADGAATRQLRLFASVAAIRARAEDTGIGEYEGHQAINVPRLRASVQADYSVPGIDGLALLGGVQYSGRKFADRLGNASVPAYTVANLGARYATALGGLATTWRLNVDNAFDKRYWRDSGEYQGDAYLFPGAPRTARLTVQVDF

SEQ ID NO: 11027 - protein, 695 aa, Phenylobacterium zucineum
MSLFLQRPMALLLAAASPLALADGPAVQDVVTVSAERQHYRSLSATGATKTDALLMDLPQSVRVLTGDLLRDAGVTTLAGALDLASGIAKQSPLGGLWDSYAMRGFTGDPNFGSDYMINGFSSSRGYNGMRDGGNTQNVEVLKGPASALYGRGEPGGTVNITTKKPKFAPEYNADVSFGSFQTRRAALDLTGPLGDTIAYRLNAAHEEGHSFRDTLKVERSLFSPSFFWLLDEHTTVSYEIEAVRQRAPFDRGVVAVNGRLGAVPVSRFLGEPGDGPMTVKSLGQQLFIHHALSDDWTVQAGASYRDSELSGYSTEANKLLADGRTLNRQRRHRDFSATDVSARAEVLGKFRTGALAHEVLAGVDAYHFDDYRVQLRRNPSAANAYAIDIFNPVYGGKADPLALSIDTQEGQQARGLYAQDQVDLGAQWKALVGVRHDTYTQDVTNKRLNVSNRQSLSATSPRAGLVYQPSKMWSLYASAAKGFRPNSGISIANQAFPAERSRSYELGAKLETGRLTGTVAVYDIRKSNVLTTNPANTDFAIAAGEVGSRGLELDVSGEVARGLRVSGAYAYTNATVTRGDTTIVTGSRFANVPRHSANLLATQQFALGAGTASVGGGVQYVGERLGDVAVSSSFTLPAYTTAKLLASYSPTAKLRLALSVENLFNRSYYASSYSQLWVAPGAERTVTLNAHYRF

SEQ ID NO: 11028 - protein, 353 aa, Phenylobacterium zucineum
MHLRHLFSSRLRGSLLLGSLLVVSSFSTQAAEEMLRKAVGKGAYEMAYSQQENALWLATSQSRKLDKGGVVYRLDPVTLEVTQAIHNDLKPFGATINNTTQTLWFGNTVNSAVTAIDAKTGEVKGRLVLDDRKRTEEVRPLQPRELVADDATNTVYISGIGKESVIWVVDGGNIKLKTAIQNTGKMSTGLALDSEGKRLYTTNADGELITIDTADNKILSRKKLLDDGKEHFFINISLDTARQRAFITDSKAAEVLVVDTRNGNILAKVAAPESLAVLFNPARNEAYVTHRQAGKVSVIDAKSYKVVKTFDTPTHPNSLALSADGKTLYVSVKQKSTKQQEATQPDDVIRIAL

SEQ ID NO: 11029 - protein, 233 aa, Phenylobacterium zucineum
MYTKRLNPICAATLAIAASLPMAAHADDPDNIFRIGYAHVGFDLKSSDLTGPPGTTPPGLRINVKDLDILALSYERRLSPNWGVQFQAGIPPTLTTVGAGAAVPVGTVAKARIWFPTVLARYTFTGVPTVRPYVGVGVTYTFFTDEEVTTGYTAALQGSSSSMKLEDSWSPYVRLGVEYPIDKNWIVNVEYSTFQIKSTATVVTQTPGLGPIPRRVDIKDTPQIFGVTIGYRF

SEQ ID NO: 11030 - protein, 735 aa, Phenylobacterium zucineum
MIRRILQLVSPQVSGRVLSLVLASLVLALVPQHSLATDAKTDASADLNAGLKTDANAKVKQASRPASETKHTAQTIKPRPLEVLTITASRQAMAIKHNSTSISVVDEHQLQAIGHQHINQTLARVPGSWISRGNGQEHLSAIRSPVLTGAGACGAFFMAEDGISLRAAGFCNVNQLFDTNTEQASRIEVIRGPGSVLYGANAVHGTINIISPDMFVPRDEYLSQEIGPDNYWRSSVSTQSVKNNHALGVYANASHDGGYQEGSGYEQQKLNLVHQYMQDAFSVKSMLSTSHINQQTAGFIRGKFAYKDEALKRQNSNPEAFRHSQSWRAYSRLSWEMPGSEQDSELNITPYLRYNKMTFLQHYFPWQPEEDNSHRSMGIKSVYSQHQGEFSWHGGLDLEFTQGQLQETQKGAFSASIPQGAHYDYRVDSRSMSPFVDVDWFATQVLTVNLGVRYDHIVYDYDNRLSSGSACDLGVSNCRFYRPEDETRNFGHWSPRLGLVYQVNEQLNLYGELAQGFRAPHTSELYRLQAGQISADLDTEQLTSIQFGLRGYLDSFSYELSLYQMHKSHFIFQDSQSQYVGNGETQHLGFEFSLSYAFNDQWMLSLGGSVAEHEYANDLRLIDESIEGNQIDTAPKEMLNTRVSWTPSTNLQLELEWQHLGEYYLNPENSASYPGHDLLHLRGQVQISDKLALSLRLNNVLDKDYAERADFAFGSYRYFVGQPRSVFLTLRYQMD

SEQ ID NO: 11031 - protein, 225 aa, Phenylobacterium zucineum
MKVRYLTSALLLAMTSGLAAAASVDIRHEYVPDRDGDEHRDRIYVSHRFDNQIGFSVEAKWNYKDGHMGNAGHETGVSYRWKATDNFSLTPGINIDASPSGASVFKYNLTGAYKINDEWDVAARIRHGYKNTDDSRYNQLNLYANRKFEWGKLGVEAEYKDIHGGEGGWKDKGHDQLIDFKGEYTKLESGVIPFFAIAAITHKGDGSEFKDEYVPRFRVGLKYNF

SEQ ID NO: 11032 - protein, 705 aa, Phenylobacterium zucineum
MADISDVQILRGPQGTLFGKNTIGGAIVVNSMQPQKDFDLKLEAVTGRYNRADFKGMINVPLSDNLAMRAVASYETRDGFQRRLFDGGRQGNKDSFGARLAFKWEPTDKLTVNLSGDINIRREEQTAISLIELRDQPVPLRFVEIPNSAPPGGTNRLIAAPSSMYFWNKISAVGAATGACGAAWGGFGPTGPIPGTLAPTSNPNCASTRWITGDPDTTWAGGNNRSDFDLWGVNLTLDYDFGDISLKSISSYRDQKSRFEYDFDGTPHNILQLTNNIDLWQASQELQLTGSVLDDRLKFVLGGYYLKEKGQDKEPLEFGFAQFFSGGKIDNDSYASYLQATFKVTDRFSITPGIRYTNETKRFDPSLQVIYNDRSRFDPVLASLYPNGAFIAFSQCLVGQAVPGVIPPGVPGFEAFAGFPLPGGCTPSATNPGGNHTMPAVQVQAKAKEWTPAISADYKITDDTLIYASYSKGFKNGGFSQRIFPAEITTPSFTPEFVESYEIGLKNEFFNRRLRLNIAAFLSDYSDMQIVVNEGIAPKVRNAGTGRIKGFEVEGEAAPIDQVQLTFGVGYLDAYYTNIDLSAAPVTKDSKFAFVPKWTASAAINADVYEGQAGKLTLRGDWSYQSGTFKDAVNSPQLFQPAYSVFGASASFTDKSEHFTVTGGVTNLTDKRYIQGGYVDLDIGGAATASFSRPREWFLKLAYKY

SEQ ID NO: 11033 - protein, 750 aa, Phenylobacterium zucineum
MGYRIHPLAAALAVAFSSLAAQQAAAQTTLNEVVVSASKIRDAATPQQIGSAEIAAQHAITRDTAALLRDVPGVSLYGAGGVSSLPVIHGLADDRLRITVDGMDFIASCPNHMNPPLSYLDPTNVSKIKVFAGISPVSVGGDSIGGAIVAESAAPQFATPDQGLLAKGEIGAFFHSNNNAQGGNLSATLATENISISYTGALAKADNYKAGGNFKTWTTTGRIGHTLALDEVGSTAYESRTHTLGFAVRGGNHLVEAKFGYQDVPYQLYPNQRMDMLDNEQKRINLRYLGQYDWGTFEARAYHETVDHFMDFGADKRYWYSGMSGGSNSLNGTPCSPITGGMSGCAAGMPMYTSSKTTGVNLKADIELGANDLLRIGTLYQHYTLNDWWPASGGGMYPNTFDNIKDGKRDRLGAFAEWERRIGKQWTTLLGARYERVETDAGDIQGYSSSYATDANTFNNRDHNRSDNNVDLTALARYTANNMSDIEFGLARKVRSPNLYERYTWSTSTMAALMNNFVGDGNGYVGNLDLKPEKAYTASFTFDWHAADRSWELKATPYYTHVDDYIDATRLTAFANTNNQFVVLKYANQSARLYGLDLSGRMPLAKTGLGEFGLRGLMNYTKGENRDTGGNLYNIMPLNGKLALTHQYGSWSNALELVGVSGKNDVSSARNEIHTAGYSLTHLRTSYTWKNVRIDLGVENLFDRFYYLPLGGAYTGQGTTMSTTGTYSPAWGIVVPGMGRSIYAGLNVKF

SEQ ID NO: 11034 - protein, 344 aa, Phenylobacterium zucineum
MKRLFTVLLCAISTITSYYAAANSREEVETSIYVGIRAGYSYNEGSCSSNHLKCDKSDTGYGLFIGYDINPRWAIETSFNDIGDTTATYSNAHLDGDLSQIDISVKYAYPIYQNLSLYGKVGAAYWDAKAKGQNVSFSDTGVSPLLGAGLELIISEHWKGRIEYQYIDRIGNNLMGKASPNKLGLALIWNFPLRKHKPAKPEPVIVYQPVEAPPPPVEKPVTEQRIVIDENLGGALFEFNKSEIRNTAAIQPVIDVLLEDPSLYVNVIGHTDSKGSEEYNQRLSQTRANVVAKYLNSKGVSLSRIKVFGMGEDQPVADNSTEEGRAQNRRVEFIISNSQQIHGH

SEQ ID NO: 11035 - protein, 484 aa, Phenylobacterium zucineum
MTKSLLSLAVTAFILGGCSLIPDYQAPEAPVAAQWPQGPAYSPTQSADVAAAEQGWRQFFHDPALQQLIQTSLVNNRDLRVAALNLDAYRAQYRIQRADLFPAVSATGSGSRQRVPANMSQTGESGITSQYSATLGVSAYELDLFGRVRSLTEQALETYLSSEQARRSTQIALVASVANAYYTWQADQALFKLTEETLKTYEESYNLTRRSNEVGVASALDVSQARTAVEGARVKYSQYQRLVAQDVNSLTVLLGTGIPADLAKPLELDADQLAEVPAGLPSDILQRRPDIQEAEHLLKAANANIGAARAAFFPSISLTANAGSLSPDMGHLFSGGQGTWLFQPQINLPIFNAGSLKASLDYSKIQKDINVAKYEKTIQTAFQEVSDGLAARKTFEEQLQAQRDLVQANQDYYRLAERRYRIGIDSNLTFLDAQRNLFSAQQALIGDRLSQLTSEVNLYKALGGGWYEQTGQANQQASVETPKG

SEQ ID NO: 11036 - protein, 681 aa, Phenylobacterium zucineum
MNRISHFARGASALALLCLSAAALAEEAEADRATIIVNAQTVADDARAAVEKRPGGVDVVEASAFADKVAVNLRDALAFSPGVYTQPRFGQEVRLSIRGSGLSRGFHMRGLTLLQDGIPINLADDNGDFQELDPQVFERIEVYRGANALRFGGSTLGGAINAVTPTGRTAPRFELRVDGGSYGTLRTKAAAAFADARGDAYVALTTDRSDGDRDHAKRDAIRFNGNVGLRLTDTIETRFYATISHIDQDLPGSLTLAQALSTPKLSLPANIAMDQERDVDSVRLQNRTTVDLGSGRLSFGGFFNAKKLFHPIFQVLDQKSNDRGVFASLDLAGELGGLPWEATLGTQARFGTVAAKQFVNVAGRRGAPTADQRQTARTINSYGELRLRPIEPLTLIAGGVYTSGERRIVNRLAPARSGEADFDAFAPKLGLLYAPSAAVQLFANVSRSVELPGFNELSQTPNTGLPGFTPVGAQKAWTVEIGTRGRHGIAAWDISFYRADLKGEMLQYAVSPIIPAATFNAGRTRHQGIEAGLDLQLGALIRLRQVYQYNDFRFRDDAVYADNRLPVIPRHQYRAELRLGFEGLNLTPNVEWVPEGAWADYRNTLRAPGYATIGLGAEARLAPGVTLFLDARNLTGKKAVGDISALVAYAPDNRATPADEGSVAFYPIERRAFYGGLRMTF

SEQ ID NO: 11037 - protein, 1550 aa, Phenylobacterium zucineum
MPRLNKFVTEVAPTTPTLAGDDLETYKDKEKYPSFVRVGAGTQFVYEKGSYYVEKTTRNNDIKFLDEAYRYAIGGTPYKGINIDPSQSKKGLIGFGDSRQHPNAKDVLSQDPLTNYGVLGDSGSPLFAFDKQQNKWVFIGPYTYWAGYGKKSWQEWNIYKKDFADNIKKRDNAEPVPFSTSEYRWTTTGNSSQIKNNQKTISVNLPNSEEKLVNYQQKEKENTGQNVIFEGNGNSKNTLVLENNINQGAGGLFFKGNYEVKGKTDDITWVGGGISVEEGKTVTWKVHNPQSDRLAKIGKGTLIVNGKGDNKGSLKVGDGTVVLKQQTTKGQHAFASVGIVSGRSTVVLNDDKQVDPNSIYFGFRGGRLDANGNNLTFEHIRNIDDGARIVNHNMTNASNITITGGSLITDPNTITPYNIDAPDEENPYAFRRIKDGYQLYFNEENRTYYALKKGASIRSEFPQNRGESNDSWLYMGTEKLDAQKNVMNHINNERMNGFNGYFGEEENKADQNGKLNVTFSGKTDQNRFLLTGGTNLNGELKVEKGTLFLSGRPTPHARDIAGISSTNKDKHFAENNEVVVEDDWINRNFKATNINVTNNATLYSGRNVANITSNITASDKAQVHIGYKAGDTVCVRSDYTGYVTCHNGNLSEKALNSFNATNVSGNVNLSGNANFVLGKANLFGTIHSTGNSQVRLTENSKWHLTGDSNVNQLNLDKGHIHLNNVSDATKATKYHTLNISNLSGNGSFYYLTDLSKKQGDKVVVTQSATGNFTLQVADKTGEPTKNELTLFDASNATRNNLNVSLVGNTVDLGAWKYKLRNVNGRYDLYNPEVEKRNQTVDTTNITTPNNIQADVPSVPSQNEEIARVEAPVPPPAPATPSETTKTEAENSPQKSETVEKNEQDATETTAQNREVAEEAKSNVEANTQTNKVAQSGSETEETQTTETKETAKVEEDEIQEAPQMTSETSPKQAEPAPEEVSTDTKVEETQVQPQTQPTTVTAEDTTTPNGKPAEETQPSEKTNAESVTSVSQNQAEKTVSQSTKDKIVVEKEETAKVEKEKTQEAPKVTSQVSPKQEQSETVQPQTALESENVPTVKNAEEVQAQLQTQPSATVSTEQPAKETSSNVEQPVTESTTVNTRNSVVENPQNTTQPAVNSENSTPKSRRKRSVSQPQETSAEETTATSTNETTVADNSRRRSRRSVSQPQETSAEETTVTSTEKTTVADNSKSSKPNRRSRRSVRSEPTVANGSDRSAVALSNLTSTNTNAVISDARAKAQFVALNVGKAVSQHISQLEMNNEGQYNIWVSNTSMNENYSSSQYRRFSSKSTQTQLGWDQTISNNVQLGGVFTYVRNSNNFDKATSKNTLAQVNFYSKYYVDNHWYLGIDLGYGNFQSKLQTDHNAKFARHTAQFGLTAGKAFNLGNFGITPIVGVRYSYLSNADFALDQARIKVNPISVKTAFAQVDLSYTYHLGEFSVTPILSARYDANQGSGKINVNQYDFAYNVENQQQYNAGLKLKYHNVKLSLIGGLTKAKQAEKQKTAELKLSFSF

SEQ ID NO: 11038 - protein, 1552 aa, Phenylobacterium zucineum
MKTKRFKINAISLSIFLAYALTPYSEAALVRDDVDYQIFRDFAENKGKFFVGATDLSVKNKQGQNIGNALSNVPMIDFSVADVNRRTLTVIDPQYAVSVKHVKGDEISYYGHHNGHLDVSNDENEYRSVAQNDYEPNKNWHHGNQGRLEDYNMARLNKFVTEVAPIAPTSAGGGVETYKDKNRFSEFVRVGAGTQFEYNSRYNMTELSRAYRYAIAGTPYQDVNVTSNLNQEGLIGFGDNSKHHSPEKLKEVLSQNALTNYAVLGDSGSPLFAYDKQEKRWVFLGAYDYWAGYQKNSWQEWNIYKKEFADKIRQRDNAGTIKGNGEHHWNITFGTNSKIGSTAVRLAGNEKDANNGQNVTFEDNGTLVLDQNINQGAGGLFFKGDYTVKGINNDITWLGAGIDVTDGKKVVWQVKNPNGDRLAKIGKGTLEINGTGVNQGQLKVGDGTVILNQQADADKKVQAFSQVGIVSGRGTLVLNSSNQINPDNLYFGFRGGRLDANGNDLTFEHIRNVDEGARIVNHNTSHASTITLTGKSLITNPNSLSVHSIQNDYDEDDYSYYYRPRRPIPQGKDLYYKNYRYYALKSGGSVNAPMPENGVTENNDWVFMGYTQEEAKKNAMNHKNNQRISGFSGFFGEENGKGHNGALNLNFNGKSAQNRFLLTGGTNLNGKISVTQGNVLLSGRPTPHARDFVNKSSARKDAHFSKNNEVVFEDDWINRTFKAAEIAVNQSASFSSGRNVSNITANITATDNAKVNLGYKNGDEVCVRSDYTGYVTCNTGNLSDKALNSFGATQINGNVNLNQNAALVLGKAALWGQIQGQGNSRVSLNQHSKWHLTGDSQVHNLSLADSHIHLNNASDAQSANQYHTLKINHLSGNGHFHYLTHLAENLGDKVLVKESASGHYQLHVQDKTGEPNQEGLNLFDASSVQDRSRLSVSLANNHVDLGALRYTIKTENGITRLYNPYAENRRRVKPVPSPATNTASQAQTDSAQIAKPQNIVVAPPSPQANQAEEAKRQQAKAEQVKRQQAEAERKSAELAKQKAEAEREARELATRQKAEQERSSAELARRHEKEREAAELSAKQKVEAEREAQALAVRRKAEAEEAKRQAAELARQQEEARKAAELAAKQKAETERKAAEIAEQKAEAEREAAELAKQKAEEEGRQAAQSQPKRRNRRAIPPELSSDATTRALPRIARNSNPDASDYEKIPLDALEDEDVSESVDTSDKQPQDNTELHEKVETVSLQPRAAQPRAQAAAQADAVSTNTNSALSDAMASTQSILLDTGASLTRHIAQKSRADAEKNSVWMSNIGYGRDYASAQYRRFSSKRTQTQIGIDRSLSENMQIGGVLTYSDSQHTFDQASGKNTFVQANLYGKYYLNDAWYVAGDIGAGSLRSRLQTQQKANFNRTSIQTGLTLGNTLKINQFEIVPSAGIRYSRLSSADYKLGNDSVKVSSMSVKTLTAGLDFAYRFKVGNLTVKPLLSAAYFANYGKGGVNVGGNSFAYKADNQQQYSAGAALLYRNVTLNVNGSITKGKQLEKQKSGQIKIQIRF

SEQ ID NO: 11039 - protein, 748 aa, Phenylobacterium zucineum
MRSRWGHSVKTRFAYSLIALALAQHQSTFAAETVLDKEAPQQTLSTSSPVASPASTEPAAYEQVKLAAPERIAVHGRAMQMYVDKETTVGTKTAINVMELPQSVQVLTEQLIVDQAARNITDLYRSIAGVSEFSYSGVTFRGFRDDANVFYDGVRGDPYSGFSVPQLFNVQRVEVLKGPASALYGGGEPGGMINYVTKKPTFVESKELTLSTGSEDMMGGSLDLTGGLTQNLAYRFGAYYQQEDSFRNNADSQNAEVAGGLLYEISDDTKLTTTFDIIKQDLGGNRLRGVPVDNDGNFLVAPSYNANEKSDFQKMDALVLQSILDHQFTDNFSVKTQIRYLNNDSTQQYHESRGWATLDANKKPIMGDGTIKREYRVQARANDEISLTNDFVYAFDALGFEHEFLFGGDYHYVETEYSYKLATDKTGVGNLNIFDLNYGETDPSTYTLQDKNTDGTRANRYGVYVQEHLHFNEQWSLIAGLRFSQFDDYDKKTGFSFSDNAITPRAGLNYRPIDSMSFYLNYSESFNPASLTDQAQDIADGFLDPETGNQIELGMKNEWLDGQFMTTLAVYRIEKQNVAQANPLNTGDDDGIPALLNLGEVHSQGVEWTLVGDLTDNLTVTANYAYNETEVVKGVTNDSLTNTFDSKHFANAPRHQAGIWTRYDINALDSAIAFGMDYVGEQFSLDGQIVKPHTIFDMSWTTQWDQTQVRLNLKNIFDKEYAVSGFSERNGHFPGEPRNITLELSHKF

SEQ ID NO: 11040 - protein, 1033 aa, Phenylobacterium zucineum
MNKILKVMCFILFALFAGINTIYAQGQSPTGLVVDENGQPMIGVQIKIEGTTVGAITDVDGNFTIKAQKGNILLFSYVGYEQQKITYKGEKVLAIKMLPSTEMLEDVVVIGYGKQKKNSVVSSINAIGPKELSVSSSRNMTNNLAGQVPGLIAVQRSGEPGYDNADFWIRGQSSFKGGTNPLVLVDGVPRQMQDIEADEIESFTLLKDAAATAVYGAEGANGVILITSKRGNSQKPKISFRAEGTILEPTRLPTFMNSVETLNLYNEALNNEGTASIRTDEEIAKYGPGADRDLYPDTDWLGTMLRNHTYNMRYTLNVRGGTERARYFVSGAFYQENGIFKDFGNDYDNNIGLKRYNLRSNIDFDATKTTTVKVDLSGQYLQTNYPGTGTSTIFTTMCRTPSYIMPAVYSDGTVAGHPRPSGNRSNPYNLLVNSGYAKEWRTSIQSKVEVDQKLDFLTKGLTWKGLISFDADMSYIAKRTKTPTQYLATGRDENGKLLYKTVVEGSDVLSENLSNSSNKKIYFETAFNYNRTFAEKHDVGAMFLYMQKETQYHNNALPYRKQGLVGRVTYGYDGRYFLEGNFGYTGSETFAKGYRFGFFPAMGLAWYISNEHYYPEALKKVVSKLKLRFSIGRTGNDDTGGNRFLYRGTMKQDNSGYNIGFSNSGALGGVGNGITEAQFESPFLSWEIEDKRNFGIDLGLFDNRIDLQVDYFNNKRKDILLQRNTVSNVTGFQQMPWQNFGIVKNQGVDASLNLNYKVGEVNLSARGNFTFARNEILEYDQVPQVYPWLEKKGTRLNSWKLYIADGLYTADDFNITGEGLNRQYELKPGVVSGLSSGVRPGDIKYKDLNGDGKIDSNDQMEDVGNPSVPEIVYGFGLNAEWKGAYVGIFFQGSGNTSTVLGASSNGAFFPFQWGVEESAVRSEVANRWTEQNPSQNVMFPRMHSTNYDNNTAASTWWLRNASFLRLKNIEVGYNFKEKTLKKIGIQALRVYLQGNNLCVWDDIKMWDPELGNTNGGFSYPLSRTFTFGLDFTF

SEQ ID NO: 11041 - protein, 812 aa, Phenylobacterium zucineum
MNLRKQPLPHRSRPATLAAAVRGALLYLPLASVILSMPLTAIAEQTTNQEFSIAPGNLDAALSQFSRQAGVSVAFDAKLLAGKSTLGLQGAFAPDEALNRLLAGSGLQAERQDRGGYVLVETKSAGTINLDAMRVEDNALGTITEQTKSYTPGTIATATRLVLTPRETPQTVTVVTRQHMDDFNLTNINKVMDHTPGVTRRGTDNYRSYYYARGYEIRNFQYDGIPVLSDGINFMGETTSDMIQYDRVEVIKGASGLTTGAGSPGATINLVRKKPTHEFSGHATAEYGRWDNYRTEWDVGGPLDESGSIRGRFATAFQDQQSYMDHFKEQKRALYGILEVDLSPKTMLTFGGNYDKTIPTGTSWGGTPFFDSHNNEINTSRSFNPGASWSRAEQFSHAFFSQLDHEFDNGWSSRAYYTFQRNAYDANLGSIKYTPDGDTGSSELLSGQYRYKTRSQALEAYARGPFELFGRTHELAVGVSGYHNHLKGSGHNVIRVPVDNIGEWNGRAERPDWGGILYRAEDRINQRAVYASGRFSLSDDLAVILGGRVTNYRRGGDSNMRETGEVIPFAGVTYDLSDNFSLYASYTKIFRPQSVRDESYAVLDPDEGDSYEGGLKSEWFNGRLNASLAYFEIRQDNRAESIGTLTNSNGMTYSAYRGTKAKTKGIELEVSGELMPGWNIQAGFTHQVIREDETNEKLTTQAPENQFKLYTTYRLPGRLSKMTIGGGGSYQGTTWRDGTDALGNEHQFKNEAFWLVNLMGRYQITNNLSATLNVNNLLDKYYYSNYGDRWTGIATKMYGEPRNMMLTTRWDF

SEQ ID NO: 11042 - protein, 1134 aa, Phenylobacterium zucineum
MSAVLYAAESPSKSKSVARSVLPPELQAKFSDAMRQGERALIAQAYDSTYRDPGLRDAVVRHVSTLAPTALRDVTTAADLGVLISGHRMVLAPNAAQVLATRTASASGLTASSYQNVAMAVNNSPNLPNPMPSRTEQTWNLAMIGAQGAYNRGFTGAGVTVTVADTGFDTTNAGLVNKLRTNLGKNYMVEIGKAFDPNDLSPESAQKTDIHGSHVAGIIAAEKFDNVDAHGVAYDASIIPLRAIAEKGYTTYGNVDSSALALNYFAGLSGTMVYNASYGPNSDGLTNLKLWTVGNIDDEANAAFNVLKAGKIIVAAAGNDRADNPIAARNANGLALLPFFNPAHAALGVYDDQGQQLDGSALQHQQGQIISVMSVGITKAAASYSNLCGVTASWCVAAPGGDDATGALVYSTVPVNTYGFAQGTSMAAPTVSGAIAVLIQANPSYNAQDLSRLLFSTTEDLGAPGVDAVFGYGLIRLDRATDGPTTLAANTAVSVVADQTTYWSRLLTTDGDFSKVGTGILSISGRTNAGGNVFAQLGTLAVDGTLTMSAGHRLEVAQPATLAGFGTIAGDTVIAGTLSPGKMANIGDLVSNNVVPAGTVLNGNSVGSLTFNGNVTLTSTATTRIDIDGSLIVPGGPGTYDKIYVTGAGNVFYAAGTLTPVLRGSVGTVSNYTPAIGTEFAFVQATDGASTAGSFSKLVQPTSGLPANGRFDLIYNPTSITLVVTPSSFSQLADADKLGPTQRSIAGILDKDRAASGEMPTANEKALYDALYKLNSEAEFDKALNQLSGPGQPAMASAPLQAFTGFLGAIGDRQDMLTSGSEIGQNGTAQSFAMSYAGRNTMSAGTNAAMNAFASISPAERVQDGWSVWGQGFGRNSRVGDSGDLSGSKAVSAGFAVGVDRRFSNSFNAGGAFGYTRTTATSTDMQGTVDTYAGAAYASWTPGAAVLDFRIAAGPSQMATSRQILLSPTSLQGSANGVGVGTTFEAGYRFAMGHDVTLKPFVGMTWQGFRRDAYSESQLPIGLVYAARTYDKLTSTVGAAVSARLRTTDGTTLAPELKVGWGYDLRDSTLVSEAALLDEAFLVDAAQPGRNAALVSAKLSGWRTETFRMFAAYTGEYRSNATSHQVSAGARVNW

SEQ ID NO: 11043 - protein, 708 aa, Phenylobacterium zucineum
MTCHAIHRGGRRHGRVRLFATTFLTSVLASGVAPVLAEDIPEVVITAPRLSIPADARLDAAGDTAKLLSRTPGLNLISNGGVSSLPDIHGLGDDRLKILVDGMETTSACSNHMNPPLSYIDSSRVEKVEVWSGITPVSAGGDNIGGVISVKSAPPVFAGPGEGYAVGGRLSAFYKSVNDGVGASVALHGANGTFSLGYDGSWAMGRDYYAGGDHRAVLSTLYEARNHALTFGARHEGHLLVLEAGQHDIPYQGFSNQRMDMTGNRGVHGNGRYEGEFAWGKLEARGYWQQVKHAMDQIGGEKNGKMPMRTDAIDLGYAVKGDIRVSDGKTIRVGQELHRFLLDDWWPPVAGSMSMAPNTFKSINGGSRDVISAFAEWEEKWAPQWTTLLGVRSDTVLMDTGNVAGYVTTGTEAANAAAFNAKNHAKTDFNFDLTALVRFEPNAISTNEFGYARKSRSPNLYERYSWSTTSMDSSMINWFGDANGYVGDPGLRPEVAHTVSTSFALHDSGRKEWAAKVTPYFTYIADYIGVDWVSNSTTRSSVFPLLKFANHDAMMSGVDVSGSTFLARETGYGDFKVSGMIGWLHGEMVNTGKAMYHVMPINGKAALEHGWGGWTNAVEAQLVGTKAGVDPLRREPKTPGYALLNLRSGYEWENFLLNLGIDNVFDKRYYHPLGGVDYSEWRRHSLTGQVGALPAPGRSFNAGVTVKF

SEQ ID NO: 11044 - protein, 829 aa, Phenylobacterium zucineum
MPQHFPPDASLHRSLPLTLTPIAHAARIALCGVLLLGGAAMVPAMAQGTPDAAVQSDNVRQYSIAAGSLDQVLGSFGRAAGVMIAIDPALTSGLRSEGLQGKQSVASGLSILLSPHQLEAIPGANGGYKVRRQTVSDTTLPTVSVTAAALDANSEGSRSYAARATTVGKSAKTLRETPQPVTVLTRQLIEDRGLLDLTDVLQNTPGVTVDYTDSERVTYFSRGFQIDALQIDGLTMNQSGSIFVQPDTAVLDRVEVLRGASGMIRGSGNPSATVNMVRKRPTHEFQGSAALTLGSWDRRRLEADISGPLNEAGTLRGRIVAVDDSKDFFQKARHEDRKVFYGVLEADLGPRTTLTASLQHTDLDATGAWGNLPGNFDGTPLNLPRDMYLGAAWNTWNRYNQQAMTELVHRFDNDWTFKASAAYTRLRMKENGFKQSYFTRASTTNPYIFDVTTSMYTGDASDQLVLATSASGPFTLFGRKHELIVGAESLRNKAVATNGVGNLNKLAGVDIRNWDPYTSYPETYPTITGTGAPTTTSQQGVYGTTRLSLTDPLTLIVGARVSWWDYKAPRTPASNYKVEAEVTPFAGLVYDLSKQVSAYASYTEIFTPQDAKDATGNILPPVTGQDYEAGVKGEFFGGRLNASLGIFRINNNGKAVEDASSYSPCLPYYTTGYCRVAGGKQRSDGWEMELSGELAPGWQMMAGYTNTRTKYLKDTTANTGQPLRSIDPRHQLRVFTSYRIGGETQGWTIGGGAQMQSDSYVRTGVLTSRQGGYAVYNAMVGYRFDKTYSIQMNVNNVFDKVYYKKYAPTGIAYYYGDPRNVMVSLRANF

SEQ ID NO: 11045 - protein, 481 aa, Phenylobacterium zucineum
MTMRRLMTWLFGAFLLLLREDAFALGLLDGYHLALENDPQFQAAIQEHEAGRQYRALGRAALLPRLVYSYNRGRSWSDVTQTTTRGDFKEDRDYDSYVSTLSLQQPLFDYEAFSRYRKGVAQALLSDERFRSQSQELLVRVLEAYTGALLAQDQIELARAQKRSYREQFQLNQRQFERGNGTRTDTLETQARFNLAQAQEIEARDSQDAALRELERLVGAPLEIADLAPLGERFQVRPLSPASYTAWRDLALAENPELASLRHAVDVARYEVEQNRADFLPRLGLYASTGKSKSGSENTYNQRYETDSVGIQLSVPLFSGGETLAATRQATHRMEKSHYDLDDKVRETLNQVRKMYNQSSSSAAKIRAYEMTVDSARTLVMATRKSIAAGVRVNLDLLNAEQALYSAMNELSKAKYDYLTAWARLRFYAGVLDEADLELVAANFVSGETPARRRDCATTDCPAPLHTLSKTDTEENRSALN

SEQ ID NO: 11046 - protein, 942 aa, Phenylobacterium zucineum
MKMHLLRASALAGAAGLMIAGQALAQTTPTPAPASPTDETAAVEALVVTGSRIPRIATEGPAPVTVITSDTIKAAGFTSVPDVLRSLTQNGGETQTQQSSSGADWTPGAQQVDLRGLGPNHTLVLVNGRRIADFPLPFNGKSAFTDTSSIPLGMIDRIEVLSGSASAVYGSDAISGVVNFNLKKKVDGTTVDMTFGGLEHGGAASQRLNVSTGYSKGDFDLVIGGEFVNQKPLWAYDRDIQDSTKDAPTAGARIARRDFLRMDPAEDVYVDPGKTTCDSLKTLNGGSVEYASRPRWGAYDPDTDDYGPGYYCGSYSSIGYGTIISERKSANVVASLNYAKTDTLAFFADISAGYSRTRQFQDVLSWNYQDANGSEDGIFYNQFTGALDFWQRNFTPEEMGGLHKGYITNTSRTFSITPGVKGSLGDGWDYEAFYNFSQYKSSISWPKVVNSKATALFLGPQLGVDADSGYAIFNADPARLYKPLTTAEYDSITARTTYKPVARQQGVSFQVNKADLFTLPAGPVGFAAVAEYGKQSYKLGLDPLATQNYYYHLRDADGSGSRDHWGAGYEFRAPLLKSLELSTAGRYDSYKYGGNTIDKFTYNGGLEWRPVKSLLVRGAYGTGFRAPDLHYVFAKEGISHPSGTDYYRCRTEEPDEDIGDCSYADEGLVKVRLGNAKLKPETSKSLNYGVVWSPVRNFDISVDYFRVQLNNAVLDMSLDSILRQEGDCRVGTTAAGTPVSITSPTCVDALARVVRNPLTAAIDPGGISTVTINPINVATEKTNGIDVAAHYRLATDGLGTFDFSLAHTWVDKHTSRQYPGDPIENQLAYDSGYDVPRTKSSAAINWNKDALSIGLHGQRLERLPNYAEDGWIKATYLVNATIQYEIDPRTRVSLAIDNLLDKAPPRDPTYSGYPYYDTSWFDSTGRSYYLQLTHKFGGNSGL

SEQ ID NO: 11047 - protein, 909 aa, Phenylobacterium zucineum
MAAPPAEEGAEQPAPDLIPPKALGPVEFVYPAELLELESPPEGRIVLEYVVGTDGVPFEITVLESPDPALDPHAIETVSKLRFTPGTYKGQVVEIKLTLAFDVAAPIPEPPPEEDPEGAEGDPEGVEAGEGEGEEVSEADAGPVRILGKIREAGDRNPIEGATVLAVPAGDLPVGEVKGTRYEDPSGPAPEWTVQTLTASDGTFSLRGVPDGKVRLIVLGSGYERSDRVLMLEPDKQIEINIWPRRTASNPYRTEVTTEREAMPEVVERSLKVEEITKIPGTQGDALKAVLNFPGVARAPFNTGTLAIRGAAPEDSAVFFGYHEIPILFHFGGLRSVFASEILAQIDFIPGNFDSRYGDAIGGVVNVQPKAGRKDGYHGYIDVNAFDSGFLAEGPLTKKGKGSFAIAGRRSYIDFLLPRVLPQDAGINFTVAPRYWDYQAFVDVPVSGGDLSIRAFGSNDQSKLVFSGANEDEEDVDAARSGIETGQYFSRLDAVYRKRVGPWEFLVTPAFRFSTTELDIFDVLKLDVDSYDYTGRAEISRQLSKRMRLRVGTNVVATQFIVDVTSPVTSGGGGGPPAGGGGGGGQGVDASTAVTRRVDGILFRGGFYSTLTIAATDKFVLYPGVRLEYYAEPTNRMTVDPRLRGVFKLTDSTAFKGAVGLYSQGIQQPVQLDLVFGNPRLGPQRSAHASLGIAQDLPWDSFIELTGFYKNLWDLVSPSGEIVTKIDGSVGPETFANTGTGEIYGAELLLRKDLTDNFFGWVSYTLSRSVRRDAPGEAQRLFDFDQTHILTLIASYRFARGWQFGARFRLVSGNPTTDITDGIYDAQLADYIAVDGPINGGRLPAFHQLDLRLDKTWTLPVLEITGYIDVQNVYNRQNIEAFNYAYDFQTFSTINSLPIIPSIGFRVEL

SEQ ID NO: 11048 - protein, 730 aa, Phenylobacterium zucineum
MTVYNFTSAQHRAAAFSGLMHPPGMHLRYRVSALALGLLASFAALADTAPSTLPSVQVQEQRRVTADYAGGQVAAGSRVGLLGDKDFMDTPFSTVSYTESFIRDRQAKDLTDVIAATDPTVFSNGVTGAWSENYAIRGFASNTSDTTFNGLSGMAPYYRTSPEMFERIEVLKGPSALLNGMPPGGSVGGSVNLVPKRAGELPLLRVSANFASDAQFGTHVDMGRRLGADKQFGIRFNFAYRDGDGAVGKQRKKVQLGSLALDWRGERARLSADLYSADDRVDGPARGVGLAPGVAIPRPPRGDTLINPDWAYVDSQDKGAMLRGELDINDSLMAYLAYGTSKTDYRYNGSISAQILNPAGDFTTVIGQLAFDIKKQSGDAGLRGSFHTGSVGHQWAANVTHYQHTQNDYGRRSVPGWDWTTNLYNPVWGPAAPFMAPHISHTELTLDSLGFANTLSFSDDRVQLTLGVRRQQVVSETFSVATSARTSRYDKSATTPAAALLVKATDTLSLYTNYVEGLSQGATAPMTAANAGDVFAPFRTKQKELGLKLDLGSFAHTFSVYEIKRPSSYTDPITNIFSLGSEQRNRGVEWGFFGAPMDGVRLLGGVAYVQPKLTRTAGGVNEGRIATAVAQRQAKLGMEWDVPTLQGLTLTGNATAMSKQYISADNSLSVPGRTLFDVGARYSTTVAGRPLALRASVNNVTNKAYWGMPLLSSLALGAPRTVLLSATMDF

SEQ ID NO: 11049 - protein, 724 aa, Phenylobacterium zucineum
MTELIPSFLGKKGRELFSVLFIGALSTPTAMAEKKPPSAVSTAASDGGTLTVEASSSAADTPMTSGYQPLNSSTATLTTLPLLDIPQVVNTVSDRVIADQHATTLDEVLNNVSNVVQTNTLGGTQDAFVRRGFGSNRDGSVMTNGLKTVLPRSFNAATERVEVLKGPASTLYGILDPGGLINVVTKRPETTFGGSLQATSTSFGGGTGSVDITGPIEGTRLAYRLIGSYQHEDYWRNFGKERGSFIAPSLSWFGDDATVNISYSHRNYSTPFDRGTIFDLNTGHAVNVSRETRFDEAYNVTDGASDLAQLNAEYRIDNQWTAKFDYSFSQDKYSDNQARVMAYDATSGTLTRRVDATQGSTQRQHAARADLQGNVNIGGFYNEILTGIAYENYDLLRTDMIRCKNVKDFNIYRPSYGSTGTCSSVSASDSDQRIQQVSYSAYVQDALYLTDRWIAVSAVRYQYFTEFAGKGRPFNTNTDSRDSAWVPKFGLVYKATPNVSLFGNVSRSFMPQYSIASYIGELPPETATAYEVGAKFDLFSGVTANVTLFNIDKRNVLYTETVGDESVAKTAGKVRSRGVEVDVAGALTQNVNLIASYGYTDAKVLEDPDYKGKVLPNVPRHTGSLFLTYDFHNVIGGNTLTVGGGGHAVSRRSGDNAENYSLQGYAVADAFAAYKIKTRHPVTLQVNVKNLFDKTYYTSSIATNNLSNQIGDPREVQFTVKMDF

SEQ ID NO: 11050 - protein, 1038 aa, Phenylobacterium zucineum
MRTKFSGILTLFLALFVQILFAQQQTVSGTVTDDTGMPLPGATVLIKGTTTGKTTDFDGNYSIKANNGQTLVFSYVGFTTQEIKVSSATINVQLKQGEALEAVTVVAYGGAVNSAKVASAIATVDGSTIEQVPINSLDQVLQGAAAGVSVNTGSGQPGQSGTIIIRGRNSLQGDVEPLFVIDGVPVDQDNFRSLNQNDIESLSVLKDAAATAIYGNRGSGGVVIVTTKKGKKGSGINIQYRTLYGVAVKPKTRFEVMNASQFLNFQRDLLPGNQFGDSLTDTQIAAISAQTNTNWSDIFFQQGTTLSHELSVSTGNENTSSYTSLQYYKQEGITLGSDLKRFSFRNNFNGSSDSKKFNYATTLTLNYSVNNFIVDATRGNNTGGQLDNPFIVPYIGLPYLSPYNPDGSINIVGTQLSGALNPDGSVNASGANGFVNTPYLALNTARLGTDQETEFKAVGSISADYNFAKNLTVGGSVGIDYTNIESLFITPPGSIRGLITPNQASEEKGTQFENFFRDANFITNAFIRYQNDITDKLNLTASIYGEYNYSNTQNANFQAFGLNPALPGSGSGFTAGNTAEFPSDTNGDGVDDPEDQVFNYIPTVGSSETEIALASVFATVGLDWDGKYGIDATIRRDKTSRFPKNPTGTFWSVAGRWNIDNEDFMSDVDFISTLKLRASYGVVGNQNVGSRYQGLQTVNAGPSYQLGTGYTLGTLVDENIKWETSNQLNVGLSFGFWNNRLSGELDFYRNLTKDLFSQKLLSVAGTGYNQVTANVADMSNTGVDLQISYDLLRKSQTNPWSVRIHGNGNYNKNKVEKLPGGFTGNNLRVAEGFAANTWHQVRWAGVDPSNGQPLYYDINGNITNVFDPNDAVYLDKNFDPTYTGGFGADISYKGFTLSTLFSFVADRYRQNSSLAIVEDAGLAGFANQSTTLLNAWTTPGQVTDIPALSFGGLRAVDGDRYIEDASFLRLRNITLSYTVDSKILEKTNILSGMRVYVQGTNLATWTKWRGFDPESNQSTGFFDYPVPRTFSLGFDLNF

SEQ ID NO: 11051 - protein, 318 aa, Phenylobacterium zucineum
MKAFTYERVNTPAEAALSAQRVPGAKFIAGGTNLLDLMKLEIETPTHLIDVNGLGLDKIEVTDAGGLRIGALVRNTDLAAHERVRRDYAVLSRALLAGASGQLRNQATTAGNLLQRTRCPYFYDTNQPCNKRLPGSGCAALEGFSRQHAVVGVSEACIATHPSDMAVAMRLLDAVVETITPEGKTRSITLADFYHPPGKTPHIETALLPGELIVAVTLPPPLGGKHIYRKVRDRASYAFALVSVAAIIQPDGSGRVALGGVAHKPWRIEAADAQLSQGAQAVYDTLFASAHPTAENTFKLLLAKRTLASVLAEARAQA

SEQ ID NO: 11052 - protein, 224 aa, Phenylobacterium zucineum
MAFHRVAVVAVAAGMLAAGFSQAAFAQSTDLPPTSGNWMVRLRAVNLTAANKSDPVPALAIPADAIQINNKVLPELDISYFFTPHLAAELILTYPQQQDVTVMRSALGGPTKIGSFRHLPPILTMQYHFTPESRFKPYVGAGVNYTRISNVDLQVPGVGSLDLSKNSFGPALQVGFDYRLTERLYFNVDLKKTWISADVKMGGQTISKVKVDPWLLGVGLGYRF

SEQ ID NO: 11053 - protein, 750 aa, Phenylobacterium zucineum
MLRSAVLATASAFAVVPQASLAQSSAQGGAQNLPSVTVDAPETRRRAPAAAVRRATRPSPQTAASRRPLQQRNVGFVETPRGPVNGYVANRSSSGTKTNTPIMQTPQSVSVIGAEQIRDQKPNKLDEVLRYTAGVRAGTFGADTRNDWWLIRGFKSDDIGLFLDGMQLFYTAYASWRLPPFNMERVEVLRGPSAVLYGGSSPSGIVNVISKMPPTEPIRYVETGVNNFGNAYVGFDVGGPVATQPENGKLFYRVVGQVQNGPTQVNFTPDNNYFIAPSFTWRLDSDTTFSVLASASKTDTRGINFLPYQGTVTNAPFGKIPTSFFAGDPSVDKFTREQEMLGYQFERNLTDDLTFRQNARFAHIDLTYRGYIGNGWDNINAASLGRYNWYAKDTANQADLDNQLEYRFNTGPVRHTMLFGVDLKGYQIDDYQAFNFGTVPPINVLNPVYGINIPLTGPPFRNFLITQKQAGTYVQDQMKLGNFTLVLSGRNDWVETTQAARDTGATLASNNDSQFSGRAGLIYNFDNGIASYISYATSFNPIIGLNAQNQLFQPETGQQAEIGVKVAPKGFDGYFTASVFNLKRQNVPTTDPIITTLQNQTGEVTSRGIELEAVANATKELKFIGAFTAYHLFTSRDLDPALVGKTPTNTPELLVSGWADYTFKDGPLEGFGFGGGVRYVGSSWADTANTLEVPVVVLGDLAVHYEWQNWRTAINVINLTDKIYVASCAAASSCFYGDRRRVTASVSYKW

SEQ ID NO: 11054 - protein, 363 aa, Phenylobacterium zucineum
MNHKLKFVLLASLLPFTVSAAQELTPWYVGAGLGVNNYEHIATQNGQDDPYAWDVFAGYMFNDYFGAEIGFRDLGNADWTSAGISNDAGVKGSTLGLVGIWPLANRWSLSAEAGAMYYSLENSQNTAGASTKYGSSDFAPYLGAGVGYNFTDNLKLQAKYRRYENLNDDYNIVEADSNYWGLELSYRFGNTVAAAPVAAAVIAAAPLDSDNDGIYDDKDQCPATPATHKVDSVGCTIYENVKTKEDVGSIQFANDSAVVKPVFYKDIERLANYLNKNPEFTVEIAGHASHVGKPEYNMVLSDKRAAAVAKILVDKYGISQSRVTSKGYGETQPLVAGDSKEAYAANRRIEAVVTTTTKQPVLK

SEQ ID NO: 11055 - protein, 1125 aa, Phenylobacterium zucineum
MIPYLSAVWSIDAASNRLFWRRLTRRQNIPHHRNRCSTLFVEGLARRSWRACSVAFQASGPGGTKACRLCTAHLKVSKKNLPIGAAASAPAGWRAPELCQERRRPAERDLAPRKDDRPIKNEPREGIRMNRSSFLRGGSCLALALAMAGAAQAQEAQKPDASTQVEEVVVTGSFIRGTPEDAALPVEVIGAEELQKRGSPSTVELLKALSVSNGVLGDTNQFDSRAQGSEGSGSVNLRGLGSQRTLVLLNGRRLAINPFGQAGAGIVDTNILPAAAIGRLEVLKDGAAATYGSDAIAGVVNFITKKSFEGLEVGADYRHINGSDGDYGLNFTWGKVWENGNVLASLGWQHRSKLSVSERDWASRSYLSNPEAGWSAAGNPSTFIPLASSTNGMRDPACAGLGGFPGFSGLTPVCYWQYTPFDNLVEKSNAIQAYAEANADLSATTKFHVEVLYAHTDVPDWNTSPSYAALAVPTAEASPIPGRYVVPATNPGLIAFMAANPTVQLSSLATGAVSTVPSSIFAFGALNVAARPFGIGGNPKFGYGPSIGARSFDAFRVSADLSGEFENGIGWDMALTYSQEIGIRTGYDTLVNRFALALQGLGGPLCDSNPSLPGVQGTAGVGQCMYFNPFASAIPGNAITGQANAGYNPALANNKDLIDWFFKKLSTKQASRLFVGEAVLNGKTNITLQGGDVAWAAGVQYRRSYFTADYNDISNAAVNPCVNTPDFGVTTCTGSVRNGPFMFLGVGNEADNQSDVMAAFGELSVPITDDFQAQLAARYEKYGGAVGSTFNPKVSMRWQAMPWLALRASAGSTFRGPPDPLTTTTSVTSLQGILGVFRAVDIYGNPNLKPEKAQTYNFGLLFNAGGFKASVDYFYFDFKDPIVAEPVAGMVASLYPNGAAGANNCADPAYAGLVSRFTFTGACATPTTSIARLRTNYINGASVKNAGFDFSADYRFRDVMGGDISLGGSATYIQKYEVGATQVEGITVEKAFDAVGLLNYQTTVVPIPKWKGDVHAEWNSGPHNLRLSIHYIGSYTDQRTAPFAANAYKDTTGAGVTVSAGKKIEKQVLTNLAYRVFLPWDTTATLAITNLFDKDPSYARLDLGYDPFTGDPLGRTYKVGLRKKF

SEQ ID NO: 11056 - protein, 669 aa, Phenylobacterium zucineum
MLIVHVLAQAAVAAAPPPADQGVISYPASFFADQQPANAAEMVERTPGFLLDTGDSVRGYEGAAGNVLIDGKRPATKTDDLEAILRRLPASRVERIDIIRGGAPGIDMQGKSVIANVVRKPGGMTGLVAVAQNHTWDGRTAPAMRIEGQGDLGPRKWELGVFWGKAIDDGYGSGRAVRLHPDARPDVAAFADTEGDLVDAQATGAFETPLLGGQARFNGRAYTQKFKFEEDFRLLSPAPGLETTDEVTWTDETELGVNYTRSLGARTSLELVGLRQDRERSIVSTQSAAPDTVTFALDRDTSETIGRAVLKHRFGDRLSVEGGGELAVNELDSRTSLHLNGAPGDLPAANVAVKEERGELFVKSAWRPASGWTVDSSLRYESSTISSEGDVVLEKTLRFWKPRVTASWDALPSTQLRVRVERQVGQLNFDDFVATSRFSSGGGVTAGNPDLDPEQAWVAEAAVEHRFWRSGSVVVAFRHFELKDVVDRGPVTAPTGEIFDRPENIGDGTKDELALEWNIPFERVGLRGVQLRGDLTKRWSEVVDPTTGETREISGLHPLDWNAYLTHDIPRWRLTWGVSAYGGWRETYYRYNLVETTKLKTFVHPFLEWKPQPDIHIRVELPNVTERGLRRTVAIYPGPRGGGGQPVIEDRDLQPGRMWYVRVRKTFGG

SEQ ID NO: 11057 - protein, 700 aa, Phenylobacterium zucineum
MLITKARMMTALAAILSLGSAQAAETSDQTVEDTIVVTGRYLSIDQLNAVKTPTPILNVPQSLSIVTRAQIEDQAFTSIGDILRYTPGLAVSQGEGHRDSIIIRGNQSTADFFLDGLRDDVQYYRPLYNLEQVEILRGSNALLFGRGGGGGVINRVTKTAQLDEDFAGLNASVDTFGAYQLAGDVNTVLSDAIAFRLNAYGEHLESHRDVFDGERYAINPTFTFDLGARTQAVLSYEYMSDDRVVDRGVPSVSVANGPDAPLEGYRDTFFGDADGNNTTLDASIYRGRVEHTFSDALRGNVTVQYADYDKLYQNIYAAGFDATTDTLTLDGYRDPTTRQNLIIQGNLVGEFATGPFQHTLLLGAEYGDQSTTNARQDTLFAATQDDQISVSLTDPVVVPSYTFTSNVRDRSSDVEFVSLYLQDQIDITDQFKLVLGGRYDRFDVAVLDRLAISPTDDGRRGRVDEEFSPRLGAIYKPAENVSVYVSYAETFLPSSGDQFLTLTTTSEDIEPQRFENTEVGVKWDFAERLSLTTALFRLERGQFTTVDPDDPSIVTLVPGSTTEGFEVQLLGRLTDQWTVNAGYSYLDSTVEGGAFDGNATRQTPENMISIWNEYQATDQLALALGVTYQDSFFVLENNAVEVPDYTRVDAAVFYDLTEQTRLQLNIENLLDEEYFPDAHSNDNISTGKPLNARLTIRHRF

SEQ ID NO: 11058 - protein, 359 aa, Phenylobacterium zucineum
MQMKKVMLATWLLAIGGFAQAQSSVTLYGRIDTGLEYMSGLTNGSGRSVSRLRAESGDWGTGMFGLKGVEDIGGGTKVIFQLEGGLNSMVGQVGSGTTIFNRWAYVGVQNDTYGTLTAGRMLWISNGLWDFDPLGQTAWSSASLVRGRNWQASSNNIAYQSPKWGGFDVAGQYALSNSTNWNAGGANGQGRSVGLQATYTSAFFQVRGIYDELRNPTTGQFDDVFNYSREYFGGLNVFLGPFKLQAAYQASQASQAPAGAPTRTQLEWGGLAWQATPAVALIGAVYHVNANNGGGNATIYTIAGSYNLSKRTLLNVQVATARNSRNANFSLEANGPTSSDNPLPGHSQSGIYAGIQHAF

SEQ ID NO: 11059 - protein, 367 aa, Phenylobacterium zucineum
MPLPSPITLATPMNTKTLVLITLAAAPLSALAQSSITLYGIADTGVRYTSGLTAANAASNTSGAALSSGVNTTSRFGFRGREDLGGGMYALFNLETGLNLDTGTTANSSKFFDRAAIVGLGGNWGQVTAGRQTNLLADAISPVDPVGMRFAAFNPNIATAALSSHGLGVEYGSAGATTGSYRLDNSVKYTGRLGGLTARAMYSFGETAQGGSARSSAGAGLAYGTKTWTVSGAYQRFKTADQWELKAATLGASYKWDNLRLALNTARSDGQTNATTARTVQRVHSLGATWSARSTLDLTAALYRVERERSGRAADGYTRALLFAEYKLSRRSKLYAELDRTHWSGGFQGGQNKDVATGVTAGLMHSF

SEQ ID NO: 11060 - protein, 202 aa, Phenylobacterium zucineum
MKNRLLILSLLVSVPAFAWQPQTGDIIFQISRSSQSKAIQLATHTDYSHTGMLVIRNKKPYVFEAVGPVKYTPLKQWIAHGEKGKYVVRRVEGGLSVEQQQKLAQTAKRYLGKPYDFSFSWSDDRQYCSEVVWKVYQNALGMRVGEQQKLKEFDLSSPQVQAKLKERYGKNIPLEETVVSPQAVFDAPQLTTVAKEWPLFSW

SEQ ID NO: 11061 - protein, 539 aa, Phenylobacterium zucineum
MTKLFWNALKFSPVVFAATFFASNSALAGEAVTSVSQLTQASKAQNIGQVTSVSQFSDVQPTDWAFQALQSLVERYGCIAGYPNGTYRGNRALTRYEFAAGLNACLDRVNELIATATADLVSKQDLATLQRLQEEFSAELATLRGRVDALEARTAELEANQFSTTTKLSGEAIFSVSQAFGDTRALPSGSQAARSDLDSNLAFANRVRLTLNSSFTGTDQLQTRLNAGNIIANNANNIGNASTGTNMTRLGYDGGTDNSVTIDKLNYAFNLSDSIRVKIDATGAELNENANVFNPDFRSSGSGALSRYGRFSPIYRQANDGAGITVNVNPNGPLTFTAAYVATGRNNAANPADGNGLFDGNNAIFGQVSFKPNQALNLGFAYARTYQQTPNLFGSTGSSFANNPFAGARTEANHYGFQATFQPSSTLTLGGWVGYTTAEAVTGANRDADAFYWAASLGIKDFGREGNTLGLIFGQPPKITGGNNIASESGTSYHLEGLYKLKLTDNILVTPGLLVIFNPENNNNNDTIYVGTLRTTFTF

SEQ ID NO: 11062 - protein, 648 aa, Phenylobacterium zucineum
MRSLLKISICAAVFINLPLFANEDKVLPEVKVVSATGFEQNIKDAPATLSVITQDALEKRNHKDVESMVKDVPSLFGTTPEAANRRGISIRGFSPRFTKILVNGMPVPGDNAYKGLRSVGGSYSFIPPASAISRIEVIRGPMSSLYGSDALGGVINIITDEFSNEFSANLGSSYKFARNKNISGEFYNSLYLHSGLIDDVLSVSVYGKNLNKSEDKISYANREQKDRNFGTKLFFRPNENNDITLELARSDVKYKRSKGKTLSTGTNSVASERIKGDVINLSHEARLDNILLQSYLSYGKIKEIAQQNLTLKTLNFDTKGSYFTDNNAFTLGLNAKKEKLDEKATTADAANVKRYDISLYGEDDYHLTKDFILSTGVRYNYDENYGSHVSPRIYGIYNLNDFFALKGGVSTGYATPDIKQRTQDLALPFAGGRGAQLGRSSLKPETSVSYEFGGVYNDNEGFEASLTGFYTSFKDMLSYSPICSRGSVCRHKGKIYPNGIWESVNIGKAEIYGVELTNEWQVTNALRLNQSYVYTRSKQKDGAEIGKSLNNYPLHTFKFGANYELNRWLNFWSQINYYGRSKDSLSYDDDIRPYVIADLGINYNVTKNFSLNLSVYNLFNEYFTTRSGRYDILIADGQKIELGFNLKF

SEQ ID NO: 11063 - protein, 387 aa, Phenylobacterium zucineum
MKRYVLTPLAIALAGLTGAAHAQSSVTLYGIIDAGIGYVHNADGNGKQVGMINGNMNGNRWGIKGSEDLGGGLKAVFQLESGFDPGTGRLNQGGREFGRQAFVGLTSDKYGTVTLGRQYDPLVDMAQGITGDNFFGGMFATPGDVDNYDNSLRTSNAVKYVSPTYAGFQVEGLYGFSNGAGTTGQGQTWSGAATYNNGPVSLAAGYFYANNPTANRTTGWNSASSDSLFNSPVNNGYSSAHSIGIARVAGQYVFGSATVGLSYSNARYSPDGKSGFSETEKYNIGNVFAAYQLTPALLVGAGYTYMKASGDTSASYHQASLGADYALSKRTDFYAMAAYQHASGTQSVYDATTGKRTTQAAQASIGSYGYAGTSHQEIAIVGIRHKF

SEQ ID NO: 11064 - protein, 660 aa, Phenylobacterium zucineum
MTSRPHRLFGKAALLASSILAGTILPAHGQQAIQLAPVDVEGKAPREVETTSIIDQEQIDQEQPKDMRQLFRHDPAVTVSGGSAAAQKFFVHGVEQSNLNVSIDGITQRSNIWHHNGSTTLDPLFLKAVQVEAGVAPADAGPGALGGAVKMETKDAKDMLLPGQTAGGTIIASYNTNSQSFRTTGSGYAAQDGFEVLGVLTRNMGENYINGDGNGEPGTKDHLQSGLAKLAYENAGGHRFGVSGEYAEDNAVRRMRPNLGEVSQGTGRLYNTTRATRLSTGITYETTAPTDTYDPKVNLFYNRVGLQRPNDTNQTAVASGVFNSNIETMGFKAQNTFAIPTGKLTAGVDFENSDAFVHRYLKRTNADEQARNYGLFAQARISPWTDWKLSTGLRADYQTYHTVDEKDFNNFGLSPNASAEYAITPALSAFGGYSYVFGGLSLPETGLLHAYEMTTSDDIKPTRSHNFRTGLRYDDSGLKLEGALFRTQMYDTLFYNYTNSIRINGASLRSQGIDLAGSYDWGGAKLWGKYNFTQARYASRMALPSDYNLATPVGHVLNMGAEYTLEPIRVTVGGAAEMAKGIHDEALTRGNFQPMKGYAVFDLFGQWQPLESYEHWTLRLEANNVLDKKYVARGSYTTANNITLVYEEGRSFLLSTTLKF

SEQ ID NO: 11065 - protein, 736 aa, Phenylobacterium zucineum
MAQEAVSQLPTIHTKATQEESLKVDQSANSKFVAPLKDTPKSVSILSQKLIKDTNSNTLLEALRYEPGITLGAGEGGTPFTDMPYIRGYSGQSSIYVDGVRNTTSQNRDMFAIEQVEVIKGSSSALGGGGSVGGSINLIPKVAHEGDVYQGSVQSGTDNYRHIQLDANKDFGNGIAGRVVIMGHENEKAGQSNGAEYKRVGIAPSITFGLDTATRGTLSYYYLRSNDEPDAGIPFNNANPAKPPVGVTVTPGDGKPVDVKAGTYYGWKARDFDKRENHIGTFKLEHDFNENLTLSNIATYNKSKSDYVYTNADDSKGNIYRGTVARRALSRILDTDAYSDQLSLRGKFNTGSLKHSFNVGTEWSFQETDQGVHTFTNAAGETTSTILDSNIQNCTSAAAVANGWCTSLNNPGNGAFTDKRGSITAQSTTRSHNVGIYALDSIEFNPQWLLNLGVRWDKFETEKKYNKDVDGRTPHKAGDKLESDTDYFSYQAGLVFKPTEDGSIYLSYATSANPVGVLAEGDTGSDSISDSGTASASANALKPEEARTFELGTKWDLFNNRANLTAAVFRTEKQNTRIQIDPTTTANAGKSKVDGFEISLNGKITDKWDVSTGYSYLDSEITEAAYNAVAQEGKPLPFVAKNSATLWSTYRVMPQLTLGAGVEYRDQVFVNTTAPKYLPTYTIYNAMAKYDVNKNVNLQLNINNISDKRYFTSAHAAHYAFEGNGRNAVLAINFKY

SEQ ID NO: 11066 - protein, 425 aa, Phenylobacterium zucineum
MTVLGLTLAYQTVFALPVGANMAISMKPASGGMSGAAFTLPQEVSAAVFGNPATLTQFSGTQFGLGASILKIELENTQTGAGGTNVSDSIADNYVIPDFGFSNQIGEGWVIGAGVQVDAGLGADFRDDPVRVGALAGTELPFTSELLSFNANLSIAKQITPSTSIGAAATVGFGLLQLGTTGESGPDIPTGQFGGTTASVHDTGARFSLGITQQVSETIVLSALYKSKLKYEFEDVTFTTVAPEGFQTLTVEQPAEYVLGAAMHLSPLWLVEIDIQRNLWGDASTYQDIYEDQTIFMLGTQYTLGDWRFRLGYSHQSDQFREEPNNSINSLHGLGSIPLPFVGNDLIKIVQTASAPVVSSDSLSLGIGYNISSSARIDTFAAYSFEESLTRDTPNVDAALGLPVSSSYRADVALWAVGVGVSFTF

SEQ ID NO: 11067 - protein, 658 aa, Phenylobacterium zucineum
MSNVLLKLLLASPALVSSGLVASGAIAAESLPSALEPTATSKELAQTVTPAPAELLAQAIQPQPAAPVHLTSNAQPQVFAQSRTAPSVDQLEADPLRPKQSTASMSQVTSVSQLSDVRPTDWAFQALQSLVEKYGCIAGYPDGTFRGNRAATRYELAAALNACLDVISDRFATKEDLAAVRKLQEEFAAELATLRGRVDGLEARTAKLEAQQFSTTTKLRGVAVFSFSDSLAGNLVFGSRPEGVPKTAEPPGGYPDGTRGGDPDDNPIVTYRVRLNLDTSFTGKDLLRTRLQAANVPNYNNSLGLAGGLGFSNSSRLGYEANSGGLFTLDKLFYRFPVFGKGTLQVDALRLEYNDNVFNFNPVFESSDRGALSRFGRFNPIYRISGEAGVTFNYPVIVQDKRNVLTLSAAYSGGLAGGPFSAGNPSNPGGVPGNPGGSGLWGGPYSALAQVEWAPLKDLRLGFTYVYSYGIDVSGGTGTTFASNPFGTLTSPGQLNFGSAGNAANNVGFQFTWRAIPKLTVSGWAGYSQVYGVQGVAGNSGQNLSADVINWGLTLGAPDLWRKGDLAGLIIGTPPTVISSNADQPFLTSAGGGTDVCPNVGGCKRVDQTLPFLVEGLYRFQVNPNISVTPGVIAVFNANGNDQNDPVVLGVIRTTFTF

SEQ ID NO: 11068 - protein, 690 aa, Phenylobacterium zucineum
MNFSRLFSKTPLALACAATCFTGVISAQEAGQLEEVIVTATKRAQSLQEVGMSISVLSEQSIEEMGIDSYLDFAVRIPNLGTAFQSDGRFDANSPSLRGVFGSGDKSSSATTGIYIDDVPVTSALQPRVLDLERIEVLRGPQGSLYGARSMGGTIRLITQQPSLDESSGSIHTTVSSVADGGENYAFDGNINIPLIEDKLGLRVAAYYGSISGIYDRVYEPNWLNYQTGETVQGTTPAFDRNEDVDDEDYYGTQIAMKWMPTDNLSITPKFMYQKIKADGLPFADVDAENMETRRFFDSDEPGEDEWWMGSVVINWSISAGDITSTTAIYERETSEFEEEHTFLDFIYGAAVGIPITPLESVLETTSEYENVTHETRYTSNLDGRLNYTVGFFYGDSEFTRGYPPALQPGANAALDSALGIPAPGTAGIVPGDLIFITSQPEQVEELALFGEFTFDLTDRLALTAGGRWYDTEVSYNANSDGFANGGPSEFSGVQSESGFNPKVMASFDATDELNFYASASKGFRIGGVNGQVSPTLCGDELDRVGLDPDSLRTYDSDSLWSYEVGVKSRLADNRLSLNAAAFFIDWSDSLQVQRLACGFQVDANVGDVESKGFEVELSAAPIEGLTIDVGVGYTDTEVASASGDGFPGYAEGQHCMVFPTGPARVQRNTSFSAFSGWDGRLRQMLTTTR

SEQ ID NO: 11069 - protein, 729 aa, Phenylobacterium zucineum
MKTSKISQLILLSYLLPSAVWAADIEENEKIDASKLEVITVTAQRRGENIQKVPVAVTAMNAEMLEKQDVHDLNTIATRVPGLSFSPFAPGQNIISLRGASSNDDGAGTDNSVAVFVDDVYLGRVSNVNPEMFDIERVEVLRGPQGTLYGKNTIGGAINIISKLPSLDELDAKLRLNIGNYGRRDVAGYINGPLGDNIAAKLSFSSRKNDGWVDNVTLNSKQKDNDVFAGRAQLLYEGDNFQALFSGDYSKLDVTDMARTPVDTGAKGDPAVWSPAYVAACKEGAPFCAAGAVDGYAKQKAYGVSAKLTWDLDLGELISISAYRDSESDWNMDATGSPALALIDDIIDNSDQFSQEFRWVGQTDSFNYVAGAWYMNENTDRSECFDLSLDTDCSTGMDGSDFYHQVNETNSYALFGQFDWKFTTDWILTVGGRYSYETKEIDNVAKAGDFVIINENFGIDSPVTLKESWGAFTPKVALKYTVSDDTTAYLSFAKGFKSGGFAAAPQSLAETKPLEPEEATNFEFGIKSDISDTFRLNTTIFHTDYKNLQIQSFGPRSSGEDFGVFNTFNAGDAKIDGIELEFTWLPTDNLKLYGFYGYMDSEFVDTVVPNSAYPNQSGQEMLRTPKNKYSINLEHNIDLDSGDYFTTNLNYRFTDEQRGELEPYAIQPAFKLLDASFTWHSANDNWEVSIWGKNLTEEVYITHVYTVASSVVAVYGEPRMYGVSVSWSM

SEQ ID NO: 11070 - protein, 717 aa, Phenylobacterium zucineum
MLHRKTIALAATLAWATPLSIAFAQQNDNAANPAVTTTLPEVKVTATDDASSELTHSYAAHAVTVGSKIPQTLRETPQSISVVTRQRMDDQNITKIEDVLKQTTGVNVTRLDGAGNFNSIQARGFDIGTIQLDGLAISQGANYSTALDTAIYDRIEVLRGPAGLLQGAGEPGGTINLVRKRARADFAGSVGVMLGSWDTRRAEFDLTGKLDEAGRIRARVVGLVDDRESFVNTLQSKKNLGYGTVEIDLTSRTTLSLGLAHQKVDSVVDQGLPALANYTLPNVSRSTFIGSKNNVQDMQTDDMFAELEHKFDDGGLFKFAARQIDRSMIYKALRANGLASVATGDVAYQTVNFQQEATNVNLDAYYAGPFQLGGRTHKVLVGVNRSTEESKNRSVFGPTGTMNIYHPNNDLPYPELNIGNYNNGSKQTQTGLYGQVQLKPLDRWTFLLGGRLGRWETESRNPTTGVVSSTSRPGTQFTPLSSVIYTLSDNSSLYGSYAETFVGQTAIDRNGKLLDPRTGSQIEFGIKSEWFDKRVNTSFAIFRIIDKDRAIDDTSTPSLTDSIPGGKVRSQGLEAEVSGQVAPGWELVAGYAYTATKFLQAPIASVGQAFSPFTPRHSFNLWSKHSWRDGALNRWSLAGGLKAVSDFASGTGATRVVGDGYVTVSGQVGYQIDSTTTASLTVTNLFDKKYYEKVSNFGRQNFYGEPRAVMLAVKKVF

SEQ ID NO: 11071 - protein, 805 aa, Phenylobacterium zucineum
MTPRQPYRLPFKALSLAIAMAALAPTAMAADTTPRTYHLAAGPLADVLARFAASAGVPLSFDPALLNGLQSQGLQGNYSVPEGFTRLLAGSGYSLITTDSGGYTLAPTVDLGNALELGATTINSDLAASSDTWQGGQVARSARLGVLGDQAISDVPFSVTSYTAKTIADQQARTLGDVLLNDASVRQSAGFGNFSQVFTIRGLPLNTDDISYNGLYGVLPRQIVTTEALERVEVFKGSSAFLNGVAPQGSGIGGAINLVPKRAEDTPTRHVTLDYATGDNIGGHLDLGTRFGEDNRFGARINLAQHDGGTGVDDEAQHSTLVAVALDYRGERLRLSTDLGYQKERINQGRAVIYPTGSKVPHAPSARDNYSQAWSWSQLEDTYGMLNAEYDLNDNWMLYAGAGAKHTRENGEYSSLYVSDANGTARGGFLYSPHDEDNKSAVAGLNGRFATGPVSHRVNFGLSGMWGEQRSAYEALAASKRYDSNLYNPVKVPRPTDTYFGSDLHDPRIVGKNRNKSVALSDTLGFLDDRVLLTVGVRRQSISVDSWATATGVRNTPYDESITTPVYGLVIKPWEHVSFYANRIEGLAQGPTAPSSVSNANEVFPPKRSKQVEAGVKLDWNSFGATLGVYRIEQPNSVTYRAPGAALDTFSMDGEQVNKGVELNLFGEPVDGLRLLTGAVFMHTEQKHTAYGSNDGNRAAGVPRFQYNLGADWDVPGIQGAALSARLLRTGGQYVNAANSLSIPAWTRVDLGARYRFKVDDKHVTLRANVENVANKAYWASASTSNNYLTQGTPRVLRLSASVDF

SEQ ID NO: 11072 - protein, 706 aa, Phenylobacterium zucineum
MHHSRFHFKLIPLAVVSTCFGNAAFAEDSMPSSQGGLQIVSPVVVTATRAAQRSFDLPVAIDLVDKENIQNGLPQMTLSESLIRVPGITAQNRTQMAQDPQISTRGFGARSAFGVRGVRLYVDGIPLSFPDGSGQPGSVDLGVMQGIEVMRGPFSALYGNSSGGVVQLLTENAPAGHELSAGVLFGSYNTHRENARAAGTADGLEYLINYSNYSSDGYRDHSRNKKEQGTAKFSFNLSEDTKLTTLINWFDQKADDPLGLTRAEVRADHNQAAPSAYRADTRVSRSQTQVGFNLEHKINDNNSINLISYVGTRRNEQYLSISQVNGNGRASSIDREFWGADLRWNNKGELISRPYSISLGLTYGKMNDDRLDIEAVNGIKTGTLNRDEENIATNSDQYIQAQWSVLDSLNLHFGARRTKVKLEVDDHRGTNDGSVTYEKTTPVYGVVWKVSPIWNIYANYGKGFETPTFAEAAYATVTPAVTGPNLGLKPSESRNFEVGTKAFIGSNTVANLTLFNVRTDDEIVVQQNLNNNVTYMNASKTKRNGVELSIDSKLANNISLFGSYTLLRAKFDDTYSYPVTRFGNTTINTVQSGNYIPGTYRSQIYGEIAWKHQASGFNTAFEARHNSKVYTDDQNSDSARSYTLFNIRAGFQQKLQNWRFSEYVRVENIFDKDYIGSIRVNDGNRRFYEPAAGRNWLLGLNATYIF

SEQ ID NO: 11073 - protein, 2363 aa, Phenylobacterium zucineum
MRMTHIFSMVSIFMLPTLSIGSCLNDNGTYTCSGSDIPVLNVGSSTATHFLYENVTGNFGPSLSSDGDYAFKFTDQAGPGTDATDGKHMNGQPGGEGYSSYDMSLMMHFDKGFGIDSATGGISIEGNGGIGGNANEDKKYSTTAYGGVGGAGGNGSVVTITANADNGGVPPFPITAKNGPGIIVLSRGGNGGEGGEGHNHSGGVHQGNGGNGGAGGNGGDITVRLDDQHSVDIATSASSGIALVSVAGNGNTAGEGVSSNKATGGTGGAGGNGGIVELTADSSSNAISTSGDAGHGIVAISEAGDGGTGGEGDGTAEGVGGVGGHGGTAGEINVTFAGDITTSGAQAQGVFIQSIGGASGSGGKGDSWFDSDSGLASVPGPGGEATISYANGTITTKGDEASAILVESVGGFAGSSGGASGFVGYGANGASGGDGNTVTTTLNAVSVATTGNSSIGLSALSVGGGGGVGSKDDGFVTIGAAGGAGGAGGNVTVTLTDTNTITTKGDDASGIFVLSAGGGGGTSGGNEGVVALGGAGGKGGNGDVATFSADGNTTITTEGEYAVGVMISSIGNGGGKSTSPTGPWALGANGGDGGSGSDVTFDLKSGTLGVTTQGSIADGVLISSVGGGGGHGGSSLAALDIIKPVLGSQGGDGGSGGDITVTSEGGSVDIETSGFKSNGFVAQSIGGGGGTGGNVVNVDIGLTFNQQTAALATTAAHHGGTVNVGNKDTVGLTGSVTTHGATSSALLVQSVGGGGGSAGNSIEAGSTLEFNHDMGAGGQDGGTGGDVTVNSKTDATTDGDHADGILVQSIGGGGGQSSNVIDANVGGEISQFIGNQGSSAGTAGSAGAVWVQTDSTVETKGDNALGVVAQSIGGGGGKAGYTVDGDVSINAGISLGSSGGAGGSSGTVELTTAGSVTTSGNLSTGVMAQSVAGGGGTAGTTVNGNAGISLSYTHGGNGGLGGMASDITLINNASVTTAGSGATGVLAQSMGGGGGSGGVTASASFGIVGDLNIAHGGDGGNGGTAGKVTLTNTENIKTSGDSSHGVFAQSLGGSGGVGGFLGTGAGSAGPISASVNVSVGGSGGKGSTADTVDITNSGQITTAGYHSTGITAQSVGGNGGDGGAIIAGAIDLSSDGSGSVNVSVGGDGGDSGTAKAVTVTNNSGGDITTSGHLSYGIFAQSIGGNGGKGGGSYAFTLSGSTGPTVDASVSIGGNGGSGSVGSSVTVENDATLKTSGGNSHGIYAQSVGGNGGVGAYGFAFAGDFFYKPGDNNLDVNANVALGGSGGSGEDAGSVTVQNNGDISTQTETAYGIYAQSVGGGGGDGGQAGSHTFGYTKKQTKTDEGKSYSLNFTMGGDQGVSGDGNDVSVTHSAGTISTVGNASYAIYAQSVGGGGGNSGNGSPGLKGWVADIKNTGEFLDDLYDTYKDVKGFPKDELSFEIDIGGQAGASGTGGNVTVENDATLTTTGDSGTAIFAQSVGGGGGSGGDGSQGLLTSITVARSGSGGGNGGNVAVTNSGNISTGGSGAMGIYAQSVGGGGGSAGDIESSIVTAVANFYETMGAQIFGKDNGGQGGDGGDVNITSTGQINTANENAHGIWVQSVGGSGGAGGNLGSKTDSVSIGSAGDAGNSGYVDIAIDGLINVKGTGSHGIFAQSASGTDGYSGGVKMRIAGTVKTEGANARAILAQSSEIGTDDPQGSESSGSTQCKDAECRGTSHIYVNKGGLVETTNSSAYETIAISGGRSNYNSDGSLSYSNMIQNEGTIQSANADSVVIANDSQGALRIHNWNGGILSGSLQLDDSNRTEFENLQAAYFHAGKTVYLGKLGNYTGYDGSTMSPYGQNIVGTSTVSLGETYAEAGTLWIDVQQNSTGTVLNDQIVFDGLAQGAQINLTGVIQPVWVGSTTLSSGNTGVLHIVSLTNDANLKTMTATLVNTPTVTYTLSNKTSDIFVNYTIDYTGSAAGIELGNNALSYARYLSSAMAAIEATASGNTEEASMHATTILNTTSADKLAAIEATASGDTEEALSMHATTILNTTSADELAAIYGSHTPEESLIGATRAVSASHRLNQLMQSCPTLDPTTGTDFLRQNDCAWVQAIGSHLNQNATGESPEFSETTWGIALGSQREIAADTFIEIVGQFETLSIDGDNFSQDGERYSLGLALKKEIGRFTLSTALTGGIYSLNYDRAYKSSQIWQQANSDIDGGFLGAEVRASAVFLGQSGYYAKPSAALAYTQVWQDSFTESGNGLLNWDVGSVSDGWLAMTPMIELGRAFSGNDHSMLAFIRAGLTVVLNKPSMDASSTLVDADASLGELNFTMGTDRCQGDLTVGFDAQLQDNLSLSIRAQTALSTNSYDYGGSAKLEFRF

SEQ ID NO: 11074 - protein, 251 aa, Phenylobacterium zucineum
MVRTAKSAPYLGNVGLEMMGGNKTAGIGACLALATGVLAGAPMARAADMTTPVKAVAPVSEPSPWFVRVGVGGLFFDSSTNILLGNAPVPFSDATADNNWTVVFDIGYYITPNISLSLTGGYPPTTTLTGQGSLAALGALGKTTYGPAALTAQYHFNQFGAFQPYVGAGIAYAIIFNSNDGAVKNLKVNGAPAFVLQAGAEYAIDQHWGVFADVKKLFLEVDATGIVAGLPVQADITLDPLIVSFGASYRF

SEQ ID NO: 11075 - protein, 490 aa, Phenylobacterium zucineum
MNSSRSVNPRPSFAPRALSLAIALLLGAPAFAANSGEAPKNFGLDVKITGESENDRDLGTAPGGTLNDIGIDLRPWAFGQWGDWSAYFMGQAVAATDTIETDTLQSDTDDGNNSRNDGREPDKSYLAAREFWVDYAGLTAYPGEHLRFGRQRLREDSGQWQDTNIEALNWSFETTLLNAHAGVAQRFSEYRTDLDELAPEDKDRTHVFGDISTQWAPHHRIGVRIHHADDSGHLRRPGEEVDNLDKTYTGQLTWLGIEATGDAYNYRSSMPLNYWASATWLTGDRDNLTTTTVDDRRIATGKQSGDVNAFGVDLGLRWNIDEQWKAGVGYARGSGGGKDGEEQFQQTGLESNRSNFTGTRSRVHRFGEAFRGELSNLQAATLFGSWQLREDYDASLVYHKFWRVDDDSDIGTSGINAALQPGEKDIGQELDLVVTKYFKQGLLPASMSQYVDEPSALIRFRGGLFKPGDAYGPGTDSTMHRAFVDFIWRF

SEQ ID NO: 11076 - protein, 430 aa, Phenylobacterium zucineum
MIKSNMFKLLKAVFVICPFVFASMADSAGFALYEFSARGNAMGGAVMANKAEPASIATNPALITQLEGTQLQTGITAVIVSGSTTIGTEKRDLETGAFYLPAFFLTQQLREDVFFGLGFFPRYGLGGRYKDYETWSMGTVLREAYTVDLMTYSFNPNLAVKVTDDLSFAMGLEVMFLDFQERKHLVGGAKMDISGNSTTWGGNFGVLYNPGWAEKWAAALTYRTKTRHVATGRVKTPGLALPPAISFDGNASAALTLPDQLAFGLSFTPTNKLTMEANIMGIFWSSYSQLKIDYDDLSQSPGGPGNPPYLNENKNYKDVFRIGFGVEYSLNPTWDLRAGYVFDKSPINKKYMDTLVPADDRNIFSVGAGYNVSERMGIDVSYSYVLISDLSGRNVEKGNTVFKYEDASSHMIGLSFKYAFGNGPLSNRVI

SEQ ID NO: 11077 - protein, 367 aa, Phenylobacterium zucineum
MAVTTNHNKQSKERRMKRTALALACIGLTGTGSVCAQSSVTMYGLVDAGVEYVNHAGPNGSVVKLTSGGRNTSRWGMRGVEDLGGGLKAVFNLESGIAIDTGNLDTSGTLFDRRATVGLSSNYGQVVMGRTFTTTYDFMLPFDPMGYAPNYSWATSSTATGGRKDGLFSRASNAVRYDGKFGGLKLGATAAMGEVAGDFKTASKYALGVGYNAGKFAAAATWDRQNGAGSSTTPADTTDYIQGIHAGASYDFGSLSLFAGYRNYKRTLTTGAASERSDMYWGGASYDFTPAFTLYGAVYKQNIKGGNDADPILFSLRAQYSFSKRTLAYLSAGYAKARNGQNVSLSRDFVGYANSQTGVMAGLQHRF

SEQ ID NO: 11078 - protein, 367 aa, Phenylobacterium zucineum
MHITYLLHIDDNISRNNVSMCELLVMKKISYCILSLGIACNASANTNTEDETIYIGGKIGWTHFSNGCESQNLDCDKEAMGGGVFLGYKLNEWLAIEGGYDYLGKAKAIYPSLDDPSIDAPYSAKFQGIELGLKADYYLNDNWNVFGKVGGLGWRADKKGEELNYDVEGRDQDISLMLGAGLEYRLTKQLKTRFEYQWFDSVGGENTGGSNINFITIGLTYSFGSKEEVVVIAEPDPPVRIVKAEKLTLNELNGQALFGFDSAKLSSEVEAHFDSILERLKNNPTSELSIVGHTDSQGSDKYNEGLSLRRAQSVANYFESNGIAMSRIKVEGRGETDPVADNNTLKGRSMNRRVDLISPAFTSEVKP

SEQ ID NO: 11079 - protein, 1064 aa, Phenylobacterium zucineum
MLKVLRLIFTFMLVLTAAGVNAQVTTSAISGKVTDEQNETVIGATIVAVHEPSGTQYGAITNVDGRYTIQGMRTGGPYKLTVSYVGYQSAVFTGIMLELGNTYTQNVKLHPSSELLDEVVVVADAKTQSGAATNFSANSIENTPTVDRNIYDIVKNSPLAMTSKNGGITFVGSNNRYNSFQIDGTVANDVFGLSAGGTNGAQTGANPISMDAIQEIQVVVAPYDVRQSGFTGGGINAITKQGTNETHGSAYTYFNNQNMYGKYSAVRGYEKSPMSQQFDRTYGGTLGGAIIKNKLFYFVSAEGKKNSYPSSTYPGYTTNYITSATAKQIADQYKKLTGIEETYGERDIEQKSFGLLARVDWNISEKHKLAVRYQHNNSYKDVYGANSTTYYFGNSGYRMNNKMNSVVAELNSRLGDNLYNELRASGTFVRDFRDTEYSGPCVQISNVTGGDGETKITANIGTEFSSGANKLNQDVYSFEDNLSWYLGNHTLTFGTHNEIYKISNLFIQASEGAWYYNSLDYFLQDKPYKFTYKYSDPDMTGGNLKYAPVMKAGQFGFYAQDKWVVSRDFNFTYGIRFDIPLLFNKPTVNPTFNDFAAGRNMGVRVGETPSAKLMVSPRVGFSWYIDEEHRTLIRGGVGIFTGRVPFVWLSNSFNNTGMEQKGTTLQPKDESGKNDTNEAPSLGEYKDNPLAAATGSMKQDIVTTDKKFKYPQVLRANLAWEQFLPGDVKMTLEGVYSKTMNNVFFENLALVENGQVYAVPGVEASASPSYKVQAGDYYSIINLKNTNKGYSYALSALLEKHFGFGLDMSASYTFGHSKSVNDGTSSVAYSNWKYNYSRDTNSGNELGFSKFDIPHRVMAQVAYTTPKYWNNWMSTSISVIYNGFSGNRYSLTMNETSDFNGDGQKGNSLLYIPTDEELDKMKFVDATNKKGEVTMTAEESRQAFKQWIEGDAYAKDHRGQYAERNSNLTKWEHEINLHLAQTIYNPKGLGKLEFTFDIINFANMLNKKWGATYGSLYNLSPISVTKLTTVDGQTTPNYIYNKSEITKSDVSSRWHAQVGIRLTF

SEQ ID NO: 11080 - protein, 406 aa, Phenylobacterium zucineum
MRFKSQFSLSLFLGLFFTWCLPIKGVASEELAISDVVPSAYTGNGLSYKSDNQQFSLRVRGRIQFRYANPGAGQPTQPSDFDHVGGNQFGVNRARIKVDGHIGKPWFTYSIEYDAADQRTLNATVAFEKYDSLSAKLGQWKVEYSRERSVSSGGQQMMDRSIINRIFTLDRQMGASIYGHIDNGGAANFNYWAGMFNGSGRGDYSNHDGEAMYSGRLQWNFLGKEVGFKNSDIARSSTPKAAIAIAGAKFKSQFTRFSSSGAGNLTNFDEGEVEGQYDIRQFVIDGAYFYKGFSAQAEYHEKNIVDVANDNIETTLRGYYIQAGYFLNASISWWPKPLEIAARFATYSPNTSEEDQSFYEKTVALNWFFNGHKNKLTAQASRVSLEQLGSEVGDSTIYSLQWDVSF

SEQ ID NO: 11081 - protein, 715 aa, Phenylobacterium zucineum
MIFKNNKIMQLWVLSLATVSTTTFAKTQEETILVTQGVSQEPTAPVKGMVATKTLSATKTSAELVKTPQSVSVVTRDQMDALDATSVSQALRYTAGAFTEYRGSSNRNDEVFVRGFSYVPKFLDGLSFGATASSQTGTVDPWLLERVELVRGPASVLFGQVNPGGLISMTSKRPTSEPIHKVQFSTGNRDLAEGAFDFGGPLSDDGRVLYRLNGIARTQHNQVEDYKDSRVAIAPAITWYPNDQTRFTLLTSYQKDPDAGYRNFLPAYGTVTSANGKYIPLDFNVSDPDYDQSWREQTMVGYEFEHQFNDMMTFRQNARYASIKQKYRYLVYFNSKPESTLLSRRAQHEERTTNEFGIDNQLEAQFATAQMNHTLLGGLDYKSSNDKQLLMRGSGSQYDMDWTHPVYGVNVDESTFSPASHEQQNLDQMGLYLQDQMSWNNWELLLSGRYDWTEVRTTDYINSEKTQQNDNKFTWRTGLLYAFDFGLSPYISYSTSYEPNLQTNRAPDSAPFKPTTGKQTEVGVKYQPVDNTLMSLALYDLKQSNVSTYNSTLGWFENAGEVRSKGVEAEIHSSLWDSVNLIGSYTYTDAETVNTTVAGTEGKTPARIPAHMASAFASYTFPGGPLKSLTTGVGVRYIGTSYGDAKNTFKVPAVDLYDAMVSYELGELNSSLKGAAVQFNVNNIADTKYVASCASDTACFYGVGRTVTATVSYSW

SEQ ID NO: 11082 - protein, 930 aa, Phenylobacterium zucineum
MHRNNILTHSIRTALISGVAVVAFTTPVAFAAEDGAKVERIEVTGSRIKRTDMESASPVLSMNRDEIEATGMISIGDILQTIPAAGSALNTAFNNGGNGSTNMDLRNLGSQRLLVLVNGKRWISSLGSTVDLNTIPTSAIERIDVLKDGASAVYGSDAIAGVVNIITRKNFEGVEVSVYGGQNSKYDDGRQYTADITFGSVSEKGGLLFNMSHVTQQPIWAGDRDISATGYSSTADNTRLKVKGSQFNQANQDALAAVGTANSSGIYDFMSKEGTGVNVGVDQLRPRTGSDVYNFAPDNYLSTPQNRNSFYVQGFYDISDDLRFVSDFMMTNRKSSQELAPMPLTLGASFGEAASRVDIGANNIYNPFGEKLYGSNARAVANGEAAGYVPYALQRRMIEAGSRQYNQNDTTYRAMVGLEGNIGDNWTWSATYIYGQNNQDILTTGLLNLTRINQALGDDCNAANGCVALNLFGGPGTITEDMVDYITFDSVSRSGLTMKDYAFNISGDLFDLPAGAVGIAIGLERREESGFDTPDPLTVTGESSGNQRDATAGGFRLDEAYTELSIPILENLLLTPAIRVSDHDAYGNSTTGKVGLEFRPMDDMLLRGTWAQGYRAPSISDLYAGNADSYPTWTDPCNTRDDKGNPVDISGKPGCAAVPDGYRQANTQIRISQVSSPDLKPETSESYTFGTVYNPSWLEGAELTLDYYNIKVEDAIGRYGHTRIATECADGDNQAACGNIDRDSLGNIVDLRNYLQNAGTYEVEGVDFFTAYRFPESSFGTFKASLDLAYVINNKSDGEDRAGIQFGDGGFPKLKGNLNIDWVMGDWDAHWKTRYVGAMDNDYVETYGFTAAKNGITERFDSYMVHNVSVGYNFDSYNTKVAVGINNLFAKEPQWEAPDNGLAISTNNFSVTEYDVNMDRFVYLRATTKF

SEQ ID NO: 11083 - protein, 187 aa, Phenylobacterium zucineum
MRRRFSILIWFTSEGVMLKRIIWILFLLGLTWGCELFAHDGTVNISGSFRRNTCVLAQDSKQINVQLGDVSLTRFSHGNYGPEKSFIINLQDCGTDVSTVDVTFSGTPDGVQSEMLSIESGTDAASGLAIAILDDAKILIPLNQASKDYSLHSGKVPLTFYAQLRPVNSDVQSGKVNASATFVLHYD

SEQ ID NO: 11084 - protein, 805 aa, Phenylobacterium zucineum
MISRGCKVNKFFAVLMMCCIPQVVWANTEKKQIVFLDEISVESKGAAFRSDPLSGLPKQNDILVSKQKLKTGSSTLGNALAGELSVHSNQFGGGSSAPVVRGQEGVRLKILQNGSDVIDMSQLSPDHAIGVDTLLAEQVEIVRGASTLLYANASPAGVINVVDKRIPTQLPKKGYEVDFNTRYNTNSHEKLVTAALTFGLGKHIALRVEELLRGSNNYHVPAFKLDKTLNYVPDTQNKTKSGNYGVAFIGERGYVGFAYNLRREKYGLPGHNHKLDSCAAHIWGGNVRNDYYLGLYPHLMHDTDLVNTHFHCGSNHDMDGKHSHNHPYGHDHDHSIAGPLIDSYAKRYDIRAEVKQPMKAIEKIKLSYSETRYKHDEKDGNIAVNLFKNNGYNLRVEIFHTPIAGLSGVIGAQYQTQTSSANIPRIAPCSNNASDPCHKKKQRDPSKITKGDRKSWALIENTQSQMSFFAIEQLRWQDFLFEIGVRTEKQRIDIEYDRAWLFKVKRKLEGCDPNSFFYSPSGCRQGSYPAPDFASYHDRATSYSGAISWNMTPDYTLSLTYSHNERHPTPMELYYHGKHLATVSFEHGNRNLKKEVSDNWEVGLAYLGDKLSYKVNVYYNDFKNRIFNQTLNKSGNLSLNRYNQSKAKYYGVEGRIDYALTPELHMGLFGDYVRGKLYDLPPTYRVDHVANSLEPVTQPDQDAPRVPPMRLGFRVNMEMTESLTSSLEYTYVYQQKKVAPLENQTAAYSLLNIGVDYSRQIAGVNYQLFVQANNVLNRKVYSHTSFLPFVPQMGRNVTLGLNIHF

SEQ ID NO: 11085 - protein, 1052 aa, Phenylobacterium zucineum
MKSMKKSPKQNWESNIRRTPIILGLSAALCMPSAFSYANASDPVAGELVQSVQQGRTVTGKIIDDTGEPLIGVSVLVKGTTVGTITDFDGNYSLEVPSGKNILVISYIGYKTQDITVGKSNQLNIKMEADTQALDEVVVVGYGVMKKRDLTGSIASVKAADIVKSPASNAMEALQGQVPGLDIVRNSGKATSGVTINIRGQRSLSDVKDEFGNNVANAPLFIIDGMQGGDFSDIAPADIESIEVLKDASSTAIYGSQGANGVIIITTKKGAQGKTKFSYNGYFGVNGWAQYPDMLSGEDYMQVRREAARTGGQWNSTADDQKLFTVEEWQAIQNGEWTDWIDEVLHTGLVQSHQVTASGGTEKTTAMLSAGYYQEKGSFKNDKMDKYNLRMNIEHKLGKTVKVGATTQVTHYAQDERAENVLWRAATNAPLGKAYDEDGKVVEYPLGKNGQVSPLVDEASEVAARHHVLKTNLIANGYLDFTPVEGLTFRSNLGTNYAFYRKQDFEGASSIDRLGQNSTSLSKIKSSEKSFVNWDNIISYNKTVKDHTFGATALTSWTQSKYTSVNAQGEGQLVDSYLWHNLGANDKSSYVIGSDYIQHQTFSYALRFNYSYKGRYMLTVSNRWDGNSRLSKGNKWASFPSVAAAWRISDEAFMKNVEALSNLKLRLSWGKTGNSGIMAYGTQSGLTPKTNSAFQDNGYTYYIYNEYVGNENVGWEMSNTWDLGFDIGLFNNRISAVVDLYQTKTTDILLPRTLPTSMGGSNATPFKMYQNIGATMNRGIEVSVNTVNVDNKNFKWNSTLTFAANHEEITDLIDGKDIIGSDSHITTSLLIGRPLKSFYHFINEGIWQENEAEEAAKYFKDSKKTQPFKPGDIKLRDLNGDYIIDDKDETYLGSQSPKWTGGFNNNFSYKNFDLNVYIIARWGQMIDYELTGSYDPQGKGNFPAYLNYWTPENPSNDFPRPAQTNFYNYLGYQTLNYIDGSYWKIKTVSLGYTFPKSLTSKLGVSKLRAYVTANNLFSFAKNHLIQDYDAERGGSAKAPLQRQFIFGLNLDF

SEQ ID NO: 11086 - protein, 192 aa, Phenylobacterium zucineum
MLKSTFLLGLVGLVSLPTLAAGIEGGPYIGAGLGVYQDSDTDGAGNLDAESMGYSLYGGYQFNRIVGIELGYTDYADYEKFGTKLLSPTSLSVAANVGYTFDNSIRPFVTAGLSYVDLNSSNSAFYGDDSGAGFHFGIGVEYNPVENLTLRLISQADAVNIENYAYINGNKVRLSSKDVAFSTVTLGASYNF

SEQ ID NO: 11087 - protein, 673 aa, Phenylobacterium zucineum
MSQSARSTLKLSALSLAIISNIPAVYAATKSPDANSDKSSREVITVYATGNERDSFEAPMMVTVINSQSPQSQTAGNANDLIKKIPGINIAGINRANGQDVSLRGYGPKGVLTLIDGIRQGTDTGHINGTFLDPALIKQVEVVRGPSALLYGSGALGGVIAYQTVDAADLLQAGQDHGFRVFARGATGDHSMGFGGATFAKSESLDGVFAFSTRDSGNIRHGGGVVGDNDEFISNLMAKGSWKIDDNQSLSSQLRYYRNEANQPKNPQTLTGKNKNPSTWTDRTTTQRDAQLSYQLNPAEYDWLNAKTDLYYSDITINARTKAKGFEGRKQKTYGVKLENRSRLWTDSPLAHQFTYGGETYKQKQTPDGNTDSFPDADIRFYSGWLQDEITLRDLPVSIVAGTRYDNYKGNNSKDEAVSADKWSSKGAISITPTDWSMLFTSYAQAFRAPTMGEMYNDSMHYPGNFWTPNPNLRPESNETWESGFGLRFNDLLADNDELKFKASYFDTKAKDYIKSDIVNRGRNTTSVNISSAKIWGWDASINYESNLFSWELAYNRTEGKDEKSGGSLDNLSPDTITSILEIPIAQTGFSVGWVGQFTNHTDFKGKDARGRDPKQQAGYGVNDFYVSYQGEGMLKGVTTTAVLGNAFDKEYYSPQGTPQDGRNAKLFVSYQW

SEQ ID NO: 11088 - protein, 705 aa, Phenylobacterium zucineum
MGYEYRSERAIRDNCRTYSARSVCHVVLSIEAVLAGMMVPWCSNAAGILTLNEVEVRADARNLIGTADSANEGTVLKRQLDERTVYRPGELLETVPGLIVTQHSGEGKANQYFARGFNLDHGTDLRITVDGMLVNQRSHGHGQGWADMNFIIPELAGGLRYQKGPYYADLGDFSSAGAVSMSYVDKLPRGIANYGVGQQGFIRGLLAKSYEAGNGNFLYAFELLTKDGPWINKENYKKFNAVLRYSQNTGNTRFNITAMGYGGNWNATDQIPQRAVTWGLIPRLGAIDPSDGGESHRFSLSAALQHTSNHGVTRANLYTIHSNLALFSNFTYFLDDPINGDQFSQTDKRFQSAFNLNHTWVTGLAGFAFENLAGIQVQSDVIDNGLLSTQQRRVLSVTRKDHVLENSVGLYYQNSVQWLEKFRSVAGVRSDFYWFDINSNIDANSGREYDSITNPKLSLIFGPWAKTEYYFNYGSGFHSNDARGVTTTVDPKSREPVSRVHPLVRSTGYEAGLRTAIIPGLQASITFFQLDLASELLFVGDAGTTEASRPSRRKGFELSAFYMPNNWLMMDLDYALADARFTDWDPAGNHIPGAVKGVGKFAVAVDNLGPLFGSMQIRYFGKRPQVEDNSIQSGNTVTVNGQIGIKIDKKFRVMLQVFNLFNTKAHAIDYYYTSRLPNEPDAGIADRHFHPIESRSFRINLVGNF

SEQ ID NO: 11089 - protein, 709 aa, Phenylobacterium zucineum
MKGRKIKQKQKWGLGVEKIGYGKSLMPLTVAVTGVLAAVAPIWVQAQSTDESIQLKTIQVIAPEIEPAITVQSLPEAKRAMRRVPGGANVVDSETYATGRASTVQDALGYSPGVFVQSRAGAEESRLSIRGSGIQRTFHLRGIKILQDGSRLNLADGGADFQAIEPLATRYIEVFRGGNALQYGSTMLGGAINFVTPTGYDAERFRARGEAGSFGYNRLMASSGGVHGSLDYFASVSRYSQDSFRDWAATDNWRMFSNAGYRITPDLETRFYLTYVKSDSQLPGNLTKAQLKSDPRQANAFSLFGRQKRDIDLIRVANRTVLKLGNSQQLEFSGFYSHKNLWHPIYQVLSQPTNDYGVGLRYINEMPIASYRNRFVLGFEPSWGNVMDNRFKNDGGNAGARTAKFDQHASSYVVYGENQFYLLPELSLIAGAQYTYTTRKQKDLFMAGGVDQSKSKNYQRFTPKAGLIYELNPDVQFFSNVSTSFEPPSFAELTSGPVQAPTFAKAQRAITFEVGSRGRLFNMAEWDVALYRAHVRNELLALVDPATSSPIGTANADKTVHQGIELGLDVELAKMLYLRQMYMFSDFKFDKDAVFGNNQLAGIPRHFYKAELTYRHADGYYIGPNVEWSPQKYYVDHANTLSADSYALLGFKIGKRSKSGFSWFAEARNLTDRKYAATTGVVENARGIDQAQFLPGDGRSFFAGLEYRM

SEQ ID NO: 11090 - protein, 764 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGEAGLRLSSGNLEKLTSAGINIGLGKNFVLHTEGLYRKSGDYAVPRYRNLKRLPDSHADSQTGSIGLSWVGEKGFIGAAYSDRRDRYGLPAHSHEYDDCHADIIWQKSLINKRYLQLYPHLLTEEDIDYDNPGLSCGFHDGDGAHAHTHNGKPWIDLRNKRYELRAEWKQPFPGFEALRVHLNRNDYHHDEKAGDAVENFFNNKTHNARIELRHQPIGRLKGSWGVQYLGQKSSALSAIPETVQQPMLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYEGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 11091 - protein, 174 aa, Neisseria gonorrhoeae
MKKALAALIALALPAAALAEGASGFYVQADAAHAKASSSLGSAKGFSPRISAGYRINDLRFAVDYTRYKNYKAPSTDFKLYSIGASVIYDFDTQSPVKPYFGARLSLNRASAHLGGSDSFSKTSAGLGVLAGVSYAVTPNVDLDAGYRYNYVGKVNTVKNVRSGELSAGVRVKF

SEQ ID NO: 11092 - protein, 417 aa, Neisseria gonorrhoeae
MNKKHCSLLTMSILFACNVHAAGFQVAEHSASGLGRAFSGEGAVADNASVLARNPAAMTLFKQAQFSGALSIVDPEVNVYDTYHKEDAKDVAPLQIVPAGYYISPINDQWSWGIGMFTTYGVATDYPNDISAGDMAGDTSLLSVNINPNLAYRINEQFSVGGGINLVYAHAELTRHKGELAPLFGAGGKKSDNLIGMEGDTIAWGWNIGALYELDENNRFGFGYRSKVDLDFDDGEFSSYDSGRATAPKVDGRLQISLPSIIELSAFHQLNDQWAIHYGWQQTDWSTFKELKATSPQCNDNGVAGQCFYKPEKYEDNNRYSFGGTYTLNSEWTLRAGIAYDEQAGKATLSIPDSDRFWYSAGVTYAMKENLTLDAGFAFVKSKSGSFTETNAGNRDITFDSEGTAYISAVQMNYTFK

SEQ ID NO: 11093 - protein, 349 aa, Neisseria gonorrhoeae
MKAKLTALALASVFSTPLLAQPNVTVYGVADAYFGYGEYDDNKFTGVNSGGLSGSRIGFKGSEDLGNGLKALFTLEYSLNLDRNDGIGTSSGARQQFVGLQGSFGFVGLGRQYAPGYFVNKYDTTGGSSALSPQIQLAKAAGATIDAGGGSRFNNAINYKSPSFGGLSVNAIYSFNEANQDEDRRTEDKLGVGVEYKGGPLAAGLTYQQIEGGDIDRPDDQKEWMLGGAYDFGVVKVLGSYQQVKDALGNEGNTDKIYQIGAAVPVGSGHIHAAWGKLDADAGSDHDVKSWVLAYTYSLSKRTTLYTGFLHNDNEDETNQTNLASKEIDGVTVFGEDSDNFVIGVRHTF

SEQ ID NO: 11094 - protein, 222 aa, Neisseria gonorrhoeae
MQADLAYAAERITHDYPEPTGTGKNKISTVSDYFRNIRTHSIHPRVSVGYDFGGWRIAADYARYRKWNNNKYSVSIKELKNNNNKKKKTENQENGSFHAVSSLGLSAVYDFKLNDKFKPYIGARVAYGHVRHSISTKKTTEFLTVARNRVTVPGTYKVSTTPGAHQESNSIRRVGLGVIAGVGFDITPNLTLDAGYRYHNWGRLENTRFKTHEASLGVRYRF

SEQ ID NO: 11095 - protein, 731 aa, Neisseria gonorrhoeae
MSIVRSIPAVVSAFVAVSVAPISTDAIAQDIALEEGRRPKALRVVPTDRAPIGTFELGELSTVLSEISVSGSGRESGGLPTPSQSVVTARDVYTFNKNTLDDALTVVPGVSAANSGGSRNERLIFVRGFDRFQVPLSIDGIRVYLPADNRLDFGRFLTPDLAEIQVQKGYVTVLNGPGGMGGAINLVTRKPVRAAEAEFRTGVEVGNRGIPTAFTGFGLIGTRQENYYLQASGTIRDSNGWFLSQGFRPVPIGNGPPIEDGGRRDFSAVDDYRVNLKAALTPNATDEYSLSYTKQSGAKGAPYSVFEPVSGITPMPLPRGTAFQRDWRWPYWDIDSLYFLSRTAIGDKSYLLGRAYHNSFNNLLSAFDNASLSSQRLPRSFDSFYDDTAYGGSIEFGTELIPLNTLKFAAHYRRDTHTERQFPAPGLPSSVIEPRQTSQEDTYSVAVENTFHATDQLDLVAGLSYDRNALRRAQDYNASTRALFSYPLGSTDAVNWQTAAIYRTSETGRVHASVSSRTRFPNLFERFSTRFGDAVPNPDLRPERATNYEVGWSELFLGSLRLSPAVFYSDIEDAIQSVSIGNNQIQNQNVGTGRTYGYEVASELTLSPELFVGANYTFLIRELNDPLRPALKPTGTPRHQAFVWATWQATPALSFTPSVEAASGRFSTDRLENNFFKTGGYVLVNLQAQYALDAHATAAIGVRNLFDHNYSLAYGFPEAGRTVFANVRMTF

SEQ ID NO: 11096 - protein, 278 aa, Neisseria gonorrhoeae
MQADIERCCYMKLVKRCFFFLTMITIAPFVQAEQWKGAYFGVNVGQGDVQAETDSRGVPGYFAGVGGDASGAIAQASSLTGRYASSHKGGAVGAHLGYNWPSGKIFLGLESDIQFTDLKDNAALNTINPVTGYPGNPMSANVRQVNTVDYLVTLRGRIGYVNDQWLLYGTGGVAVGRVNTNINYKGSYLSAPTIVFDDLNAGSRSTRLGFVLGAGAEYAIAKNWAVRVEYLYYDLGKSSQSYNVTSRAPATGFVASSSALATTDWTLSTLRVGISYRF

SEQ ID NO: 11097 - protein, 1037 aa, Neisseria gonorrhoeae
MDNKTITISTAPRLAGMLLAFVFLLAGQMLFAQSKQVTGVVKDVTGETVIGASVVEKGTANGTITDFDGNFKLTVGDKAVLQISFVGYQTQEINTVGKTSFVVTLKEDSEMLEEVVVVGYGAQKKESVVGAISQVSSKELLQSPAANVSQAIAGKISGVITSQTSGAPGSDDTQIYIRGRATFAGDAQPLVLVDGVEREFSQIAPDDIETISVLKDASATAVYGVRGANGVMLITTKRGREQKPEVSLTANWQIQSPTRTDTYLNSYQSVNLLEEALANDGLPSQFSANDLEMYRRSVAGELSGLEAMLYPNVDWYDEVLKSSSPAQRYNVSVRGGTKRMRYYASGELYDQKGLIKNLSNDKYGNSSSPSFRRYAFRANMDLFLTKDLTFSVNFGTRFEERKGSNTTERSDYSQIFYEMNHTPGWLFPVSTVVQNGEKQETIYGGSSQYQKNIVASLTKGGYYKATNTINETNFILDYKMDWLTEGLSVKGMASFDYNSYDKTLYQATFATYELNNRDDFGNIDAYNRFDADGELAGSKDSYTIYKLYMEAQINYARKFGRHDVTAMVLYNQNDYRYRADLAKRYQGLVGRATYGYDDRYLAEVNFGYNGSENFMKGKRFGFFPAFSLGWRISNESFMENTKEWLNNLKLRASYGQVGNDVYTVGGVAQRFLYEEKWSQISNDYMFGTSGKSGIYETQYPNYGVTWERAHKYNVGLEFGLWNGLLNGNIDLFHEKRNDILTNYLTRPEWVGVTMAAGNLGETVNSGFEIELKHNNHIGKEFQYNVGLTFSHAKNEIKNMDEPALKTDYRKREGHPIGQYYGLVCDGFVTAADVADPNFPTSTFGNVQVGDLKYRDMNNDGFIDERDETFIGYSDVPENTYALTLGCNYKGIGFSVMFQGVDHVSRYYDAEAMYAFVSGGKVKEHHLDRWNPTKSESENLASAKYPLLHYDSYGDHNQRQNSFFLKNGAFMRLKNIELSYTLPTKWIEKVGMSDCRLYVNGNNLITWDHLDDLCDPESNGSNRYPIMKTVNFGVNIKF

SEQ ID NO: 11098 - protein, 91 aa, Neisseria gonorrhoeae
MLYGTGFEASMAVQLFKTLLNQIPLLSSLQSGTLPLFGYSGWGRPMKKAHTGESGLKWEAKDSSKLIGNKDHALRGLSSPMAVIRQIRLIT

SEQ ID NO: 11099 - protein, 228 aa, Neisseria gonorrhoeae
MQADLAYAAERITHDYPEPTAPGKNKISTVSDYFRNIRTHSIHPRVSVGYDFGGWRIAADYARYRKWNNNKYSVDIENVQIREDNGNRIDRKTENQENGTFHAVSSLGLSAVYDFKLNDKFKPYIGARVSYGHVRHSIDSTKKTTEFVTSAGAPGGAPTVYPPHKNTQDDHREGNSIRRVGLGVIAGVGFDITPKLTLDAGYRYHNWGRLENTRFKTHEASLGVRYRF

SEQ ID NO: 11100 - protein, 2346 aa, Neisseria gonorrhoeae
MFLALSGAGIVPAHATCSTAGTTVTCSGVANPLAPSYSNSANNVNATVNPGASVGVLLGVGGTAMSLTGNNVTLTNNGTIDPSALGSGLGVLSSGTVVGNAAASTTTVTNNGTMMGSTGVAISGVTGMALSVQNGAGGTSTITNTGTIGSSPLVGATLTGADAPVVAAYGGGTVNMSNSGTITGRVSLGSSGTPGQGNTFTNSGTINGGVSMGANSTNTFNAVTGSSVNTAGGTGGAFNITVGPITLGVAATGVVDGGAGGNNTLNLQQGTAANGTIAANNYINFNHLDVTSGNWTINGASTAQDATLSGGVAIINNNASLGTGTVTGNGGALQAGTTGLNVSNNVSLGAGGLTVQGATGLTLSGTVSGGGALTKNDGGTLTLSGANSYTGATNLNAGGLVVGNNSALGIGALNVNASASLDASTNVTLGNTVNLATGSTLTLGGSNALGLTGTISGSGGLTKNGAATTTLSGVNTYTGDTTINSGTLALNGAGSLSATGTVNLTGAGATFDVTGASGARTIGSLAGAAGTNVTLGANSLTLNGSGNATYAGTIGGSGSVTLSGTGTQSLTGTNVYTGGTNLNGGNLVVGSNTSLGIGAVNVNGSSTLDATTNVTLANGVNLATGTTLTLGGSTDLGLGGVVSGGGGLVKNGAATLTLSGANNYAGGTTLNAGGLVLGNGSALGTGALTVGGSATLDTNTNLTVGNAINLTTGNTLTLGGSNALGLSGAISGTGSLVKNGAATTTLTGANTYTGGTTINAGTLAIGAGGSLSSTGTVNLVNPGAALDISAGSAQSIGALSGAIGTSVSLGANALTLGGTASGTFSGTIGGTGSLTLAGTGTQTLNGANTYTGGTNLNSGSLVLGNNGALGFGALNVGGAATLDTNATLSVGNAINLGTGAALTLGGSNNLALGGAISGAGSLVKDGAATTTLTGVNTYTGGTTVNGGTLAIGAGGSLASTGTMNLAGAGAMLDLSAATGGQTLGALSGVTGTNLNLGGNALTLGGTASGTFSGAIGGTGSLTLAGTGTQTLNGASTYSGGTNLNSGGLVLGNNGALGFGALNVGGAATLDTNATLSVGNAVNLGTGAALTLGGSNSLTLGGAISGAGSLVKDGAATTTLTGANTYTGGTTINAGTLAVSAGGSLASTGAMNLAGAGATLDLSAATGAQTLGALSGVAGTSLNLGGNALTLGGTASGTFGGVIGGTGGLTLSGTGTQTLSGANTYTGGTTINSGSTLALGAGGSLASTGTVNLTGSGATFNLSGASGAQTIGALTGAAGTNVNLGGNGLTLSSAGNYAFGGAIGGTGGLTLAGAGTQTLTGANTYTGGTTIGGGSTLALGAGGSLAATGAVNLAAAGATFDVSGASGAQTIGALTGAAGTNVALGANALTLNGSGNNTFGGAIGGTGAVTFAGTGTQTLTGANTYTGGTTIGGGSTLALGAGGSLASTGAVNLAGAAATFDVSGATGAQTVGALTGAAGTNVNLGANALTLNGSGSGNGTFGGTIGGTAGVTVAGTGTQTLTGANTYTGGTTINGGSTLALGAGGSLASGSAVNLAGTGATFDVSGSTGTQTIGALSGAAGTNVNLGANALTLNGSGNTTFGGTIGGTGGVTLAGTGTQTLTGANTYTGGTTINGGSTLALGAGGSLASTGAVNLAGTGATFDVSGATGTQTVGALSGAAGTNVNLGANALALNGSGSSTFGGTIGGAGGVTVASGTQMLTGDNTYTGGTTIAAGGTLQLGNGGTSGSVAGNVVDNGALIVNQSGNVTIASVLSGTGSLTQAGSGRLTLTGTSTLSGPTTVGAGTLAVNGSLGQSTVTVQNGATLTGTGTIGGLVVQGGATAAATQPGAALNVGGNVTFQPGSTFQVAATPQQSGSLAASGTATLNGGTVQVLANQSGYQPSTTYTILSASSGVQGAFTQVSANYAFLTPTLSYDPGHVYLRLVQNGTSLPDVATTPNQRSVATAVAALGAGNPLYDTVLTTDAPTARRAYGLLGGELQASLKSMLLIDSRYVRDAVTDRVRQGLAPGSGPLAALSSGGAALCGDNTAGVVDPTLPPERRIGSRDGCYGGTPYQPVVWGQAFGGRSRLAGDGNASSINRSMTGFIAGADMALNDKWRAGLAAGVTHSSLDNDQSSSAAVNSYYLSLYGGAQYGALGVRGGASYTWYRINSDRYPGFAGFSDHDSAGYNANSAQVFGEVGYALPVGPVAIEPFAGLAYVNLHTDGYTESGGAAALRAGGETTHVGFSTLGLRAASQLGSIASGTFTARGTVGWRHAFGNVRPSSAFTFANGGTSFQVSGVPIARDSAVLEAGIDANITKRLTLGLTYSGQYGSGVRDNAILGNILWKF

SEQ ID NO: 11101 - protein, 562 aa, Neisseria gonorrhoeae
MGGDNDGQFSLNNGAIAQNTKVNGGQFNVNEGATAEGVTVKGGEFNLRARAQAMKLTIEFGEAQIAGTLTDVTLRGGNTTLASTADVAGTIHSISGSALKVYQGAHTAQADLNLAGRVVLFADDVAPMAALPSRAVRAADNRLSAPFTFKRINMSGGTLDLRNVKNAQLVMDSLAGNGTFKLGSMLQQDASAPLNVTGNADGDFILQIDGSGIDPTNLNVVSTGGGDARFTLTDGPIGLGNRVYNLVKDASGKITLVANESTVTPGTASILAVANTTPVIFNAELSSVQQRLDKQSTEANESGIWGTYLHNNFAVKGRAANFDQTLNGMTLGGDKATALTDGVLSVGGFASASTSSIKTDYQSKGNVDSHSFGAYAQYLANNGYYVNGVVKANKFNQDIHVTSADNSASGNTNFSGMGVAVKAGKHINHNHLYVSPYVAMSAFSSGKSVVKLSNGMAAQSSSTRSMIGTLGVNAGYPFVLKNGVEMKPYVSASVDHEFAANNKFRVNQEMFDNNLNGTRVNTGAGLNVNITPNLSVGSEVKVSSGKNIKTPVTVNLNVGYRF

SEQ ID NO: 11102 - protein, 146 aa, Neisseria gonorrhoeae
MNYIYSATTNSFYPLEMKEDYTQAGSWPDDAVEVDEQVYIEFSGLPPKGKIRIAGENGFPAWSEIPPPTHEEQIAAAELKKQQLINQANDYMNSKQWAGKAAIGRLKGEELAQYNLWLDYLDALELVDTSSAPDIEWPTPPAVQAR

SEQ ID NO: 11103 - protein, 394 aa, Neisseria gonorrhoeae
MAANPVGGIKQEAAYAGQILAGADLDMNKLVGLSGVSVHIAVTNRQGRNLSRDAIGNSTSVQEIWGGGQTTRLTQFTIEKKAFNNRLILEAGRSIANTEFLSSPFYCQFQSNSACGNPTFVFRTSSLTWWPVSSWMGRVKFWMTPRVYLHAGAYEVNRSFQGNNDHGFNWSTNRANGVMIPFELGYATTFENDRLPRHYQIGGWYDATNYNDPSRDTQGGYVQVSGLPAQSLYGRSGAYIRFDQMVWRPDHSARGLTLFGVAMTGLSGRLAEDYFLEAGMVMTAPFKKRPYDTLGFMINNQSLSGAALQGVSEARTLAGLPPGTNRNQVMMELNYTFQALETVRITPNLQYIINPDQLRYPTRPKSIPDAFVVGLKLTVSIANLVDNMIKGHPL

SEQ ID NO: 11104 - protein, 435 aa, Neisseria gonorrhoeae
MARFENLQETFPMNKTLIALAATSVFAASAQAQNSVTLYGSVDAGINYVSGQDAAKTRLASGIMEGSRWGFKGNEDLGGGYRALFVLESRFEADTGAISNRAASGIQVPDRFLDLQFLGVPLIPLAPGVTTQTVVNQVGAQLGSQIGVNLTNNVFDRQAFVGLVTPVGAVLAGRQYTPAYEMFYVFDSMQTDSSLSAAQIATLPAAVDIRKSNALAYRLQKDGFTATLMYAFGETGDSTSNNRYMSANAYYKGNGFAVGAAYGTNNNAVGDKALTDVLLGASVDLGPGKLSTLYATFKDDNPGVGADVTAGLIAQNPSPAFAPLATLIGNAFERALRQDSRLFHVGYRFNFGPSTVTVAYNHYDDRTIADADVQSYGAVYTYALSKRTDVNFVLTRFDNDDNAQAAPGGGGFFGGVTSEAGKGAHNIALALRHRF

SEQ ID NO: 11105 - protein, 739 aa, Neisseria gonorrhoeae
MMSFINHTRDGQRQPAAAPSLLAACIAMALTPAVSFAASSSEDTVVVDGGFDNAQDPSAEQDQDYSVKTTTTGTKLLLVPRDIPQSVSVISQQRMQDQELNTIGQVLDNTTGVSASRIDTSRTNYYARGFFISNFAYEDMPTFLDNRWNFGDTAGDTAIFDKIEVVRGAAGLMSGTGNPSAYVNMVRKHADSKEFKGSASATYGSWDKQRYVLDLQAPLTESGNVRGRVITGYQDNDSWVERNHYRKKFIYGVVDADLTDSTTLSLGYDYQESEEDSPTWGGFPSLFSDGSKTDFRRGFNTAADWTYSNQDSTKIFANLTQRFDNGWEAKVNAMHAETNFDSKLMYIDGYPDKTTGLYDASSFQGAWGGWNRGERKQDSVDAFVRGGYDLLGRQHELMLGGSYSRQRNNYDNSYPVNDNYGLMDVGSIYDYNGNLADPTWSGFALYQRDVIRQKSAYAATRLSLADPLHLILGARYTEWSAKYNLERKPDEIRDAKFHDVTPYAGLIYDIDDTWSVYTSYTSIFQPSGQRDINSNFIDPTTGKSYEAGVKGDWFNTRLTASLSVFRIEQDNVAVNTGVTIPGSGGQSAYKSVDGTVSKGVEFELNGALTDNWQLTFGGSRYIAEDEDGNAVNPQQARTTLKLFTRYQLPMLPELTVGGGARWQNKTRYDFETPGPNGISQITQDGYTVVDLFTRYQVTKNFAIQGNLNNVFDKEYYDYLGTYGVYGAPRNVSVSGSYSF

SEQ ID NO: 11106 - protein, 227 aa, Neisseria gonorrhoeae
MQADLAYAYEHITHDYPEPTGTKKDKISTVSDYFRNIRTHSVHPRVSVGYDFGGWRIAADYARYRKWNNNKYSVSIKELLRNKGNGNRTDQKTENQENGTFHAVSSLGLSAVYDFDTGSRFKPYIGARVAYGHVRHSIDSTKKTTEVTTILHGPDTTPTVYPGKNTQDDHREGNSIRRVGLGVIAGVGFDITPKLTLDAGYRYHNWGRLENTRFKTHEASLGMRYRF

SEQ ID NO: 11107 - protein, 697 aa, Neisseria gonorrhoeae
MFSRFKCRSAGWKVYLATTVTFSLFIHPAHAETASADTEPAGKLITATNLQEVTVTATRTSRKVSEIPESVSVVDTEQIRTRQAADIGDVLRYLPNIDLGGGPRNLGISPTIRGMADDRILFLLDGARQDFNRGHNARIFTDPSLLKRVDVMRGPASAIWGSGALGGVISFTTLDATDLLRPGERSGIKVRGGFQSMNEQYIPGTSIYGLVGEEFDYLLDFSYRNAADDIRHGDGSKLQNSQFQSYAGLAKFNWTPGDHRFTFSTQTFDQTGKVPANSQTASTPDTLVDRDTEQRNYTLRYRYENPDNTWLNPEVLVYHNTTHSLEKRLLDRRRDETDFSTTGINARNSSRLDLSSFATQLITYGVDYFHNEAKGKRNGAIRPEFPRGNADVVGVFLQDEITLWDRLSLIPGVRWDYFRSEAEGMATSANKNDRVNFKIGGLFKVTEWFSLIGNYSEAFRAPTLGELFTTGTHFTCGPGCANLFVPNPNLKPETAFNKEVGARIQKSDLLYEDDRLAIRGAYFHNKVKDFVDLMVDFVFFPVPGNPGRGGVTTSDNVRDAVLEGFEIEANYAAKYGYTGFSYSQTRGYNRTDGGVLSNVQPDRWIVMAGLNWPTYDLSLGWRSSIIEAQNRVPTGGTPTPGYTLHDLTLTWLPQNGSLKGVRLDFGIDNLTDKDYRRHLNVLRDPGRNYKLAVSYQF

SEQ ID NO: 11108 - protein, 930 aa, Neisseria gonorrhoeae
MDEIKVREFIFNEQTNSIENIPMDSRVLNGDKVKVGVLDGDFINRKNYLENKYVNIEILERDHNPKHSNHGELVLKALREKNKLGIIAGSIGENDDFSGREGTAVIPKLETYEKVLEKFNPNQKVKVFSQSWGVPETIGSYIWKSEEERMRAIAPGQTSNEGRKILDFYKKEVKKDTLFVWANGNTLINNQNQVVLFNDAYYQGGLPYLYPELEKGWITVVGVKKRDGNMLNKHYTDTAHLAYPGNAKWWAISADAEVIDSKGVTHRGSSFAAPRVAKAAALVAEKYDWMTADQVRQTLFTTTDRTNIDENETYIRNIVTEPDEKYGWGMLNQERALKGPGAFINIRRQYQYSPSSNNVFKADIPENKVSYFENDIFGDGGLEKLGKGTLHLTGNNSYERGSVVKEGTLEIHKIHANQINVENKGTLVLHSKTIIGYKVNSNTVIDEKEVTASNITAKNLDNKGTVKVIGTTAIIGGDYIAHLGSKTEMDFSSKVRVLGKIDMQGGAITLSSNRYTTLRETATIMEASTIQGNIANVEAQGMRKANVEVKDGKVVATLSRQNPVEYIGENAETSSKNVAENVEKVFKDLDQKVLSGTATKEELAMGATLQKMSTMGFRSATEMMSGEIYASAQALTFSQAQNVNRDLSNRLAGLDNFKNSNKDSEVWFSVLGSGGKLRRDGYASADTRVTGGQFGIDTKFNPTTTLGVAMNYSYAKANFNRYAGESKSNMVGVSFYAKQDLPYGFYTAGRLGISNISSKVERELLTSTGDTVTGKINHHDKMLSAYVEIGKKIGWFTPFIGYSQDYLRRGSFDESEASWGVKADRKNYRATNFLVGARAEYVGDKYKLQAYVTQAINTDKRDLSYEGRFTGSSVKQKFYGVKQAKNTTWIGFGAFREISPVFGIYGNVDFRIEDKKWADSVISTGLQYRF

SEQ ID NO: 11109 - protein, 820 aa, Neisseria gonorrhoeae
MPIAVLLQLPCKMPTLKKGGQITGLYVGTNTDADTSYTSTGLTKILAQDISTSKTASDYIMGVYVFGPKSKVILNDSEIKVVSKGQNSFTLKIGNFENNGKSYKGEIISTGKMQLDSTEATNAPTILLVADDSKLDASADTASAEIKSANSAVVFGVTDLVYKNALGGIGGNLSRNKSAKDQSVKLNNAVISTTSENASLIKAASALNVDSLANSKAGLGWSNGTFTTKGDFTLSGEKSLATAAKNGWLFEVDDGSELTALINKKAKVVGLSSKNTSGTLNITLDDATWELQAKENGVPTSTLNKLTLNSHAILDASKPTDTASTKAQYDIQLTSDATKEDGTLNNGGIITLANNSFNDILTIKGNYEGKNGVLKVNTEWNSPGDDNGANAASDLLVIKGNASGNTTVKAIKADGTEDVIDGNIGSIAEDLNKNSAVLIRVHGTDNGNDVADTAEGGYKYRSTFTGEARTTGAGVLKLASRKNNNGHTEYFWTLTSINTNNINLDPVVPAYVLAPKAGLELGYTTLSTLHERRGENQTSKAQNQTWGRIFGKHSELNGKTRLGTQHNIYGFQFGHDFAIQHTEEGDLRLTGGYVSYGIMNSTYSDRLDDQPQTGKGKQKGWNLGLTHTRYAPSGAYVDLVGQIGFLNNQFNARNGVEVKQKATALALSAEIGLPYALREYPTKDVWLIEPQAQLVYQMLKLNSFKDDVKYIQGGYHHGLRGRLGVRAVYNVQSVEGKYRPNSVYITANVLHDFMNGKGVTIGQDKVKETLAKTWAEVGVGGQLPVGKQSLVYADVRYEHSLSGTKHEGYRGTVGFKYTWK

SEQ ID NO: 11110 - protein, 490 aa, Neisseria gonorrhoeae
MEVTVSASTVFKLSPLTIALFVASQVTYANDDMEVMEVLGHTPEGIDITIDSDQLAKSQAQDLNDIFRKDAEISVGGSSGVSQKIYVRGLEDTMLNVSIDGAAQSGNLFHHQGRLSIEPELLKQVDVSAGAGRATDGPGALGGAIKFTTKDAHDLLTAGETYGAMLKGGYYTNNEGYKVSASLYGEVADQLGLLASFGYVDGDNIEDGKGQEQPYTALEQQVAILKLSGQLNDEHYLSVSYDYRNDDGRRLNRPHFQPSFKNAPLDQETDRSTFTLNHKYNASDLFNLDTTFYYTDSRLAHKDHPRWGTSDGSIQTSGVKIFNTSKLTGHTLVYGLDYKKDKSEFETNYDGKKNDEEKGTVYGLFVQDDWMLTETIILTAGARYDWYELTDNMEQDFDSSGFSPNVGINYNPLEGLNLFASYAEAFRGQQIKELFVIDYRENDPNRKPEEARNLELGANYQYDDFFAGITFFDSTIKDVVTNQGLRAPHN

SEQ ID NO: 11111 - protein, 233 aa, Neisseria gonorrhoeae
MQADLAYAAERITHNYPEPTGADKDKISTVSDYFRNIRAHSIHPRVSVGYDFGGWRIAADYASYRKWNNNKYSVNTKEVSRNNSNGNDTWQELKTENQENGSFHAVSSLGLSAIYDFKLNDKFDKFKPYIGARVAYGHVKHQVHSVRKETTTVFSKPSGSATKPGQIPSLVTKPAYHESHSISSLGLGVIAGVGFDITPKLTLDTGYRYHNWGRLENTRFKTHEVSLGVRYRF

SEQ ID NO: 11112 - protein, 282 aa, Neisseria gonorrhoeae
MQAIHKRFIILATTCAALTLASAPAHAQKVGDNVVTAGWFNVQTSGHSDPLTTSVAQVPINYPLGLPSTFSAPGSSLSTSNANTVGFTFSHFFTDHIALTAVGGIPPEFRIYGHGELIPPGPAGALGRQSLGDPALNPIITKARQWSPAAMVQYHFLAPTASFRPFVGLGLSYNFYTNIEVNPAFSASVNSNLGAILAAGAEIPGPTSVHADASSSWAPVFNVGGTYNFNEHWGLTASVTYIPLSTTSTMTIKASDGTVLSTSKTKLEPNPIVFYLAASYRF

SEQ ID NO: 11113 - protein, 851 aa, Neisseria gonorrhoeae
MELGAQANGSESPRFPRVISLRTPVARTRVAYPARGSSGSAIVVIANNYHCDGAATQIRTPRNFRRGRLAAPPGDRTTMRNPNFTGVVSRPRRALSIAAVAGVAGLGLAQAAVAGPDSADAAVTTANADDRSVSSVTIDAKRVADPSSSKFTAPLVDTPKSVTVIPAKIIEQTAATSLADILRTSPGITFGAGEGGQPLADRPFIRGQASANNVFVDGVRDSGGQVREIFNLEQVEVVKGPDSAYGGRGSGGGSINLSSKSPKADSFARGSVGVGTDAYVRATADLNHALNESVAVRLNLLATQGDTPGRKSVSFDRWGVAPSLAIGLDGDTQLTASYYHLEGDQTPDYGVPLLTKTTQPRTASGILDVDRRSFYGVASRDYQKTKSDIATFAIDHRIDETLNLRQVVRYSKSLNDYIVTNPGDGGAAQFVQGQWWMKRGTKTRWNPTETVAAVTDLHGKKTFLGLEHSFDVGLELSREENLNATYSTFTTSGAACPTGFTIAATTLASLGAGDCTLVYKPNDKDAWTGVINRAPAARNVAKTTALYGFDTVKFGEKVLLNLGLRHDRYESKGVDVATTQANGVFTSVTYTPRSGSWAFTNYQVGLVYKPTPGSSLYVSYSTASTPPGISAGDQNSNTATGTGNLATVQLEPEDSESFEAGAKANVFHDTLALSAALFQTSRKNAQIQIDATTYAQVGEVEVKGFEFGVSGNITPKWQVFGGYTYMDSELVRGAYTSVNQGDPLANTPKHSISSFTTYKVTRKIALGGGAYHVSKSFGGNQGGAGGGASRIYAPAYWRYDAFASWAVSTGVDLQLNIQNLTDERYIARTNGVHHADPAPGRQAILTINVKY

SEQ ID NO: 11114 - protein, 912 aa, Neisseria gonorrhoeae
MQQQHLFRFNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVALTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLVPVDDASTYAYFIVEEECKNEGYEKCKAKKDVDGKDERQTVSTRDYTGPNRFLADPLSYESRSWLFRPGFRFENKRHYIGGILERTQQTFDTRDMTVPAFLTKAVFDENKKYGSIRGYGKYAGGRKYSGLITNGENGAEVGAEYGTGVFYDETHTKSRYGLEYVYTNADKDTWADYARLSYDRQGIGLDNHFQQTHCSADGSDKYCRPSADKPSSYYKSDRVIYGESHRLLQAAFKKSFDTAKIRHNLSVNLGYDRFGSDLRHQDYYYQHANRAYSLKTPPQNNGKKINPNGSEKNPYWVSIGGGNVVTGQICLFGNNTYTDCTPRSINGKSYYAAVRDNVRLGRWADVGAGLRYDYRSTHSDDGSVSTGTHRTLSWNTGIVLKPADWLDLTYRTSTGFRLPSFAEMYGWRSGGKIKAVKIDPEKSFNKEAGIVFKGDFGNLEASWFNNAYRDLIVRGYEAQIKDGKEQVKGDPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRDTKATARRTRPWYIVDVSGYYTVKKHFTLRAGVYNLLNHRYVTWENVRQTAAGAVNQHKNVGVYNRYAAPGRNYTFSLEMKF

SEQ ID NO: 11115 - protein, 233 aa, Neisseria gonorrhoeae
MQADLAYAYEHITHDYPKPTAPNKNKISTVSDYFRNIRTHSIHPRVSVGYDFGGWRIAADYARYRKWHNNKYSVNIKELERNENKNSGNHLNIKTQKTEHQENGTFHAVSSLGLSTIYDFDTGSRFKPYIGMRVAYGHVRHQVRSVQQETTTVTTYPSGGGAKTSVPSKMPPKPAYHENRSSRRLGFGAMAGVGIDVAPGLTLDAGYRYHYWGRLENTRFKTHEASLGMRYRF

SEQ ID NO: 11116 - protein, 736 aa, Neisseria gonorrhoeae
MLQAFPAGRATGRARLPAAALALALGNLPAAALAAEAPADATPNNEPVQALPAVTVTGEGLSSVTEGTDSYTVGVTSTATKLRLSPRETPQSFSVITRQHMDDQALLSVRDVLDATPGISSRQLDSDRVSFSARGFAIDNFMYDGVPTNIEGAYAFGDSALDTAIYDRVEVVRGATGLMTGAGEPSAAINLVRKRPLQGFAASAGVTVGSWDFYRGEADISTPLTADGRIRGRVSAAYQDKKSYIDLYQQKRNVFYGVIEADITSNTLLTLGTDYQQTRPTGTTWGGFPLFYSDGSRTDFRRSVTTAADWSEWETESRTLFATLEHRFANGWMARGTFSHAENDYDARLLWLTGYPDRATGLGMKGGALAHYVGNRQQNTVDLYATGPFQLAGRRHELVLGFTGNHQRVVNDNYPPLDAAVPVGNFYDWNGSYPEPRWSDTATGGDRAKTRQTGAYAAARFSLADPLTLIAGARVSNWKTDQYSWGAEYSYDHDNVVTPYVGLIYDLNDTYSVYASYTEIFKPQSYRDASGKYLDPVEGKNYEVGLKGEFMQGRLNASAAVFEVKQDNLAQVDVGRLLPDGSQAYYAAQGTRTRGFELELAGEVARGWNMFAGYTHYIAEDADGKPVNTTAPRSMFKLFTTYRLPGAWRRLMVGGGVSWQSRTFSDAIGPQGETEVGQGSYALINLMARYEFDRQLSATLHINNLADKKYYTQMGFYNQGFYGAPRNAMLTLKYQY

SEQ ID NO: 11117 - protein, 868 aa, Neisseria gonorrhoeae
MLPRRLPRMRASAPRHPAALALTAAAVSLAWGTLAPVAAHAQIASQASNQALRSYSIPAAPVEAVLNQLAREAQVMIAFEPGLVQGKQSRGFKGMATVQAALDSLLEDHPLQAQSEGPGAWRVRPAAARSPKAAQGARAGVQERNLDEVLVVAKKDARQQVFETAASVAVVTREEIDRLPPRNTADVLAEVPGVYTSQSRRDPGVSVNIRGMQDFGRVNVMIDGTRQNYQQSGHGSNGSVYLDPEMLGGVDISKGPTSTVGGAGMIAGVVNFRTLEADDLIKDGSTRGARLNLSSGNNGYHYAGSAALGLKPREDLDLVMLVSRKKVGEFEKGRRGSMTDDVDGQVHGVSQLTSQDQTSVLLKSTWRFAPEQQLKFSYIGMDAKFGEKPQSASGGGILNHVRTDTLLANYAWNPSASALVDLKSSLYYTRTRNQAHRYAGGTLDPYAYDLQYQTSTVGGTLENTSRLQWGARDAALLKTGAEFFHDWTDPQAQALSVGADAGTTALYAGSTPKGKRTVASLFGELNWMHSDWLELTGGLRYDWYGMQGDGRMRVGSLINPPGVRPPSTALYTRFKADRNDGAFAPRLALAVKPVEPIQLFASVGRGMRPPALTEALMWGQHTGSLFPYYPNPDLRAERSRNWEVGANGMFDDVLSKGDKLRVKVAWFNNKVNDYVTLARIMSPIDTAGGGLLGPYAYVNLQDPFRSKGLELQGDYDNGRVFGSLNYTHMLVNTGKGGYDSFPLGSLTGYPNNNLGQSGDANIWYVLPPRKTASLSAGVRLLDKKLTLGGRMRFQSPSTNSSVWTTQGERYNQKSWRLFDLWASYEITPNATLRVSINNLRDLNYSEMQGGSYFIGPGRTAIATLSIQF

SEQ ID NO: 11118 - protein, 224 aa, Neisseria gonorrhoeae
MQADLAYAAERITHDYPEPTGAKKAQLSTVSDYFRNIRTHSIHPRVSVGYDFGGWRIAADYARYRKWKESNSSIKKVTEDIKDNYKETKTEHQENGTFHAVSSLGLSTIYDFQISDKFKPYIGVRVGYGHVRHQVRSVGQETITVTPKPKNGTQGGPVKSTSPIPAYHENRSSRRLGFGAMAGVGIDVAPGLTLDAGYRYHYWGRLENTRFKTHEASLGVRYRF

SEQ ID NO: 11119 - protein, 360 aa, Neisseria gonorrhoeae
MGKRMSALCGLGLVSAGACAQSTITLYGVADIYTEFLTHQAGPGDKSSASLVRMASGGKSGSRWGLKGVEELGGGWQATFRLESGINLNNGTGTGAGGFDRSAWVGLQHERWGALRLGHQYSTLFDVMERYSPTGAYSTLYEPAGAIVGVNFRENNVAKYLAKIGSLTLETHYSFGGTPGAFQSNAAYGAGFDYAGGAFSFAAAFDNVNTPRPGGFAHFRRYAGAAIVSVERAQLLAGVTHGQSSVATPSVVTHYTFWWAGVRYMITPYLQAIGAFYYEDIRAQNPPNAQTTAPHPANPQQVTLQLNYFLSKAVTLYLAGGYARRAALDFDNYNYNFLHYSLAADRAGSAGAALGLRKLF

SEQ ID NO: 11120 - protein, 236 aa, Neisseria gonorrhoeae
MQADLAYAAERITHDYPEPTGTGKNKISTVSDYFRNIRTHSIHPRVSVGYDFGGWRIAADYARYRKWNNNKYSVSIKELKRRKNSTSGGGSQLNIKHRKTEHQENGTFHAVSSLGLSAVYDFRPNDKFKPYIGVRVAYGHVRHGIDSTKKITGTLTAYPNDADAAATVYPDGHPQKNTYQKSNSSRRLGFGAMAGVGIDVAPGLTLDAGYRYHNWGRLENTRFKTHEASLGVRYRF

SEQ ID NO: 11121 - protein, 403 aa, Neisseria gonorrhoeae
MHSYKMNKHASTRLAGTAIATCLTALASGGVHAQSSVTLYGLIDTSITYATNQRTHGAGSPGSGTVAMTSGALNASRWGLRGREDLGGGTAAVFTLENGFSGTTGALSQKGVDMFGRQAWIGLSSKTAGTLTFGRQYDLILDFVTPLGASGPGWGGNLAVHPYDNDDSNRNLRINHAVKYTSPTYHGLTFGAMYGFSNTAGQFANNAAWSAGVSYASGPLKLGAGYLKISRDRNAPNPNGALSTVDGSATITGGNQQIWAAAGRYAFGPHSVGAAWSHSTTDGVTGVLQGGSIAPLKGESLVFDNFTIDGRYVVTRALSLSAAYTYTMGRFDTRTGQTRPKWNQVVAQADYALSKRTDAYLEGVYQSVSGGNGNPAFNATVWTLTPSANSNQVVVALGLRHKF

SEQ ID NO: 11122 - protein, 346 aa, Neisseria gonorrhoeae
MKKSLIALTLAALPVAATADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYRNNGFFAQYAGLFQRYGEGTKKIEDYQYNSPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRPKF

SEQ ID NO: 11123 - protein, 305 aa, Neisseria gonorrhoeae
MLIFIPILIFVALVIVGAGVKIVPQGYQWTVERFGRYTKTLQPGLSLVVPFMDRIGRKINMMEQVLDIPSQEVISKDNANVTIDAVCFIQVIDAPRAAYEVSNLELAIINLTMTNIRTVLGSMELDEMLSQRDSINSRLLRIVDEATNPWGIKVTRIEIRDVRPPAELISSMNAQMKAERTKRAYILEAEGIRQAEILKAEGEKQSQILKAEGERQSAFLQAEARERSAEAEARATKMVSEAIASGDIQAVNYFVAQKYTEALQQIGSSSNSKVVMMPLEASSLMGSIAGIAELVKDSANKRTQP

SEQ ID NO: 11124 - protein, 274 aa, Neisseria gonorrhoeae
MILTPIRRYGAMILMLLTLVFSSEVLAKTHTTTASQKSHLTKASNKQVSSKQEYSRNSAKSSSLPDLRKYPSGTPRKKAFLRTVMPYITSQNAAITAERNWLISKQYQGQWSPAERARLKDIAKRYKVKWSGNTRKIPWNTLLERVDIIPTSMVATMAAAESGWGTSKLARNNNNLFGMKCMKGRCTNAPGKVKGYSQFSSVKESVSAYVTNLNTHPAYSSFRKSRAQLRKADQEVTATAMIHKLKGYSTKGKSYNNYLFAMYQDNQRLIAAHM

SEQ ID NO: 11125 - protein, 809 aa, Neisseria gonorrhoeae
MPIPFKPVLAAAAIAQAFPAFAADPAPQSAQTLNEITVTGTHKTQKLGEEKIRRKTLDKLLANDEHGLVRYDPGISVVEGGRAGSNGFTIRGVDKDRVAINVDGLAQAESRSSEAFQELFGAYGNFNANRNTSEPENFSEVTITKGADSLKSGSGALGGAVNYQTKSASDYVSEDKPYHLGIKGGSVGKNSQKFSSITAAGRLFGLDALLVYTRRFGKETKNRSTEGDVEIKNDGYVFDPANPSPSRYLTYKATGVARSQPDPQEWVNKSTLFKLGYNFNDRNRIGWIFEDSRTDRFTNELSNLWTGTTTSAATGDYRHRQDVSYRRRTGVEYKNELEHGPWDSLKLRYDKQRIDMNTWTWDIPKNYDTNGINGEVYHSFRHIRQNTAQWTADFEKQLDFSKAVWAAQYGLGGGRGDNANSDYSYFAKLYDPKILASNQAKITMLIENRSKYKFAYWNNVFHLGGNDRFRLNAGIRYDKNSSSAKDDPKYTTAIRGQIPHLGSERAHAGFSYGTGFDWRFTKHLHLLAKYSTGFRAPTSDETWLLFPHPDFYLKTNPELKAEKAKNWELGLAGSGKAGSFKLSGFKTKYRDFIELTYMGVSSDDKNNPRYAPLSDGTALVSSPVWQNQNRTAAWVKGIEFNGTWNLDSIGLPKGLHTGLNVSYIKGKATQNNGKETPINALSPWTAVYSLGYDAPSKRWGVNAYAARTAAKKPSDTVHSNDDLNKPWPYAKHSKAYTLFDLSAYLNIGKQVTLRAAAYNITNKQYYTWESLRSIREFGTVNRVNNKTHAGIQRFTSPGRSYNFTIEAKF

SEQ ID NO: 11126 - protein, 683 aa, Alteromonas macleodii
MSSRYFVMSLTALAVSCVYTHPLNANPLYSQTLDLIELNNQYHSSDDGMQLSYLNSLTLLRADHSGNGANISMRSASQGVAVMQDRVYFSPAPYSAPQLQLLPNLLLQQNVTSTPLANMTVGGQGAFGVVNYQSLEITDRPQSGSFKVEGATDSDFNAGMTWGVKQKEYGALFAANYLQEQDDANFFNNSDADRKKTDILFKVNAASLLGARSPQQTEFTYQFIDDDSYRSQLGSTLADWQQDPLLLYSATAQDKLQGRQHKYQLSHQVDLAGSKVISDFYYQSYSQQLNQLGLFNGQEINAATLADIADFDHAPTADAIDVALLVQDNDYSAFGAQTQAINQYGEHQIIYSARYHTDKAEMRFGEQTALWQADRSLVSDDSGAILAYTDDATALTSAIDSLFRWQGMQIKLGLTYEHVSINREVKQAFAGLDEADFSDSDWMPQLGVLYDAGDWRFSTDIRRAWTAASAGNTTQEAQVSLHYQVSAQYAREGIKADLRAYVQEFDNLHVDCDSYSMCADERLLTQENIPDVLTYGVELGLGYRWDLGGVELPLGLNYQYLSAEYQTSTCTDVQGCVLEGDRLAWLPEHQLQLSAGIKYAQYRLNLEAAYQSERDFSQFGSEQERISGQWRVDLAANYDFDKHHRLYFRVENLLDESLVTTASNSGIRSENGRISYLGYQWRF

SEQ ID NO: 11127 - protein, 464 aa, Alteromonas macleodii
MPAAIFPYYNEYLMKQQFSLRSSVCLTLATLASSSALAAGFQVNEHSANGLGRAMAGQAAKPENASILATNPAAIGVFKEAEFSASVSFIDPNVDINGAVTYNLGDTPVGGAAAQEDDIADTAFVPGFFYVSPINDEVSAGVGVFTTYGLRSDYSDDFGALHFADTAEVKTVTLNPAVSYKVNKQLMIGFGLNITYAEAEIGSGVSNTLAGTVAGLAPTAEALGITLPTLTTGNSLFSMEGDDWGYGWNAGIFWQPTEMTNIALSHRAETKLELDGAVSSETPVFPINLNQPGSLDLNLAAITELAVDQKIDDQWSVQASVTFTDWSTFEKLEANLEDGVDFLIKEENFDDSWRASIGVTYILNDEITLRAGYAYDDGVVSVENRSLSIPDTDRHWVSGGMTYTVSEDTSVDLAYVFIDGREADINKDRTIIRDVLPETDFTTNFTGTQSATAHILSVQLNTRF

SEQ ID NO: 11128 - protein, 462 aa, Alteromonas macleodii
MKIKSPLIAYFSLVALLPISADAQTISDEDLASLIKRINQLEQEVRSLRSELDSVGSEQVDSKQVDLAQKEQKQDQNTSVVANEDAAPVSIKWKGAPEIKGDGGWSVKPKGRVLYDFNTLSSVPSSIDIPGEGFSSEARRLRFGIQGTMPGGFGYKLIADYLDGVKLTDAYFTYEDGPLKLTLGQHNTFQGLEELSSSNDTSFVERAAYTDAFGFERRVGLSATYKLNDFLLEGGVFTDNIDDLNDGNNSFSVDGRVGYTTVVDDTFIHLGSSVHVRDLGNEIDSIRYRQRPFVHSVDTRFINTDDISGATDEFSYGLEAAVITGRLHVVAETHWAQVTRSEFADPTFFGGSIEAGYYLTQDTREYKGGVFKGVKVNDPVSNGGTGAWQINVRFDRLDLVDAGIVGGAQDAYMASLIWTPINEVRFLFNYAHLSYTDALNIVEGAPNDFSVNVIGLRGQLGF

SEQ ID NO: 11129 - protein, 637 aa, Alteromonas macleodii
MHTLALARAPGAALRSPSAFPVLRTLSALAAASLLACQAQAQVQQAQQAQRAQTSQLDTVVVTASRSEQPLRTVTADMTVIDAETIARSGATGVADLLVQVPGVQINRNGGPGQVTSVYLRGTSNQHTAVFIDGVRYSSQELQGGAVWSTLPLAQIERIEVLRGPAAAIYGSDAMGGVIQIFTKRADGQTRAYAEAGIGNQGTSKLATGFQGGADGFTYGLNLADERSDGFDVYPGNTFSPNPDKDGYSNTSLGLNAGYKTGIHQIDASLLYSRLRTHYDQSPPPFDDYDVVKNTTGSLRWQAGWNAMYKSVVQISHTDSQSDRHTQSPESAKGRSTNYLLQNLFTLGQHRFNIGLERREDKLDTQYAWTQNTDSRRVQNSLSAGWRLTEGRHQFDANLRHDQVRDQQNKTTGGLGYGLQIDERWRWVASAGTAFRTPTLYERFTGQAAADLKPESSTNVETGLHYAAGANRLSAVVYRNKFKNLITYDWNSAVPCNCYRNWQSVEITGLTLAGSTRLGSANLGASLDFMNPENLETGKLLPYRSKRMLKLNADTQAAGWTLGGEAQLYSGRYADEANTFKLGGYGVVNLYAQRQLTRQWTLLARVNNIADRDYAPTRGYANAGRTVFVSVRWTPLP

SEQ ID NO: 11130 - protein, 830 aa, Alteromonas macleodii
MKNTSILKLTTLSAAIIASSAVLPSVAFAEGAMVEEIVTTGTRAKARSATDTVAAVDVITSAELTNQGDMDVANLLRNSVPSFSVNDQPISDAATLVRPFQLRGMAPDHSLILVNNKRRHRANVIVWSAGGISDGSHGADVSTIPGMALKNVEVLRDGAAAMYGSDALAGVINFKLKDASEGGSVQLRMGQYAEGDGDMAYFAGNMGMELGANGFANVTLEYGSSDETVRSEQRNDAAGLIAAGFPVADPAQKWGRPFVDNDLKLFVNFGSQLTDSVELYGYANYASKDVDGGFYFRNPTNRGGVYAKDGNLLVGDTTGDMSGNCSQYAVDASDPTSSALAAAITGLKADDNCFNFNETIPGGFTPRFGGTVTDVTFMMGLKGELENGLSWDVSAYRGENEGDFYINNTVNASLGENTPRNFDPGLYRQTDVNFNADFKYSLSDTVSLAFGAEHRTEEFTIGAGQKESYIDGGLGVQGFSTSTNGFPGFSPDISGDFDRSNDAVYVDGEWDVSEDLLLAAAVRFEDFDGFGSTTNYRLGANYKIDENFGIRATLSTGFKAPTSGQLNASNISTLIDNGVLVNKGVIPATNPVAAFAGATELKPEESENFTVGFFGSVGEVDITFDYFNIDVTDRLTLSKDFSLTTADIASLAAAGVSGADDIAVFRFFTNDFETKTSGFDLVLSTSTDWMGGSTDWNLAVNHTTTEVTSRGEYIDDDRERSIEEVSPDTRYNISANHMMDGWRALARVSYFGDWYDPNQGMSYDGEHVVDVELSYDLNESSSVMIAGQNIFDEAGSKKHNGAAGAGNTYSEFAPMGFSGAFWYAKYSYNF

SEQ ID NO: 11131 - protein, 700 aa, Alteromonas macleodii
MTFRSSLLGACALMTLATSAHAQTETNTSGETEDVIVVTGALGAFGATKSSAPILETARSVSVETSYDFISRGALNLSDTLNYTSGVLGQAYGFATRGDFFTVRGLDVPEYRDNLQALFGNYNNTRPDLYTIDQVEVLKGPASVLYGQGSPGGIVNLASKVAGPDLGQEIVASYGTHDRAELAGDFSTTLIEDTLHARFVGVVRDSDTQVDYVNDDAIALAPSLTWTPGENTEINLLFNYDDRDGDAAGQFIPLTGTYYPGPNGETIEPSTYLGEPGFNTYETDSTALTVIGSHRLNDIFTLEGTARWRDSGSTYRQTWVAFAGAGVPRILPNGDSRYGRRWYDSEASSKQLAFDTRVRADFVTGAFEHEVLGGVNYQNVELDSESSYLLQGTINVFNPVYGDGLPTQAEIDAVRSYTSSETDYWGFYLHDQISWGNWIFNAGLRADEVSNETGAVSQDDDAVTYSVGLLYAFDNGFSPYVSYAESFEPVIGIDSFTNQALNPQEGEQVEIGVKYQPAGTRTYLTLAWFDITQTNLPNPVALPTAPSQQEGEASVTGFEFEGVTTFETGYGDLKLDAALTLLDTEDANGIPFSVIPDEQASLWAEFRPAALDALRIGAGVRYVGERESNGVSVVNGDIVRIVSDSYTLADLLIGYELEDWSVALNVRNLFDEAYYGSCLARGDCFPGEERTVNLRVAKRF

SEQ ID NO: 11132 - protein, 681 aa, Alteromonas macleodii
MSANSVARAHSPDVVVMDPLVVTGAYTPTSSFDLPFSVDTVDLSHGTDGQLGVNLSEVLSKVPGLVVQNRQNYAQDLQISSRGYGARSAFGVRGIKLLSDGIPASTPDGQGQAATLNLDVAERIEVLRGPAATLYGSNAGGVIQMFTRDGQGPARVGAETTFGSDGFNKNHLSAEGGNDTAGFVLDASRMDTDGYRDHSAARRDQTFAKVNFKPDDDSRMALIYSSLEQNDTQDPLGQKWDAYKHDPRSTAVEAEKYNTRKSIDHQQLGMNYERYFGDATLQFNLYAGRRSVVQYLSISEKAPSNVQRGGGVVDFDREFHGGTLRWIQPVVEVPGNLTFTVGADYDQSTDDRRGYQNFSGDQLGVKGELRRDEQDTATSLDPYLQAHWEIGNWTSELGLRYSTMKMRVDDHYLANGDSSGSKTYQQATPSLSVMYAFTPDLRGYASVGKGFETPTQAEMAYAPGEVERFNFGLKPATSMQYEVGVKYRLGERTRLNAAVYEIQTDDEIVVANATAGRTSYRNAGRTTRRGFEASLQSDLGEQWQTTVVYTRTDARYAEDVSSAIERGNRLPGVPLDNLYGELVWKPVPSVSMGVEGQYRSKVYVDDSNNAKPAPAYAVFNWRTRFEQHVGPWTFHQLVRLDNLFDRQYVGSVIVGDSNGRYYEAAPGRSWYAGAGLEYQFR

SEQ ID NO: 11133 - protein, 842 aa, Alteromonas macleodii
MKKHFLLSLLFIGFSFLGYSQKTISGLIIDSNGQPLTGVNILEKGTNNGALTDYSGKFSITIKSNESKLILSYLGFKKSEIKASENATITLEEEGVGLQEVNIQAVGSRNTKRTVIDSPVAIDIINMADVITKTGQIEINALLQYLAPSFNASKQSGSDGADHIDPATLRGLGPDQTLVLINGKRRHQSSLVNLFGSRGRGNTGTDMNAIPAAAIKRIEILRDGASAQYGSDAIAGVINIVLKDNVEEFTGNISYGAYTAKTPYADKITSSGIDGNTVQVSGNYGFKLGEKGFLNATLDFANKKNTNRPANENTYAIYRRQFGDGEAKNGSIFLNGSYSITNKTSIYLFGGSSYRDSDAYAFTRTFDSSRNIPAIYPNGFDPIIGTKIIDHSVSGGLKTKLGNWDLDFNNTFGTNNFKYDIHNTLNASLGVASPTAFDAGGHSLSQNTTGIHFSRNFDKIRNGFNVALGTEYRIENFKITAGEEASYKTYNLSSPGASQGFPGYSPENTVNKSRNNFAAYIDTELDYTENINLAIAIRYEKYNDFGSTFNAKIAQRFKISPSSAFRYSMSTGFRAPSLAQKYYNLKFTDYVSGVGSETLLSSNDSPITKAFGIKQLKEEKAFNASLGYTFKKGKITATVDGYFVNIEDRVVLTGKFNGSGLGLNIDKVQFFANALSTQTTGVDFVLSYDEKINNHSISTSFVGNINKMTIGNVASGSLDSETFFGKREKYFLLASAPESKLGINLNYNYNKKFFTNLRFTRFGQVELIDWLDTVDHYGAKIVSDASINYQFTKNFNITVGANNFLNVYPDIQDTETETGGNFDSVQMGSNGAFGFLRLGVKF

SEQ ID NO: 11134 - protein, 678 aa, Alteromonas macleodii
MTHRYLPASLLLGALSASGAAFSQTISPEVMEVTAPRLDRELYATPAAVSVVDRDSIAQGQQRVRLDESLVTVPGVFLQNRDNFAQGERLAIRGFGARAPFGVRGVTVMADGIPYTLPDGQAQLDAIDLDSAQRIEVIRGPSSVLYGNAAGGVLSVTTADGRDDQKTRLGAEIGSDGYRKYRFSDGGVNGPWSHHVSVSALNFDGYRDQSQVEKYHLNAKVRRELGNDRALTAIVNLLDNPRSEDPGGLTREQVDEDRNQAGDFTEEYDTGQNVDQQVLGLQYEDLSAGPGELYVKGFYLQRDFEQQLPYPGDSLLGYERDYFGGSAEYHQDLLLGELPLRYVVGVDVARQEDDRWRRNVEFDGTVGGDTADETQTATSLGIFAQGDLDLTDKLTLSLGTRYDRVDFDIDDDFGSDGDQSGDRTFREWSGSAGLSYRYLPTHQAYVNTGTSFETPTFSEFANPSGVGGFNPAVEPQKAWNREIGLRGNFDNGVDYDLALFSVRVRDELVPYNENGRDFYRNAGDSSRDGIELALGWQMTPSWRLDSALTLARYEFDEYDTQDGNYGGNRIPGLPEQTWMNRLTWKGFDERFATLETQYIGDMVADDANDVAVDDYWLVHLRAGDGWHLGGDTLLKGYVGVRNLFDREHFANVRINANNDRYFEPASGRTVYAGMEVAF

SEQ ID NO: 11135 - protein, 706 aa, Alteromonas macleodii
MKFRLSLIYTALFTGISSAAIAETSQAHDDLEQINVVTELEKAKAAGDKQKDIVNLSLLGRQTAFTSPISVVNYDEKAFENSQQRNVVDAISKVDSSIMNFGGETNTISGIYVRGLQLDARQITVNGLPGLYSTYNSPTAAVSSAQLIKGASTAIGGMDPEGAAGSSMNIETKRATDEDINKIRFGWFSNNRLQETFDFGRRFGTNKEWGVRLNGKYRDGDTARNNYDERNKEFAVGVDYRGDKFRAGIDYMYAKRATHGGRARVQDIQNLNFRLPDAPDGSTNLSPYWSGQTTEDQTIMGTFEYDLPYDMMLSGGLGYMDSRYYGSFGQIRMTNTDGDYSVRSMRAMDYHTRTTSGNLKLQGEFETGSVYHNWSLAFDAVKRQRDHNQSSTAKSFTANIYNPVFSSGQPTYSALEQGTNEKLGSYSLALADTAGFVNNTIRLTLGGRFQWIKQHDYSTDIKAHENRFSPMVTLAYVPNPDLVFYGNYLEDLEPGSVDEDTGVMAKPIVSKQIEFGVRKNWHELFTTTLSIYQLSRPGIHRLTGEQQGKERNRGIEFNVYADLLEKSLRPFLGVTYNRGELIDYSRYSDGAIINGSQVASPRWIMKAGVEWDTPFINNLTLNAAVQHYGKSYQDYAENYEFPSYTTVDLGAKYVAKLDTKQTLTFRVGVENLFDKAYWQVQRGRYDRSFAVLGMPRTYWANVEYSF

SEQ ID NO: 11136 - protein, 1042 aa, Alteromonas macleodii
MRFKQTMLASSVALALLATGSQAWAQDAGSVAAAEDAAGDEAAVMEEVVVKGIRSSLTKAADYKRDYNGIVDAIVAEDMGKFPDGNLAEALSRLVGVAIDRSNIEGSKVAVRGFGPEFNLVTLNGRQMPTVPGVYNGGRSFDFGDISAHGFESVQVFKTPTAQLPTGGIGSTINIITAKPLNAPGFKGSFSVGGVVDTTDIDDDVTPEIDFFVTNTFLDDRLGLSLSGSHQVRNNREEGLQETSWFNTADIPGRIDGATIDATANQRADGVLFFPEKVGFQVKDNERTRNNAQATLQFDVTEKVRATLDYTYSAVEFTTVGNQFGSYLGGFNMTSGTANNNGTIFDSSYAGGQYTHSATWGYEDSTNKSLGFNVEWQVSDALTLAFDYHDSSAEKEGTGLDNSISFINANWPGWDAVYEPAATVNSRDVSFGSSGIPRYDFNVSNSFQGNNIEGYDEIQANDLGSTNGTFNHQKKRNELQQFQIDGKWENLDGLFVSSLKSIEFGISRMEQEVRDTRASNFLIQGAGNDGTSTVLNYAQYDDAIFTRTSLSGFMDESGSNPTDYYLAIDVPAAAAAFSRAGWGPGAPPALWWAQNYADCEIVSDAAGTGFTDLATGERGDDRCLLNAGPTTVDGTVEEELTAVYAQFNFESEINYMPLNVSAGLRYEDAETTSTALSQIASDIAWNVDGFNVLYNGVVPVPVSASNSYVLPNISMSLGVSETGVVRLSASQSIARAGINDLRSVLAFTQRQFGENAQANSGNPALEPLESDNFDIAYENYYAEGSYFAVGYFRKNISGFLTSSTKTQTYGGLTDPFFGDFANAARADIAAGNSRGDTPPWANEFQELWWNTAGQDGSIGICYGGGWVCPPEYIIGEATDPLAQIDIAQPDNGQSGTIDGWEIAIQHQFAGTGFGINANATFVGGDVEADVYSLGEQFGLPGFGDSANLAAFYEDEKWQATIAWNFRDETYAGVEGSNNPIFLEDRFQVDMTASYKVNDNLTIFAEARNITDEPVRLFVRQSEMIFLAQDHGPMYKFGLRANF

SEQ ID NO: 11137 - protein, 1236 aa, Alteromonas macleodii
MRTHFRLNALSLAVMTTFLSTHTVAQESEQPPAEPVQSKLASEEDIEVIDVTGFRSSLMKSMNAKRFSDTVSDSIHAEDVGKSTDQNIADALSRVTGVTVQEEAGEGTRISVRGAGPSLNQISINGVALTGGISNDGSNNNATNNNSVDLSSFSSDILSSIDVVKTAAADQDEGSLGANIVLRTVRPLNLKKPRRSFTIEGRYNEFADDNDFRINGSFADKYFDEKLGFIITASRDVQNTRQDRISTDFETGAIPINDLNDGGRTATDLATGQPIRVLGYQRDDQGNVLRDDSGQALVNPIESLVDYDPTTQQLVEGDLFVLARDSVNFGLNTDKRERFSLSTGVQYRPDEKTDIQWDVTYTKQDILQDNHSVNMNISPLVLIHPDDDNTALNVVDLRTNTLERSTSRSIGGTTNRTTGLREIETKVSTLDFTRHLTDNLTMNIVAGYSQTVDETPDDDEENRFLSIGTAQWGTAGRNAVEAQPDDILELVGYDCSTGSTADCDYFSGSTLAQFDAFDGSVTSVTSRFNPFDLEHNHLGQLLFRKNKLTDTNKSVFLNFDWVLDYEHVRSVEFGAKWADRSRDVNIENTRITNGEDLIDVDDPSAPFEVRGLATIRVADIISGEAFPYDNFGEDLQANRSNALFGGWPLLDAEKALELVGGKNAGELGVNRSRAGSREIATETMAAYVKTNFEFFDGKLTGNIGVRYVRDESDASGLGSINYIRAPQMLDPYDLIVTRGLANMSNPACPEAVISNNDTRFTPENDDQLRNCWAFAVTHGYNFNNQATIPYDTATGQFLIPGADGQVGPDVNRILFVDGSGNIVTSNELPAQIYDQNGNLVPTSASEWARFNSNGLIWPFLDRSTAFTGPNGTGQEVQQREAPVSDSGTNEAWLPSLSLNYALNEETILRFAATKTMTRPSFDSLNPGNSIREQQFGTGNGRAGNTQLKNLTSTNLDFSYEWYFNESGLLSAALFYKDMQDFEETIITPFHYKDVRDQIDLESADLLLDFDPNRTPGDEDNCHPLRYAAGFFDKWTIECDVVNVATVTNGDGATIKGIELGYTQNYTMLPGVLSALGISVNYTYQDSESEAQEIGSTGRFLRPLPQPFTPKHSANMTIYWEKDGIQLRLANRYTDVQAVSRNNGGAIWQEASSRLDFSGSYAINKNFTVTFNALNLTDETMRNFYTSSGTVDATNLNSQEVVLDEGNVFDDSGITTNRTVALFKTGRQFRIGLRGTF

SEQ ID NO: 11138 - protein, 209 aa, Alteromonas macleodii
MKKVALSVLVLAGFASTSALAQDAFSYAKGGLTWAHTKSDYIGGKDSNNRDFGGLNLDVSKSFGSNFYGRMGSEYTSRNDGNDSMGISSLGLGVYTPLSTGLNLYGEAGLMGYTMERQQAANVNNTGWDNINRKNSGSMYGEVGLRYDIGAVELSTGYRYANMTDDMQDFKVGAAYKVSQNLALTADYTYRNWDLQKGSISSLGVKYSF

SEQ ID NO: 11139 - protein, 638 aa, Alteromonas macleodii
MKSPLHSIALAISLGLATGAYAQTVDLPETVAIGRPIVDEVKVDPYSSTSAVVTDEQLRDQNAVDLASALRRTPGVQISRYNPVGAFGGDQGGAIFIRGMGVSRPGSEIKTYIDGIPFYMGVWGHPLLDLLPINGMKSITVYKSPQPQINGNNFASVNLATKRATEDGVHGSARISAGSFGTIIEQADLVGRQGNVDYMLAQGHAQSNGHRANADGELNNVMGRLGLKLSEHWSVGAGFLYVDNRARDPGDNRQPAPAEAPQYNTQAGMVSASVSHVHGDWRGDFKVYSNSGQGNLLHQAGLDGDTLSSFRMSGLRWKEQFSPWEGGTVVAGLDHDRVSGDVKFNRVAPAPQTRFDAPTFKVTSPYVSVTQAIPLSPDWALVPSAGLRFYEHSAFNSRLAPHAGLSLVSDKLTVFANVSRGINYPGLEVPLLASLMPALGTSWQQLSAEELDHAEVGVKLSPTEATQVDVSLFHDKVKNRYVFGFPPDVPPPPQFLNLGSYRMRGAEVSVRQAVGRDWTVFGGLTLLAPTIDNLPYTPKRALTIGINGQLGPLRIAFDAQYQSEVWALNRSRAAGVANTEKVSGFAVANARIAYPLPALGKKGEIFLAVENLFDRDYAYRPGYPMPGRWGQVGLSASF

SEQ ID NO: 11140 - protein, 718 aa, Alteromonas macleodii
MQQRSLKLSALTVAVLSSFSTLVYAQDATEKTEATLPTIQVKANADASAEGLSAPYAGGQVARGARVGVLGQQDNMETPFTVTSYTQELIQNQQAASVGDVLLNDPAVRVARGFGNYQQLYMVRGLPIYSDDMSYNGLYGLLPRQYLSTEIIERVEVLRGANAFLNGAAPGGSGLGGAINVVPKRADNEPITQVTAGVQSGGQGYVAADLGRRVADDRVGIRVNVARRDGDTAVDGSSGELTIAGVGVDYRDGRVRVSADIGYQDHRLKASQPSFYVATTDVPKAPDASSAIAQPWTYSNEKDSFGTVRGEYDFTSNITGWAAFGVREGRESSSFANPTLLNGNGDTSAYVLDTVREDSIQTGEIGLRGNFKTGSVSHKVSLSAMGYKALSKNAYGFSDFSGFAGNIYSPTHVDKPSTTFFPGGRMTNPLVTERLETSSVALADAMSFFNDKLLITVGGRYQYIDDTTYNYDTGVAAPGTAKSAVTPVGGIVYRITPAMSVYANYIEGLVKGDIVSASSGANNIGEALDPYKTKQVEAGFKFDAGRIGGAVGVYQTRRPVGGVGDDNRYDIVGHQRYRGLELSAYGEIVPSVKVLGGVSLLDTDLNGKEGIGAPKSQANLGLEWAVRQIKGLSLDGRVIYTSSQYADAANTQKIPSWTRIDLGARYVMPMGEQVLTLRARVENVADKDYWASSGGYPGQGYLTLGAPRTYIVSASVDF

SEQ ID NO: 11141 - protein, 215 aa, Alteromonas macleodii
MNTTLRSIAAALCTAGLALISAHAFAADSDPTASGIHAGDVLVRLRAISIVPQVRTSDALSTLNVGVNNATVPELDFTYMIRDNIGVELILGTSRHQVTSSLGGLGGVNVLPPTLLLQYHFNHQGQVRPYVGAGVNYTYFYNDGLHVGDQQISVKRSSFGPALQMGVDVQVTKSLFANVDLKKVWMKTDASLNGASLGTLHIDPLIVGVGVGMKF

SEQ ID NO: 11142 - protein, 1138 aa, Alteromonas macleodii
MDNIMKCTPLGEQKSLWLRKTLLIMKFFVLFLLLGTVPCWAGIAYSQNVKMSLDMENTTVHDVINAIEKKGNFYFTYNLNQVNVNRKVSIKVENKTINQILDRLFSKSGIDYKIENRHIVLYKQATPEVEAVKQQKSINGIVADEQGEPIIGASVLEKGTTNGTITDLDGRFTLSIGKGTELIVSYVGYTTKTVKIGNQSTIKIVLIEDTKTLDEVVVIGYGTQKKSDVSGSVTSVSGDKLSKIPTANAEMALQGMAPGLSVNFGSGAAGSSATLQVRGVTSWKDDDGENSESNGPLVIIDGVPGNMSYLNPEDIKSISVLKDAATAAIYGSRSAAGVILIETHRGTMNSAPKITFSGYWGLSAMPKRLEVCNSAEFIKVRKMALINAGTDESRWPKYISEYERDPSQFADTDWQKEYYQRGFTQKYNIGYTAGSANSNVSLSAFYSKTDGVTIATGDEKFGFRLNSDVTRGKFKMGESVSYSRWSADLESNSGFSSIYQVTNMEPLAFLYDENNDGGYGGAISGMGMSDAGNQVAFNKLIDNTSSTDYIAASGYLQYEPIKGLIVKFNASRNMYFSKSRLFTPTYEIGAAKRNTMASLSESRSQTTNDLLELTANYDKTIAEIHNLSLLLGLSQEENKYEDLSASGSDFENNSMSLMGHAKSNYSVGGTKTRSALRSLFGRVNYNYMMRYMIMASFRYDGSSRFAKGNKWGFFPSVSLGWNIANEPFWENLKETVSMFKLRLSYGALGNQNIGLYRYIPTLSYNTHALNYPFDGRETSMGYAITAFPSSNIKWETTVYKNIGVDISLWNNKLELSAEAYIKNTRDMLSSRNISLATGYNSSILVNDGKLRTTGFEMQAIYHGKAGGLKYDLDLNLSHYKSVLKSMANPDYLYEYGALRTYVGGEIGEFWVYQTAGIFQNQAEVDEWNTAHGYKDQNGNWQPLQPVAKPGDIRFIDQNGDGMLDTNDRVKVGSGTPKVSLGFNINLTYKDFDLVANFYGDFGAKRYNYTKYQLERMDHVFNYGKNALNAWTPENPDTDIPRAVSGDPNKNSRTSTRFVENGDYLRLNNLQIGYNLPVKYCKKMGLSNLRIYVGATRLFTITNYKGYDPSTGSSVGQMGYDYAAIPLSRDFMMGLKFGF

SEQ ID NO: 11143 - protein, 234 aa, Alteromonas macleodii
MIVRKCRGRRTLCCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLAFTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 11144 - protein, 173 aa, Alteromonas macleodii
MYKTIRLILTASVMMLSNLVHAQSVPPLMGASQFAGPYLGFKVGVNSSNASGVISKASHTTVFPGFTAGYNFDVNRFVVGAEAFADLHHGSTTCKDGGIDAKFGMPFNQVLPYVRIGFTGDDPDTRFHWGLGVEYKFARHISAVGEWTTDTSNHDGTKRTNNSFTIGLQYHFN

SEQ ID NO: 11145 - protein, 720 aa, Alteromonas macleodii
MFTNPAEDSLNLLMLNSKIPFLFSLVGLSVNAAAQSSKSSLQDAHDELEHIEVKRHFQPYRGNVPLIDTPQAIDRITADTLANEGITRFIDALDFAPTIVRQNNSGGMFDSFAIRGFSGDENNPSGYLINGFNVRGYSGNRSTVNVQTIEVMKGPGSALYGQGEPGGTINIITKKPQFEEQGYVQATVGNFDKKHVEFDYTNGISSDMAYRINGSYEDSDTYRDNVFFKNLNLNPSFIWNLSGHTSLSYQMEILDQEKPLDRGVFILNNDFDAVDAEDFYGDIRDSAHEVKAFGHQLVLNHELNHNWHFLSGFAYRDSSFEGQSSDTELSDGRQLLYTDPSVLSRQRRTRDYQAQDLSLRFELSGVVDVAGFVNNVLFGLDYYNYHIDTDYRRWRTAWGAGDTTYSIDPENPDYTIFRPDVTPTTLTAEKQKGLGFYAQDVIELTDATKLLVGFRVDKFEQDIFNKLSEEGQEQDQTEVTPRFGFVYEINHAVSLYTSYAEGFRPNPGLDSDRNAFDPEETTSFEVGAKWENIADRFSGSIAIFDAAKTNMLTAEPNTGFSATLGEVESQGVEFQLTTDLTSDIRLDMAYAYIDAKTANEVNNLDWGVSIPKGSRLINIAKHSGYISLNHFTRVFEKEAFFGVTMRYVGDRLGQTTDPTFILPSYTLVNLAGSVNISDALSMRFDVNNLFDRDYFENSYHQLWTMPGSPTNYTVSVKYQF

SEQ ID NO: 11146 - protein, 393 aa, Alteromonas macleodii
MYYVGNNYYSDGTNSYFCSTSSEYNEELSTGSAIIQNISHFFFKTRKPQNYFYPYKKLETNKRLKKFEEIRNFATNGEEIYYAGEKLANADINTIKKIEEGLFYFVDKENVYYKSKLLSFKNNEKLKVFHENDYNVYYLYDEESGNVYADDYLFDTANAPYKVIGIDGTHHFSLLFISKDGVYFYEPFRKKQERIGDNIFKGEIKEIYPDIFSDDENVYYLDVYEDWAKKRVNNYFSLRKRPLNGELISRNTRIHYLDKKTAWENDWEKVADIYSNTNGSIWKKGNKYYYFDIYGFSQSIHKPIYEITDKEVLDYLLNFSKLKDRNIINLPDKIRDFISERKLIAFNGEVEMTATIHFIEDPYAYSIPKIIFISIAFLIGLYARYRKSKFSKK

SEQ ID NO: 11147 - protein, 202 aa, Alteromonas macleodii
MKTHLLTTAAALVLTSAAPALAQSAGDWTFGVGIINVNPDSDNGSVVDGTLDVEVGSDTQLSLTAEYFFTDNIGLEILAATPFTHDIDVGDGAVTGETKHLPPTVSVNYHFTQFSGFKPYVGVGINYTNFFEEKSSAGTLELDDSWGLAAQIGVDIPVTERGALRLNARYIDIETDAKLNGADIGTVKIDPVVLNVAYVFTF

SEQ ID NO: 11148 - protein, 419 aa, Alteromonas macleodii
MKQKKGLLVALLTPMLAFGGAAAVHASGYAVFTHGASAMGQGNAVTAHASDPSTVFYNPALMNKLEGTQVEAGTTAVLSSRQYEPAGAGNGASNDTAFFPSHFYATHKLNNQVSVGLGIFNPFGLGTEWNQNWDGRYIATKSVMKTFNINPAVSIQVTPKLALAAGLDVILLDASLEKKVPSAALGLPAGFDVNQKFKGDGKGVGFNVGVAYDVCDHFSLGASYRSEVKIDVSGNATLSNATLTAGGAPLPITIGGDTDVTLPPQFTAGAAFKGIDKLVLEAGVRWEGWSKFKELAIHLDNGQTTATPRNWKDAWGGNVGGRYQMNDTVALLAGYVYGDTPVPDSTFDPGIPDAKTHVFCAGTDLNFKPVTVAFSYGYQLLENRHKDNGIPAGFPTAAEANGKYKTDAHLIALSVGYKF

SEQ ID NO: 11149 - protein, 796 aa, Alteromonas macleodii
MKNTITYILIFLACQFLVAQTYTGSVKDAQGNEVAFANVIVKSTTDGKLITGVITDEAGKFEITVTTSEAFQLIVSFVGYKNWEKIITPNSPTAIGIITLLESENQLKEVVITAKKPIIQRKAGKLIFNIKNSVASNGFNAMEALKFAPKIDPTSDGIKMIGKSKLAVMVNDRLLNLDGQSLDSYLKSLRSENIEKIEIITNPPARFDASGNSGLINIILKKNTNIGFDGSVTATYVQRSYPGFMPSTYLKYSTDRMLIAFNLFADNEAKRSESSNEFLYPTLRRNGSTRTKQEIDGLSSGLNFEYKFSDNHKAGIILNSDIWKTEGALQNNTIFRSLSSQQIDSALIAPSNNTNKYDYLSASAYYDIKLDTIGSTLQFNYNHLKKNNEDDRSLFLSRYEGDLNNLTGTNSALNISEADYQVNSLNVDVELPIKDSKLGFGGKLTFLKNDSDIQFFDTTSGTSILDANQSNVFAYDEEVYALYTSYQRPLGEAFYLILGLRYEHTQTRGNSITTGIVTENNFNNIFPSLTLAYDPSDKHSFSVGYSKRIDRPGFSDINPFRSYTDFFSFNEGNPLLIPSITHNIDFSYIFNNDLEISVYHTILKDAVDFITLTTADTNTVISRPENFYDQSTFGLDIYYNFNPTSWFNSNNGFSAYYNSSESKIPTVTLADLSGSGFYISTRNTFTLNKEKGNTVYVNFFQNFPETNGFLKTFNRANLQIGGKFTFMDKRLTLNASVSDIFRQNRNRNREIYQNYTFNSRIYNDIRRLNVALTYTFGNNKSKSSRRKADDSDKSRL

SEQ ID NO: 11150 - protein, 193 aa, Alteromonas macleodii
MFKKVLVVALMGVSSFTFAGNWQVKFGGSVIAPSEDTTTALGVVKADHEYAFTPSVEYFFGQTPFSAELLLATPVNHDVLLDGQKVARIKQLPPTITAKYHFKNSTRFTPYIGIGATAFIPWDEQGVADKVKEDFGVAGQVGFNFQPADAKNWGVFVDVRYADISPEVTLTNGAKFDLDINPFVYTLGYSYKF

SEQ ID NO: 11151 - protein, 997 aa, Alteromonas macleodii
MFTNNKKQTRGVGAKTLLATAVTAALLIVPAAHAVDGSSIFKGHIVAQSGNDLTGATITLKHKSKGLVYTITSNAEGDYLLRNVPVGTYDVTIVKDGYQTMTEENVAVTIGQSIIFDVQLYKAGTDIERIAVTGSAIRRVDMASSTSGLTFSSSELKAMPVNTGFESIALLAPGTAAPGGSNFKGASSFGGSSAAENGYYFNGLNVTSIRTGLGSIRLPWEAISQTQVKTGGVSPEFGGALGGIVNAVSKSGDNDFKFGAEVRWDPDSLRSQHDSIFQDSGTISTNTQQSSYDFKEVQLWASGALIEDTLFFYGLFAPRREESNSAGQSTFSDFERDEDRWFTKVDWFINENHSVGFSAMNNKRTWTDKTFAYAWEENVVGEQQGVDAPGEDGGNVYSINYNGYLTDTFSVSAVVGRVTENVENVVASPNPGVWDERNGFVTLSQHTNSGVTEEEYIRDQARIDFNWDLDEHSIQFGVDYTNVKVDFFEGQNGIGDAKGWWTVKTAGENDVSSAALGSDFIERRIRSREVDSDTTSLAFYINDSWQATDNLVLNMGLRYSQFENTVSDGRAFVDIDNQIAPRLQAIYDVSGDGSAKVFATFGRYFQPVSVNMNITQGSASIEWFEYFELDQLEGNGSPSLLADGSPSRGDMLRDRRWRQRGITEPGLIASASLKPMYSDEFTIGYQQEVFDTMSAGVRAIYRDLGRSVEDTDVGPVLAKKLDEMGITDNVGQGSYYVLNNPGEAIQMSYDFDGDGQVDNVNLSAEELALPEAKRKYLALEFTLDGNLTDDLRINTSYTWSHSYGNTEGLVKTDNNQADPGWTTSYDYGDLMDHGYGNLPNDHRHSIKVSGAYNITDALTVGLVASATSGRPKSYFSVHPEGVDSCEQGSPWDACISKYYDQASHYDENGNPAPRGSKGNLPWSTNVDMSLTYYTDFFGSDMTLKGTVYNLFNSDSAININEERAQYGDNGLELNPDYGLVTSRQGARYMSLVARIEF

SEQ ID NO: 11152 - protein, 1097 aa, Alteromonas macleodii
MFHKKIKIINFLWRKNFYQSSSFGAWQKTMHLRDRKLISQLFFLCLVSSFTPGLIAKEAVDSVAFNIPQQRAYLSLIYLAEQADITLLFSFEKVEGIDVNAVHGEYNTMDALKLMLENTGLVAQMNDSGQISILYNKNHKRQDDMTTYNKNQVASAVLAAMGTLASPQLLAAEADTSADTKMEVIEVSGIRGSLSRSMDVKRSAEGVVDSISSEDIGKFPDTNLAESLQRITGVSIDRSGGEGQSITVRGFGPQFNTVLVNGRQIASESDTRGFSFDTIAAELVSSLDVHKTSSATMQSGGIGSTVNINTAKPFAINGFKAAGSIKGIYDENSEETTPQISGLISNTFLDDSFGVLLGVSHQERKTRLNQAQIDGWLENVGIPDPKTASGEAYTGNIFSARNYDHKVTFEDRTRTNANLVLQYAPTDNLVLTADALYSDFDVETNATSYGHWFTAPNVTGVDGGSPIVDANGTVVDMYQEVGLATDFHAKKFDRITDSKSFGLSADWDVNDNLNMSFDYSHSEASREANNGRGNQLSLIGYANRVRFQVNDDILPNASMFESANPNIYSGQQELDGTAYDPSVTPAGVQDYLSTDNSRAHVMLRRGWEVQDELDQFRWDNTWLADGDTGFSAARFGMMYSTETKSLNRWDNEGEGLHCAYCGYPDSPTISPDAQYIFDAGSDFLSGVSGSGQMPTSWLAHDGEANFAFLEQYYASTNSDTISFDAVLRDKSYSVQEDIFAAYFEVDFVGEIAGMLISSTAGVRYETTDTDVKGRDKPIAQLNILDKTEMLPAYGSVEAISQANSYDAILPSFSVKLEITDDLVARLAASKTMTRPTLNSMSPITVINTTRPGGDLTSSQGNPKLKPFSSENLDLSLEWYYDEVSYVSAGYFRKNVENFIVNTQEDLTFTLSDGSLLTDPSTGDDTDNPDSNDGVAHFTNTRPNNGESAIVDGWELAVQHSFGESGFGVMANATLVSSNAELDAADITQVFALTGLSDSVNLVAFYESGPIQTRLAWNWRDSFVQSLTQTNGDGPTIVESYAQLDLSGSYDLTENLAVFFEGVNLTEEYVHKRGRFENQLLSVEDSGRRFALGIRGSF

SEQ ID NO: 11153 - protein, 363 aa, Alteromonas macleodii
MKRAPLITGLLLISTSCAYASSGGCGADSTSGATNYSSVVDDVTVNQTDNVTGREFTSATLSSTNWQYACSCSAGKAVKLVYMVSPVLTTTGHQTGYYKLNDSLDIKTTLQANDIPGLTTDQVVSVNTRFTQIKNNTVYSAATQTGVCQGDTSRYGPVNIGANTTFTLYVTKPFLGSMTIPKTDIAVIKGAWVDGMGSPSTGDFHDLVKLSIQGNLTAPQSCKINQGDVIKVNFGFINGQKFTTRNAMPDGFTPVDFDITYDCGDTSKIKNSLQMRIDGTTGVVDQYNLVARRRSSDNVPDVGIRIENLGGGVANIPFQNGILPVDPSGHGTVNMRAWPVNLVGGELETGKFQGTATITVIVR

SEQ ID NO: 11154 - protein, 543 aa, Alteromonas macleodii
MTNITKRSLVAAGVLAALMAGNVALAADVPAGVTLAEKQTLVRNNGSEVQSLDPHKIEGVPESNISRDLFEGLLVSDLDGHPAPGVAESWDNKDAKVWTFHLRKDAKWSDGTPVTAQDFVYSWQRSVDPNTASPYASYLQYGHIAGIDEILEGKKPITDLGVKAIDDHTLEVTLSEPVPYFYKLLVHPSTSPVPKAAIEKFGEKWTQPGNIVTNGAYTLKDWVVNERIVLERSPTYWNNAKTVINQVTYLPIASEVTDVNRYRSGEIDMTNNSMPIELFQKLKKEIPDEVHVDPYLCTYYYEINNQKPPFNDVRVRTALKLGMDRDIIVNKVKAQGNMPAYGYTPPYTDGAKLTQPEWFGWSQEKRNEEAKKLLAEAGYTADKPLTINLLYNTSDLHKKLAIAASSLWKKNIGVNVKLVNQEWKTFLDTRHQGTFDVARAGWCADYNEPTSFLNTMLSNSSMNTAHYKSPAFDSIMAETLKVTDEAQRTALYTKAEQQLDKDSAIVPVYYYVNARLVKPWVGGYTGKDPLDNTYTRNMYIVKH

SEQ ID NO: 11155 - protein, 732 aa, Alteromonas macleodii
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 11156 - protein, 712 aa, Alteromonas macleodii
MKTNSNSAHLRRATLPVLCALLLHAAPLLAADAAPPTTLDTVRVVDTRSGELSSTANAGSALGLSVLQTPASLTVISREQLEQRGDSNLNDAISRAGAISAMPHPGNGLSALSSRGFTDGASVMRLYDGLRQYGGVGITFPFDTWSIERIEVLRGPASVIHGDGAIGGVINIVPKKPSRGAIENEISVTVGSEDTARLGFGSGGALTPELAYRLDVSGNYSGGWVDRGRNNDATFSGALLWQPRTDLQLTLTHAQGYQQPMRYFGTPLVEGRQLEALRHRNYNVDDSEIRYRDRWTQLDALWTPTANVEWRTRLYQIDSQRDWRNAEAYVYNRATGLIDRSGNTEITHNQDQTGLTSTLRVQGTAGGLQNSFAVGLDANRAHFKHTNNTYAGSSGPVDPFDPVPGQFVSDAPNLPRYRNRAEQYALFVEDRLALSERWSVLGGLRHDRARIDRTDLISGQNAFSKTYSSTGWRAGTVFALQPTLSLYAQYSQAADPVSGLLMISPANGAFDLAKGRQIEVGLKQAFDGGEWTLAAYRIRKTGLLSRDPLVPDRRVQVGAQTSRGIEASLNWNFAPHWTLDANATVLKAEFEDFLETAGSPPMLVSRDGNVPPNVAERLANVWLSWRFAPDWSAAGGVRYVGKRYADNANTLELPGYSTTDLALTWQAAPRTRLTARLFNVFDKAYYATAYYTSTQWLLGADRRVEFTVDHRF

SEQ ID NO: 11157 - protein, 732 aa, Alteromonas macleodii
MAQDLASKPDNDWQDLMFGPALMQNYALSVKGGGKYSTYYNSVGYTNQDGVMKGTNYQRYTLQSKQDFKKGIFQAGTNVVLTYDQSNPLYSVIRGGMVGHTLQAIPTWEQYDENRTGGYGGLYGDVVNLTHPLGMVDDNLMKRYSDNVKIFANAYVSVELMKGLKYKLNLTPDFQFYRYNSYEGLFDFGLAKHDITAVTEQQTRTRNILVENLLTFDRTFGDHKVSALVGYTYQDSRYRYMQGSGQGMPTGITEIDAASQGLAVSGNSSRSVLTSILGRAFYSYKNRYLLTATIRRDGSSKFGSNYRYGNFPSVSVGWNIAEEDFVKNSVSWLDQLKLRGGYGVLGNQEIDNYQYVSVVTTGINYPDGKSGLIQGAFPKTFANPDIKWEETAMTNVGIDFMALRNRLTLTADWYVKNTKDILLNVPIPISTGGANDPIRNAGKIRNQGFEFNLGWNESLNKDLSYGVSFLGTYNKNEVVEMGAESQVITGGTIHGGTYTSRTLAGYPIGGFWLIPTDGYFNSTEEVQAHQKDGVLIQPSAEPGDIRFKDTNNDGTINDEDRVYCGSPFPKFTYSINGNITYKNVDFSIGFQGVTGNKIYNATKLELTDVTRGTNYLASTLDYWTPENQNASSPRLIWTDPNRNARSESDRYLESGSYFRLRNLQVGYTLPTVWFHGFVQKARVYVNAENLFTISSYSGYTPDVNSSDVYSRGFDEFIYPSNRTFMFGLNVTF

SEQ ID NO: 11158 - protein, 185 aa, Alteromonas macleodii
MKFKTNKLSLNLVLASSLLAASIPAFAVTGDTDQPIHIESDQQSLDMQGNVVTFTGNVIVTQGTIKINADKVVVTRPGGEQGKEVIDGYGKPATFYQMQDNGKPVEGHASQMHYELAKDFVVLTGNAYLQQVDSNIKGDKITYLVKEQKMQAFSDKGKRVTTVLVPSQLQDKNNKGQTPAQKKGN

SEQ ID NO: 11159 - protein, 280 aa, Alteromonas macleodii
MKKITFYKILFLFFFISINCFAKDKTSIENSQWANLILMKGIEQRGGPFSFDDTYVEFEFGGRHEWLDLYGYVDFVDVLNSKSSDKHGQNNFFVDIEPRISIDYLTNTDLSYGVLQELYFAFDFYYADEPTGKGLKVLWMGLGSDIDIPWLGKSGVNFYTRYIDENYGASNENSFDGYVAHINWFKPFYFFSKNNFLSFHGYIDYEFGSNLDKTAFEKEYRTSDSLQSYLGLYLHEKKWLIGYGLKVYKNMTQWRDNQELNDKKTDTTGFGHYFSIAYKF

SEQ ID NO: 11160 - protein, 689 aa, Alteromonas macleodii
MAFACSASWGQASTTLDTVTVRSSGDSALERPLATGSRLDLSARDTPASVEVITREQLQARGDTSLVDAITRSTGITSLGHPGNSGSSLSARGFTDTTSVMRLYDGTRQYGGVGVSFPFDTWSIDRIEVLRGPASVIYGDGAIGGVINVIPKKPTRSPIRNEVQATVGTDGKRGLAFGSGGAIDEHWSYRLDASGDRSDGWVDRGDSSNRTLSAALRWDPVQDFSVQLSHALGRQKPMRYFGTPLINGVQDPAVRERNYNVADSRIQYKDRWTELAAQWTPSSNVIVRSKLYHIASDRYWRNAETYLYNASTGLIDRSGNTEIAHDQTQTGNTTDATFSGSLFGRKNQVSLGFDVNRAAFQHSNNTYAGSSGPVDPYNPDPGQFTSSIPFIPRYRNKAEQYALFAEDRLEMTDRWSLVAGARFDHANLSRQDLVAGTQAFKRSYSNAGWRLGSVYQLHPGLSLYAQASKAADPVSGLLMLSAANAAFDVSTGRQFEIGLKQSFWEGKGDWTLAMYSITKNNLLTRDPSNPALRIQVGQRSSKGMESTLSMQVAKTVRLDANVALLKARYDDFSESVGGVTVSRNGNVPTDVPERVANAWVGWNLAPNWTLSGGLRHVGKRYADNANTLKLGAYTTFDMALQWKATADTTLTLRGFNVLDKHYFSTAYYTTTQWLVGEGRRAEITLHHRF

SEQ ID NO: 11161 - protein, 630 aa, Alteromonas macleodii
MAQETGAAYRLDPVIVEIRDAFSGAADRATSMYVSELELDRARTGDLKDVFAGIASVSVGGGIPIAQKIFINGVDMLNLGVSIDGAAQNNRAFHHVTSNAIDPGLLKQVRADATVSPADAGPFALAGSVVFETVDPEDVIPAGQVVGGNVRLSYADNGGTAQGALTLAGTYQGFSWLGYVKRAEGGDYETGSGATQVGSGANLVSTLGKIAYESQDGHRFELSAQQLRDEELRQFRPNFGGQNGAPQALYRFDTLRKSYSFTYENVLAEGLWDPRVTLGYSENQVDRPLPSASNGTTGTFSASVSNTFNLGGGTVVAGVDYQETDGNYYSPPGSSWPADITERSRNVGLFAQARLDPTDRLRLSFGARYDRQTFTGTGGQTIRNGGLSGNASVVYALTESFAIRGGVSSVFGGIDIEDNYTFNPAWNYTALRPARANNATIGFDYEVGTFKLGGEVFLTRFENARTSTFAATGNSDFESRGFNLGATYGWNSGFARFTLSHSEVSVNGVPQDSYATLDFGAPLGTVMAFEIEQETGLPGLTVGGGVDAALPKSGAGVGSFGNRDFPGYEVVNVFAEYVPPSMQNMTIRAEVTNLFDVTYADRATYGGDFRSIDTLKEPGRTISVVAVLNF

SEQ ID NO: 11162 - protein, 355 aa, Alteromonas macleodii
MKQFKLTSAVLVLSFATPIFAVQANDTAATNDELRTELQQIQQRLAMLEAQEKEASVLSDTQFNFYGSLRPTFGLTHTNSDDVWDVGDANSRIGFAAEHQLGNGLVGFAKGEFKVDIKDDGDFGDARKAYVGLKGFFGSVAIGKQAVTQEIISDPVDIFNRSGTPLAYDSASPFRLNNLVTYRKEFGDLLFSADAQFDGNKGSGGSDFVNAGIRYKTDLIYIAAAFYNKELEDNKDENTFGVTLAKSFNDLYLAAAYQNIEKDDIDGTTLDGSTLDVVASYPITDSYKIKLGVSRYDDGGNDITSAKYNAYNTTLEWHKTPQFSTFIEYQKTDFEYRETNDQFMLGMRYNFDYTF

SEQ ID NO: 11163 - protein, 237 aa, Alteromonas macleodii
MKTFKMTLAAALVAAVALPASANYVDVRGAYKTEAKTYETRVRAGFDFAEDWQIHLEGTQAQGDKLFSNSGKSVAAFETELNYNWAINDNFTLTPGFVYWNGSDHMEYRPYLKATYAEGNFYTAARYRYQAASSSTTPGVKTNDTNQVDLWVGYNLNDFALEYNPAYINQKDGGAYTGNGTDKADTKWEHTFQVKYTGFESWAPYVDYQILDKTYANAQYTDFKTENRIRAGVTFNF

SEQ ID NO: 11164 - protein, 788 aa, Alteromonas macleodii
MGAQQITILDRETGEPVADVAVFNAQRSTSAISDASGQVPISGFGMRERIFFRHIGYQPLNLTRRAIENQGNRVYLEVQAEQLQEVVMSVSKWQQQKREVPQKIETIGAADVAFGNPQTAADLLQQSGKIFVQKSQYGGGSPMIRGFATNRVLLAVDGVRMNNAIFRGGNLQNVLSIDPFAVRKTEVLFGPGSVIYGSDAIGGVMNFYTRDALLSPGDSLMVAGSLEYRTATASGEHTAHGRVNLGFENWGMLTSLTYNHFGDLRMGSHGPDSYLRRRYVVTEGGTDRLEDNPNPLRQVPSGYDQVSLMQKFRYKPARQWDFNLGVHFSETSDYARYDRLIRPDSDGDGLRSAEWYYGPQKWFMGNIRMAHTGGNKFYEGMKLSAAYQFFEESRNDRDFGEDILYSTRERVGAYSLNLDFETRKVGDLRLYYGAEYIGNSVRSDGSETNVQSGVRDGGASRYPDGSSWQTVAAYVNGSYRFKPNLTLLAGMRYSHVWIDAEFDPTYYDFPFEDANLDNGALTGSLGISWFPGRNTQVTLNGSTGFRAPNIDDIGKIFDSEPGSVVVPNPDLEPEYAYNAELGVRQNIRDRLVVKGSVYYTYLVDALVRRDFTFNGERTIPYNGEPSNVQAIQNAAKAYVYGVELGFDASLAEHWSLLGNYTITEGVEEEEDGSESPARHAAPDFADLHLVYSKYPLKASFFLNYNGEVPFEDLAFSERSKTFIYASDAGGNPFSPAWYTLNFRSSYTFPGDYRLTLAVENLTDQRYRPYSSGIAAAGINVIAGLSMRF

SEQ ID NO: 11165 - protein, 353 aa, Alteromonas macleodii
MQLKRCFKPAALAVAAGLTMGAAHAQSSVTLYGQVDAWVGAQKGFDSSRAGVVNPGGMSTSYWGLKGSEDLGNGLKSLFALEAFFRPDTGRAGRFDGDNFFARNAFVGLSSNSWGTIKLGRNTPPYFVSTILFNPFIDSYTFSPAVFHTYLGNGLSGAAGISGLVGDSGWNNSILYSTPDFNGLTANLIYGAGEQAGHNGQNKWGGSLLYFHGNFAATAAYQQVRFDANPGDLDTIVAGFRRQDAALLGATYDFGVVKLYGQYQHIKNTISTGDTKANGGQLGVSVPVGAGSILASYAYTKTSGAVDVKRNTWAIGYDYALSKRTDLYAAYFRDKVTSLSTADTFGVGMRAKF

SEQ ID NO: 11166 - protein, 690 aa, Alteromonas macleodii
MRTVIIFCLCLSAFAAQAQNDVNYTYMDSLFQQLPEVLVKGERPVVKAERGKLVYDLPRMVERLPVNNAYEAVKELPGIVEQDGNLTLGGRSITLVVNGKVSTLDKDDLKSVLQNTPVSRLEKAEIMYAAPARYRIRGAMVNVILKSNIGQKPSWSGEVAAMYEQSRREDIAGRGNLLYTSRRFSADVMYSYGFKHTTFGLDKQSWHTMAGDVHELDLKTEAKGYGGRHNLRLGADYDFGKKNLLSVVYNTQYRYGQDCTKMRGTAHSDKTDDGDRQLHNVAADYQSSFGLSAGMDFLFFSNPSQTFLEKDMQDVSRTLNYDSNQRINRWLFYANQLHSLQGGTEINYGVKYTATHDNSYQFYRDGETGALIPDNSEKLLRKEYTLNMYTGASHSFGKKFSAEVSLAAELYHAGERHSWMLYPTVNTTYTPADGHTLQMSFTSNRKYPAYWQLQPIIQYVDSYTEAHGNPDLKPSSNYSLDLNYLYKNRYMIGVNYNYTPDYFVQLPYQLPDRLAEVNQFVNYDFQKRWTIQTMASYKVSTWWNGRIFAFGLFSHDKNSHFHDIAFNRHKFSVILNTTNTFILSKKPNIIGTLAGFYQSRAIQGVYNLSPICNVSTSLQWASPDGKTKVILKGNDILNTSNMTTRLAWGQQRNRTEMNWDNRSFTFSFLYKFGGYKEKKRTDVDTKRLGR

SEQ ID NO: 11167 - protein, 271 aa, Alteromonas macleodii
MLAGESKEFVYDSSTGRKISQLNWKIKNNLILKGDVSWDAWPFLTLNARGWTTLSSGNGHMEDYDWQKEDQSHWTDRSRHPDTDLNYANEYDLNLKGWVLKGDDYKVGVMAGYQQTRFSWTAYGGSFNYANGNDVGSFPNGARGIGYQQKYSMPYIGLTGQYRYQDFEVNAQFKFSDWVTAKDNDEHYMRDLTFREKANDSRYYGLAVDAGYYVLPNTKLFAEFSYNRYEEGKSGTQMINNATGTSFSDNGDAAGLQNKNYTITAGLQYRF

SEQ ID NO: 11168 - protein, 869 aa, Alteromonas macleodii
MKMRSIFIVSSPFGTPTRERALARLCRTALLAALLTSRLAQAQEQSPERATPQAPSGSAPAPQPSEAPPAAPVVEMPKLLEIVEAIYPAQAKQDRLEAKVALRLTLDAQGVVKTAEVLGPVGHGFDEAAQEAALRFRFEPAKRNGTTVPARVVYTYEFRLPPPPTPPSAQPSGQAAASESSDSSFGETIEVSAGGESVAQRRRQSAEAVQVLEVGTLQREAVDLGEALARTEGVSVRRSGGLGSTSRFSIAGLTDEQIRFFIDGVPLELAGYGAGLANVPVNLVQRVETYQGVVPIRFGADALGGAVHLETDQNFQGLGASASYEFGSFDTHRLTASIRQLHEPTGFLLRASGFFDTTRNDYLVDVEVEAADGSGRPVRARVHRFHDGYRAGGAGIEAGFVDQSWARRLLLRVFTGTYDKDLQNDIEMSAPYGEVEYGETSGGSTLRFEQIYSNGLSVDAIAGYTYRRNHLTDLSQCVYDWYGRCILVLPQPGVLEGRPIERTIGQHTGFARLNFGWNVSPSQKFRLSLAPTFVDRAGEDRQLQEAQQLDPLDGERNLFSLVAGLEYEIDAFEERLENILFVKDYLQRAYGEKPLDGGEFAITKRNLHQVGVGDSARLRFAPGLYAKASYEWATRMPRPDEFFGDGLLVVENLKLQPETSHNLNLGLTYEAPSTPAGDFRANVTGFGRLADQLILLVPQPSYFVYENVFAARSLGVSGTAGWISPGRYVSLDGNATWQDFRNTSSEGVYGAFVDKRIPNRPYLFANGSARFELSNLMNPRDELALTWNLRYIHKFFRAWEGFGKVDTKDVIASQWVHSLSLTYVTRSDSATLTWSADAQNLTDAKAFDFYGVQRPGRSLFATLTVDFET

SEQ ID NO: 11169 - protein, 259 aa, Alteromonas macleodii
MIEQFFRPDSVEQALELKRRYQDEAVWFAGGSKLNATPTRTDKKIAISLQDLELDWVDWDNGALRIGAMSRLQPLRDARFIPAALREALGFVYSRHVRNQSTIGGEIAARQEESVLLPVLLALDAELVFGNGETLSIEDYLACPCDRLLTEIIIKDPYRTCATRKISRSQAGLTVVTAAVAMTDHDGMRIALDGVASKALRLHDVEKQNLEGNALEQAVANAIFPQEDLRGSVAYKRYITGVLVADLYADCQQAGEEAV

SEQ ID NO: 11170 - protein, 1125 aa, Alteromonas macleodii
MKNTRCTDFCVPKNSSIKQLLKTMRVTIFLLFFCVFSTIAGTVNSQNARVSIHKTNVPLEEILNEIEHQTDYLFMYSNNIDVKERTSIRVSEKPVSEVLKKLLGNKIAYEMEGMHIILSDKRENQTAIAQQANKIQVKGNVTDMAGEPVIGASILEKGTTNGIVTDFNGDFSLNVNPGAVLVVSYIGYSAQEVKVIPGKVLKIKIKEDAELLDEVVVVGYGTQKKVNLTGAVETVDADVIENRPIRSATDALQGTVSGLTVTSGTGKPGEFASFKIRGNTSVNSAGALVIIDGMPGDINTVNPQDIETISVLKDAASAAIYGARAAEGVVLVTTKKGTSEKVKVEYTGNFSFNTPTRLPESNTGLDHALLSNVAFTNAGLAVPFSQKAIDAIKDPNTIAIPNGKEWTYTSDMDWIDLMMDHSFQQTHNLTISKASDRLKYLFSIGWLDQNGMFSEYGPDNYDRINLRSNISVELIKDKLSLDSRISYSRGVNLYHAAEGSWSIPYITFIQAGPNMPVYDPNGNYSRHRMQLNPIQALKEGGEGRTRNQRIEGVFTLEYKPVKGLSLRAVGGANILDGQKKEWRRAYGKYGVDGLISTAFGQKSPNSVTQNNSHRQYLTGQLIAEYKGVFGKHDINVLGGWSAEENLYEDLQGKRTNIVGNELPALNLGDTDGWSNAADENEWALLSGFMRASYAFAAKYLVEVNFRADASSRFSKKNRWGVFPSASVGWRITEEKFMQNQHIFDNLKLRASWGQLGNQNGLGLYDHIASYNINGYYPFKSELGQWAVISKLPSESRTWETVEVKNIAVDMAFLRNRLTVTGEYFIKKNKDMLVSIEIPSIIGIDVPTGNYGELKVKGWEVTVGWQDKIKDFSYGARFNLSDQKDKLVDYGVEYNGFVAGVNQKVQGYSLGSIFGYRTDGYFTSEEEVKNSAAFNKAITGVGDIKYIDKDGDGKISAPNDLEYLGTTTPRYTFGLNLTAAWKGFDLGVLLQGVGKRNFYLSSEVMNPYYATWNNFSYKMHNDYWTPENPNAAFPRYYAGANHNYQISDHWLQNAAYVRLKNLQLGYTISPKLTKSWGIQRLRVYFSGDNLCEYSKLNDNFDPELSDINGYVYPIMRNFSFGINVTL

SEQ ID NO: 11171 - protein, 413 aa, Alteromonas macleodii
MEYNQSRNAYVTLNSTVHRLKTYASYWWGRDGTFSLLAPYNYRVLDATTEYDFQPIKNLTLTPSVAVRFVDYKEDLSTGKDQLLEDNATSFTYAGGVKLDYQLAKKWRIIGGIRAEKFKFPNQIYLNYQAILAYKPGEKHFFRLLYGRANTGSFLYNNKVNISVTPPIAPPPGFDGFKVTNQGVPDVEPITQDMIELGYRGKLNNRILWNVEVFASSTTNFTTSVSNGPQPNPPFIEEILRRTNIPLRVEQVGTTLSMNLSFSRLKITPFITLQQTNLKNFSPSNRSPSYDSTQSYLDTYDLPHEGTPAFYGGLNVFYLPISGLQIYLNAFVFGSHNFYGSVMAPPGAPLNLADASKAVIPQQALINIKVNYALKDQIHLFVNARNLLSNKQPQHFHTDRIRPMVLFGFGVDL

SEQ ID NO: 11172 - protein, 890 aa, Alteromonas macleodii
MAAAMPAYAQQADDAASKADSKSADKGGIEQVTISGIRGSLQKSLTQKRNADSHVEVITAEDIGKMPDKNVADSLSRVPGVTIGNAGATEGGFDEADRVSMRGTSPSLTQTLINGHNVASGDWFVLDQSGTVGRSVSYTLLPSELVGSVVVHKSSQANLVEGGVAGSVDIITRKPLEFKKQFTAEATLGAVYADLPGKTDPQISALVNWKNDANTFGILVQAFSEERHLQRQGQEILGYTQIAPGSKIALAHPDLAGVYAPNLINSALFEQQRKRTGGLIDAQFKVSNDFSFDVNAFTSEMKAANYNRSYEFWGAQVINAGAGQSPNPGYTVKNNTLTSATFAPVAGTNYGVYDQISRPDESASANFVELGTKWRASDSLTFTTKLGTSSGEGKTPTQNVAEWNVGVGAGAGYQLNGTGTAANWNLGATNNASPAGAQFGWIFGDQNVNVKDKENWAQIDGEYSTDWGTLKTVQFGLRYNDHKRSSEGVIGQGPTAAAQDPANFPSGYSNFPGNFGSGLGSGFPTNVWYYTPGQLAAYNAFTNRDPIAREDWQNEFSVKEKNTAGYLQGNLEGDRWSGNIGLRVVQTKEDVLSNIGATATTPGAITTSAFGPFIRQNDKNNYVDVLPSANLKFDLSKDVIARFAASKTMTRPDYSALSGQVVLSPPPTFGAVGSGTAGNPNLKPITSNNFDASLEWYFAPRSLVSASIFNMNLTSYVGLGTVTKSYVTSINSHPTDFLADYQLTVPVNTSGTVNGIELAYEMPLGKNFGFATNATFINAYDSTNGPLVGASKRTANLTAYYEDERFNARISYNYRSAFYSGLDRSTAFYQDAVGTLAMSLGYKYSEQLSFTLDAQNLNNPTLKYYALNEDQPRAFYKNGRQFYLNAHLKF

SEQ ID NO: 11173 - protein, 858 aa, Alteromonas macleodii
MPAAHAPVLSTLAVLITAILAASPSHAAEADADPAAAAATANVAASTLDAVVVTGSRTSTRTVKNSSTPIDVISAEDLTATGQANLLEALQRALPSLSQIGGYQSDQESLIRGYQLRNLSPGYTLVLVNGKRRNASAYVSGANGGGFPGHAWADLALIPVSAIDHVEVLRDGASAIYGSDAITGVVNVILKSQAHGGELVVESGQSIDGDGSRTSVRANVGLPWGADGFVNLSGETTRQHHAIRTRRYIDGYLSYPAVDGSGNLVALRPNNRLPAGASLNPAEASRNAEANTILSSPSYALKAFAVNVGHGLGESAQFYANATASDRTAQAIQNFRLPATIFTTYKAPGVLSVFPDGFLPVLETKEKQYTGTAGVKGQIAGWDYDASLSGNRSTVRTYTRNSVNYSLPYPGSPTDFYDGKLDYQQGIANLDLRRGFEVAAFASPLEVSAGAEYQHEQYERGAGQWESYTGFGAAAFVGYSTADAVKATRNSKAVYVGAATNITSRWYLDAAARWEDHSDFGSVSTGRLTTRFDFTDALGVRATVSNGFHAPSLGAQFYQATGSCPCGTTLVAQVSSPAAVALGATPLKPEKATNYSLGVTWDPSPAFHLAVDAYQIDIRGQLGQSSQIGYNAQDPARVTDNSGTVLSAAQKNTIDALLGSAGISILPGDAFYASYFTNVGNTRTRGVELTLEANQETAWGKLRWSYAANVGRTTIQKVSDIPAALQGLPNINLLTKSSEYALRFRTPSYTQVAGLGWQNGRWRSNVDFTYYGPIKRLNNGVEYKQPPVLVTNLSGGVELGAGWSAALGINNVFDKRTRKVPEYARSATDVASIETTWDNGDVLSNVGAYWYGRVSYRF

SEQ ID NO: 11174 - protein, 702 aa, Alteromonas macleodii
MQPYVFTPSLLALLIANTCYASSAETLPDGSAKSDLERITVTATRKEALDTDLAMSVHGISEEELQMDNGQHVAESLNSISGVLIDQLSGGQGHKTSIRMPMNTSGYYLFLQDNVPLQSAAFFNHNALWWSSFNSNVGRMEVLKGAGTALYGSGAVAATVNILTKPVVEQTETAMDVVLGQEQYGKVQISHSNKLSNTQGIRASASYVTNEGWRDHTASQRAEINLRHEYELSANERLITSFTASDLEQEMAASLNDDQIENDRTNSGLSDEVLASDPLRKTQYMRLTTQWDQMNEDSYYSVIPYLRHRTNDYTATWNKNMPRVQSTVNTVGLLALANFVHTADNETTIGVDFEYTEGDQLSYQPLDFTTTGWGADTFVKGEKFYDDTTSYTSISPYLQHKRTLTKNLDLTLGVRYDYAKYEFTNHLGVYGDIGHGKISLEDRDDDFSHLSPKASLNYHLSENTSTYFRYANSFRLPTAGSLYHLTTKDSEVAAPVDPETSDTYEIGYKGNFDNITFDAALYFMDVDDGIVHAYNDQGQRYLTNATRVLHKGIELSTLWVINDELNLSVAYSKSKHEFDEHDDYSGNEMRMAPDYIANVRLRYLPSYLEGFSSQVELQSVGEYWMDDANSTDPDTGLERKDDGYSIVNLKARYQLNSQLSFNARILNLTDKVYAQGGEYRYGKNSWSPGAPRTAYMGMSYQW

SEQ ID NO: 11175 - protein, 728 aa, Alteromonas macleodii
MSKSAARLRMRILANGVSFFAAGAVAPALAQTPADLPPVLVASPGPISLTPLNVDAVLQSDATAAQGYRPEFLSGVGPLGAKPIIDTPYSIDVISRELLENTQAQSTDDVFKLDPFTQNVFPVNRGNPFSVNIRGFATSETTLDNMRLWNTSVIDIEGMERVEVVRGLSGFLYGAADPGGLINFVVKRPTAAPFAQLTVGDYGIGPFTGGAGYVHGDFGGPIDKEGRFGYRINIVGQSGDTAVDQQRLQRSYFSAALDWHVAPEALAQVNVFHSYYRVDAPDPFWFYGGTAIQGQAPSAQRSWSQPWAYYRNEQNGAEAKLTWKPNDILTLRGGFLYIHSSQPEISVNNLVFSNDGTYSQSLNNNAAGDLTTLSGYGFIDADFETGPLKHKVTGGYFTQRYQSVLPEDAASFASTTGNFNFGRPYYAAMPSFDAIGTRPSSLFFTRSNQNAVLGDQIDYGPLSVIAGVTHAQIQTSDYTYLPPIGVSRTLESQYDEGRFTPSASVLFKVTPWLSTYATYIEGLEAGDTAPVGALNAGETFPPSLDRQYEVGAKANVGATLLTLAFFDIDKAYAFLDSDNVFKSAGREEHKGVEFGASGKVLPEWTVFGGVTFLDPRVTNDPTLDGLQPINVSSRMAKVYSEYALPFVPGLTLTGGVYYYGKYAATVDNTQYLPGYATGDLGFRYETKLNGIPLTARFNVSNVTNHSYWMSNRFVGAPREISFSLATRF

SEQ ID NO: 11176 - protein, 376 aa, Alteromonas macleodii
MAAVAGVRITPMRVIIMMKRNILAVVIPALLAAGAANAAEIYNKDGNKLDLYGKVDARHSFSDNNKQDGDKSYVRFGFKGETQITDQLTGYGQWEYNIQANNAEDTGAQDGNATRLGFAGLKFAEFGSFDYGRNYGVIYDVNAWTDMLPVFGGDSISNSDNFMAGRSTGLATYRNNNFFGLVDGLNFALQYQGKNDRSEVKEANGDGFGIGSTYDIGNGINFGAGFSSSNRTLDQKYGSTAEGDKAQAWNVGAKYDANNVYLAVMYAETQNLTPYGSFSDTIANKTRDIEITAQYQFDFGLRPSLGYVQSKGKDLNDVDANHDLLKYVSVGTYYYFNKNMSTYVDYKINLLDEDEFTIANGLNTDNVVAVGLVYQF

SEQ ID NO: 11177 - protein, 395 aa, Alteromonas macleodii
MTQAALFRTSHTIAFAGALLATTSSATQAQSAVQLSGIIDAGIAYVSDSGNTHGHQSAWQAKSGDINGSRWILSGREDLGGDLNAAFMLANGFAPMTGTASQQGRLFGFQSWVALQSQRLGSLIAGRQFDEVVQFVEPFSLGGTRYGGTAFAHVFDNDNLDNWTRINNSVKYVSPLLGGLKLGVLYGFSNRAGGFDDNRAYSLGASYQYGNLDLGAGYVQFNNASNLASANVNGAAPAGAPFNAARQRTWAAGGLLHFGNGAAGFVLSETRLDHATSINDVVDTAVSLPGDDVRFQNVEVNVRYSVLQNWDVSAGYTFTAGRFATPAGVRYPKWHQVGIVNTYFLSPTTDIYAEAVYQRANQLAGTGIRGAQIANFSRASGANQLIASLGLRRRF

SEQ ID NO: 11178 - protein, 678 aa, Alteromonas macleodii
MAFFHGSQFYSFNGMTKMTIPHVKAIAAAVCAACLPSLVYAADQDTVVVTATGFEQKIQNAPASISVITKQQIEDKAYRDVTDALKDVPGVVVTGGGSSSDISIRGMASQYTLFLVNGKRISTRGTRPNSDNSGIEQGWLPPLESIERIEVIRGPMSSLYGSDAMGGVINVITKKVSNTKGWTGSLHGDATFQEDRDSGDLYQTNAYASGPLIDGLLGAKVTGLLSRRAEDKIVNGYNEQRLRNGALTLNFTPDDKNDFDFDIARELQDRDSTPGKSMAEESCRNGSCKPNSKSENRYEHTTYSLTHSGYYDDFNTTSYIQQEETNNPGRQMKSYNTIFNNQNQIFLGAHTLTLGGQYRYEKLSDNGNQLKAYEDVNKLTRWSWALFAEDEWAMTDSFTLTGGIRMDKDENYGDNWTPRGYGVWHLTDQWTLKGGVSAGYRAPDLRQSSPTWGQITGGGRLNGIIVGNADLKPEKSLSEELGLLWDNGDNLNAGVTLFNTDFKDKITEVRRCNSSSDPACTIGGEKYDFVSDRVNVDKANMRGVESTFGWKITRDLNWTANYTYTESEQKSGQFSGKPLNKMPKHMFNTTLDWQATQDVGFWSRLNFRGKTSEYLSRTSMAQGTPSYTQVDVGVRYYAYKNLLLTAGVYNVLDKQIDYETYDTILDGRRYTVGLTYNF

SEQ ID NO: 11179 - protein, 722 aa, Alteromonas macleodii
MRKHPLSTSISLILFFGISTSVWAAEEEKNIENQTSNVLPVISLKAESNQQKYAATQARSALKSDAPLFKTPQSVSVITKEQLDQKQATTLSQAINGVAGVSAGYLGRRGWDDFIIRGQNSSDQVYIDGLRQSQSPADGVAVDLSGMDQVQVIKGPASVNFGLVQPGGMVNLVTKRPQAENFANAALTYGSYNFKQATFDLNYAPKQTEKGAFRLTGRISDQDDPTDYVYFKNFYISPSYNFDLGDKAELSVIASYQHREYLRQQGLPVIGTLKSNPNGAIDRSLYLGEPTFGGYEADVYRTGWNYKYKFDNGWTFNQNAAVQQLKSTGRVVFTQTGTNFWVGTTPAYTTLSRTNNGRYQSHDTLTYSLDNSFQRAFNFLGMQHDLSIGVDAMQSKDDYVNDRYTTGSLNIYNPVYGQAVKYVAANSTEDINRLRYSGLYVRDRINLTDQLVLSLAGRQDWAEVSTQNVSKSGIAAKGLTDQNSYNKFTGNVGLLYSINDVIAPYASYATSFLPNTRSDVNGNILAPETGQQTEIGVKLQSPNQLIQGSLALYDLRRQNVAVSDPNNTSAYVLNGEQLTRGIEAELSATLIEHMRVTASFSHMFDSKITKDSVASNVGVALDNVPQNSYSLSSRYYLTDLTSGWFVGAGIRGESSKSYKGLDVHTPSYLLYDAEAGYDATRWGAQLSIKNLFDKDYYAGLLNANMVTLGDPRQINFTVKFKY

SEQ ID NO: 11180 - protein, 973 aa, Alteromonas macleodii
MKTQEVVIKPSVKVVMMPDTEILDEVTVVAYGTKRKQDLVGSISSVKNEIISNSQATSVSNALEGAVAGLQVVSSSGQPGQDANIVLRGIGSISASNNALIVVDGVPFNGKLSDINPTDIASVNVSKDAVSNSLYGSRAAGGVVMITTKTGRKDKVAINFNGSWGVAQRAYKDYDMATDPGEFYRLSWYGLRNTYWAAGKSIEDSNLAASQDLLGELGNYNAYIIPQGEYLVTPDGKLNPNARLRYNDSFADALFDNAFRQEYNVSASGGNDRTDYYVSMGFLDNDSYVLGSSYERFTARANVNSQLKSWLKVGTNVGYSKATQNGVQENAGAASNPFEVARSWAPIFPVHAYDAEGNMKYYEDGNPMYDAGNGETDGTSKRPTATNQNVIANMKEDIRETVYNNLTSRSYLEISFLKNFKFTANYSYDFTNSSQTVFYTPLIGDGQSFGGRGTKGSYNTTTTNFNQILAYSNVFGDNHHLSAKIGHEYYKYEYQYLAGQKTNFFNPNNPELDNGGQMQYINSYTANHNIEGYFGMADYDYSNKYYLSAAFRRDGTSRFLDRWGNFWSVGAAWRISNEAFMEGTNSWLNDLKLRASYGTQGNESILSEYDYAYVYTPYQDQYTVTWNGSELGYSPEFYGNPDLTWEKQKTFDVGVDFRLFDRVYGSFEYFYRRTDDMLFKRPVAYSTAGRPYNWENLGAMKNTGIEFEVNVDIFNQPDLKWTVSLVGSHYKNRIVTLPEENRENGITSGPFNLREGKSRFEYYTYMYAGMDEKGNAMWYMDETNEKGEVTGRTTTTTYADATRYFIGKSALPDFNGGLSTTFSYKGIDLSIATAFQIGGYAYDYSYLSGMSSSFYVGHNKDMWKTFNPETGQGSLPIWNADNASNSFTQQSDLNLIKASYFSIRNITLGYTLPKNLMRKLGVEKLRIYATADNLGLWSKRQGFDPRVAMAGSDDEYGGYSPMRVISGGINLTF

SEQ ID NO: 11181 - protein, 907 aa, Alteromonas macleodii
MKLSSCGFLLTSSLLSTCLIFADAASPTPKATTDLSTGFDGSSQEFTSKTSNDSNETTYNVTADISFENISTITASQPPPPPPPAGNKSVTEGCCFSNTAGDLIFTGNSHSLSFKNISLTGKGAAISNTADTKTTTLSGFSHLTFSSSPSSTVATGKGAIFCQGSSLNISNNTLVSFTDNHSTENGGAIGYETTPTPPTPPPTPPSSPNPSPQATHLSSVSSGTPVQSAQATVTFQGNTEVLFSGNSSGKNGGAIYAQNLAITSSSGTILFTNNTAKEKGGAIAIANSGTLSLSAEGGNIIFQGNIAKDGSNAIDLGTSAKITQLRATQGSSIYFYDPITGNGANVTDKLVINNPDTISGGGGSSGPGGAIRSSAAQPSPKTYTGTVVFSGKNNNTKALTNVTSLTQPVELAAGTLVLEDGALFDTKSFTQKDDTSKVLLEQNSQLQASENIDLKNLWVGVSDPTTKRVAGVSTSGSGSITISGPITLALSDPKFYENPDLAKDLNQEFIKIAAAKGTITLNNQSDPVQQDIGDHLGYQGVWKLTWADSPSGKEKVATLDWKPQGYIPPSGDTHSQTSLVPNSLWVMAFDVAAIQRLIEEEAKSATGGDIWGAGLSNFLQGKKTDKNRKFRNISSGYAAGISSKSLHDFKFSFSFSQLFGRAKDYAGARIHEKILSGSLYAQYDTKLLPILKFLSGTSVFRPSFLTQVSEDFPISFQAQFGYFYGDNTMKIKYPDTTQANSSWENHCCSGDIGASITIPMQSKDGLIQKASPFAKLQSIYVYQKGFQEKGLRRRAFDHTYLINISIPLGFKVHGESSSKDLYYEVSAAYVGDVYRHNPQNTTTPIVAGVVATPWLTTATYLQRHAARFQGSGSYALTSYIHLFAQGSVELRKLASSYHANAGSSIHF

SEQ ID NO: 11182 - protein, 1010 aa, Prosthecochloris aestuarii
MTLFARLSAGAAASALAIGFALPASAQQAGIQIAVVADDGRALPDVEVLVENPGIGFRRIVRSDAQGLARVEGLTTAGEYRVSAQASDRFEPGEPARLSLRANFSSSVTLRLVPAGTAIVVTGRRGITALNSVNAEVSASLGREELVALPIEGRDVLGALIRLPGVVPSTGFFPEAPSISINGSNGLDTHYLIDGLDNNENFLGGIKFPVPLGFTREVTVLANSYSAAYGRTANGIVNYTTPSGTNDYHGEVYALVRPGRPFDARSPFPRRDLSGNPVGESFERYQAGASLGGPIVRDRTFFYANFEYTRDRNVQIVDAPALGTVANVTGNNQFYLGSLRLDHRLTADWTLGLRANVGRVTIDRPGGGLGGGNVTFPSAGSDQDRFSTLVAATASYSGDVWSYDGALQFSRFRWNYGKPKGPAGPQVTIRDPSGLTVGVVGHPGFVFDDVEESWQTTHRVQRRLGNHRLRFGADLIHSDFSLLGGGNPDGNYIVDLTASQLSQLAAGGRGLALSADDVLALDPAVANYSVELRPQSFGTGQTQIAFYVEDEWQLSPRLTATFGVRWDYDSLTAKGGGGDYDNVAPRLALNYRPDARSTLRFGAGIFTGKLSYAVISDALQRNTTSAGFLTQLGSLQAQGIIPAGTDVSALTFAGNLGVSPPCATVSTCPTPAEVQALRETATLGEARILGPTGYRSPWSLQLSGGYQYQANDTLTLSADLVYSRTHNLVRLRDLNAPAPFTPNLANLTDANIALLRAQQDNAARFALAEALGLVRSQAAADATRPVALVAGGARQITVSETAGESEYRALILQLAKARGSDAYAFRLSYTLSKLSNDTDDINFRASNSNDFSAEWGPSANDRRHVISAVGYLYPLKGLTLSVAGLFQSGQPVNLVPDARIFGTQDLNGDGASFGENFVGNSDRYPGAARNSARLPWSATVDVGLRYAIPAFDGRIELSADVFNLFNANNESGFANAATTSNQVQFGGGAPFVQRNAGPPRQFQFGAAWKF

SEQ ID NO: 11183 - protein, 872 aa, Prosthecochloris aestuarii
MKKSFLLYTVSGVLLFSYPSLSYALASTDLQPLFVNYSLKKNKNNNLKAEQLGEPASRTFVSKKRKRSGAEESSAGASLSIPVKSAKSRKRPILESSPTNPTSESPSRSPASIKPANSAQVDEDQSTKIEVENGTTVTKQNVKIHDNYVAVHAQEANSKVKIIGGSVSSNFIGLSTLAGGTIDATNITTTVTSVGLLNTNGTIILKDSTVNVTGNDKTHGIVLRGMQNPSGNQQAQNAGREGNVHHEKDMRNKVMLTNTKILVQNGIGIGVYGAHASGEVTLKDSEIRADMLSKNEKNIEAPAHILTLNADHSILEGGVKTLADNKTFLNLNNNSTWLLTAPRKRESNNDPSHGHDIDEKLHSNLSGISLTESSIVFGTSTDGHYQTLFVGSQSQEADQTPNNPIVYKATGAAEIHLNSEWSNNSPMHKQKTDRVIINGDVSGSTIVHINFLESGNKGTKSTAVWKEEMVSTSSTAHGISLIQVSGNADKNSFKLEKGYLTMGGTPYKYVLTAYAPGTSDASQNLFGKNDQNFWDFRLQSAYVDSDKKVRALLPQVANYLVIPNAVFSAGFSEVNNQNMLLNNMRTTMFGAENHNKNGIFLSYYNEKVTLSSNRDPLHYGYGADINYDAVQLGIIMNALEGKNINTQFGLLGTYGKLSFTPKDMQDSEKTKLDKWSLTAYSGIQHSMGLYMNALLSYGVLKGNVTTALIGTAAKLDGTKTLTLSATLGQKLTTGLQGLMFEPQAQFIYQNLMLDVLSDADGLKVDMDNPHQWLVRIGGRLTKNLTTTEEDNDHAVSFYGKLNVLRTFGDGGAIQIGESFYLDPTGSSIEGGVGVNAHIAQKVVLHGDISYRHKLQKAGVSGTNFSGGIRYHF

SEQ ID NO: 11184 - protein, 587 aa, Prosthecochloris aestuarii
MKKVCLLAGSLSLLGLSALPAKAVSTSEQLPVEAQSVDVSPVTAEQDELLLADQSLSQTTSVNDLMAETKEDSVGQVTSVSQLSDVQPDDWAFQAIQSLVERYGCVAGYPNGTFRPSRAMSRREAAALVNACLDNLSNRFATKEDLDALKALQDEFAAELATLRGRVDGLEARVATVEAQQFSTTTKLQGEVVMAAQFGDFVNNPTDTVVDPANGVLNAGGPDSRVSAISRVRLNFNTSFSGDDLLATQLEVGNNGQDFFGNALGAQDHGPGLGTLTGSGVPLVDLGAADYAGVGNTVTLRRLAYTFKPGENLAVTVGTNIFPSDFVDFNSYANNSAQDFSSGFFINNPLIITNAVDLNGGAGAAFDWNPNAGNISVRGVYVAAAGNVATAAANGGLGGDPHQGTLELEYANSFGEDDQNNFAIRLQGTYAETFSIEQKVLGVNAEATFGNIGVFGRYGISFDPQNQVGVNNVDVFGAAAPASIITAGGSNTIQTWMAGVGYKDALVPGSLFAVAAGMPYLVTGTPGSNDQINLEAFYRFPVNDNITITPAVMYIINPLGTVNGLSAAGAGNDNDIIQGLIRATFSF

SEQ ID NO: 11185 - protein, 200 aa, Prosthecochloris aestuarii
MKKALSFTMCILASTYASTALAEERNGWYIGALYNSQTISIYQSREFKSAGAIAGYKINDIFSIETRLHKGTSGYSFNLLEPGFEDKKYKQDLDYQGHILAKASYSITEAFNVYALAGYTKTKTEITTLEFHTDLSGNTSVTYPHQYSENTDGFSYGVGLNYQIYNQFSVFVDYQVLPDFDKYQKSGSWDSLNLGVNYSF

SEQ ID NO: 11186 - protein, 227 aa, Prosthecochloris aestuarii
MKKALSLLAAAVLIMGWSIPSYAGNPYASGNIGIVWFDNLNGVESDYENRDYSIDASLDSGISLTGAVGCDMGDTRVEAEIGYQTNDAVSAEVLDDNGILEDGPWEWGGDVSLTTFMFNGYYDIALMESGLEFFLTAGVGGAFYSFDDVGDINDDRYRGTTNGSTWAYQLGAGLALPVGDNLIVDARYRYFDTAEFTTEDDFDAFDDVAMNLDISSHSALVGLRYNF

SEQ ID NO: 11187 - protein, 829 aa, Prosthecochloris aestuarii
METRLGFVAAAMVLCLPVPAKAAEERAFDVRGGSLSAVVPVISRQGGVSISVADARLWKARVRSVRGRMPVDEAIRRLLAGTDAHAVRVSATSWRIERRPAPQRSRAAPAPRQVPQPRAREPANEVVAAAADTIIVTASKTDLPYSHFAGVVTQLDGGELAFGGERGMDSILSRTATVSSTHLGSGRNKLFIRGIADSSFTGPTQATVGQYLGDIRLSYNAPDPDLRLYDIDNVEILEGPQGTLYGAGSLGGIIRVIPKAPDPRGPTVQAIAGASLTRHGDPGGDIAGIANLPVGEDGHALRLVGYMITDGGYIDNPLRGQNDVNRVHIRGGRGTLRLDAGDGWTVDIGGIYQSNTSDDAQYADKDAPPLTRRSMIEQPAKARYGLGTLVVMKDWGDLRFQSSNAFIDHRLFERFDASLPVAGELDGSGSGNAVGTVDVERLFAPIDITPSRDVPRRLEQHNATRMFASENRLWRPYHDGFGWVAGASFITNRARQEREYAYGPLHTPLPGVTNRITEWTGYAEATKELLTGLVASGGLRLSHVRLGGMAEDVPFALAQAGRATTASRHETDLLPSASLLAMPLDNLRLYARYQEGFRPGGLAVDGNFVRRFRNDRVQTWEAGVRFGDRKQTLLDATLSLSHSRWRNIQADFIDSNGFPTTANIGDGRITSLSGALAMRPTDALTLELGAVYNHSRVDDLSPEILPVFAATPARLGRIPNVASHAVRGSVNYATMIGDEDFRINGWANYIGPSRLGIGPVLGESQGDYIDTGLAMRVGNDRRGLSLTLTNLFDSRGNRFSLGTPFVEGNAGFLTPLRPRTLRIAVDVAY

SEQ ID NO: 11188 - protein, 1022 aa, Prosthecochloris aestuarii
MKKRLLMLFLGMATLVGQALAQEITVAGKVTAVEDGLGLPGVSVKVKGSPTVTQTNAAGQYTIKVNPGAVLVFSFIGFLPQEKAVGTATTLNVALRTDAKGLDEVVVTAFNIAQDRKAINYAFQNVKSKDIEESRQQNIVNALQGKVAGAVITSSGGGPGEGAAIILRGGTSLDGDNQPLFVVDGVALDNSSFMESLAPGAGSAFNGITGRSVGTANRASDINPEDIESVTVLKGPAAAALYGVKAGNGAIIITTKKGKAGATSVVYNNLFSWDNVMRLPETQSMYKQGTNGVFAATSRDSYGSLFQPGEPIYDNLGTFFRTGRSQTHNLSVSGGSDKYTFRLSASHSDQNGVVPKTEYGKTSVRLAGSAVASEKFTITGSANYMRTTGRRPLQGPGLYSGSGGFLVSIFNWPKNDNMSDYLSPDGTRRRLIASATADIDNPYFTIDRNPQTDSNDRFIGNAGAEYKPLKWLKVNYTVGTDFYTERNQSVRAVGTSLPNNLNGGIGQTVNSFQNLTSNLLITADQTFGDFSTSLVLGNAVDQVKFSTIDVLGLIFQNPDFISINNTVNRSMVQRNSTKRIVGVFGSFNADWKKTLFLNITGRNDWSSTLPVKNQSFFYPSVSLGYEFTKSLNMENLPWLSYGKLRVSYADVGKDTAPYRIFSPLQSNTFIGGGFRYGFFGNNPNLKPESRTSYEIGLDVQFLKNRLRLDATVYRDRTVDQIIAPRISQATGYILQYINGGSVENKGIELMLSGTPIQKKDFSWDVNFNFASNKNKVLALPYPLTIIRNSDAAIINVAEGASYPGRSLTSISATDYIRDEQGRIVIDANGYPTFNSLFSYAGDRAPKFTLGLNNSFRYKNAELSFLIDIRKGGDVINGNEWELVKSGLSKQTEERGKLVVFDGVVKNADGTYSQNTKQVELTQGYYENNLALVGTPFIEDGSWIRLRTVTLNYTLSKKYTPKVFSNLNLFVTGRNLVLLTNYSGIDPEVGVAGAGVRGGGSAGLDYGGVPSRRGFDLGLKVGF

SEQ ID NO: 11189 - protein, 386 aa, Prosthecochloris aestuarii
MRKKLTALVLSALRLAAVADVSLYGEIKAGVEGRNFQLQLTEPPSKSQPQVKVTKAKSRIRTKISDFGSFIGFKGSEDLGEGLKAVWQLEQDVSVAGGGATQWGNRESFVGLAGEFGTLRRSLGNQFDDASQAIDPWDSNNDVASQLGIFKRHDDMPVSVRYDSPDFSGFSGSVQFVPIQNSKSAYTPAHYTRQNNADVFVPAVVGKPGSDVYYAGLNYKNGGFAGSYAFKYARHANVGRNAFELFLLGSTSDEAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 11190 - protein, 270 aa, Prosthecochloris aestuarii
MKSLFKVTLLATTMAVALHAPITFAAEAAKPATAADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 11191 - protein, 846 aa, Prosthecochloris aestuarii
MILKDYNILRVKSKSISLIKSILNHTKDLEVNELKNFKSFSLTILFSVLLSTVSFSQYTFSGQVNSEDRNLPIAEAEVYITTLGISTTTDNEGNFSFQNLDEGTYSITIFTYEYDLYEETIQLTDNLQKTYTLKQLGDQLTEVIITQRKERIFALRQLKPVEGTAIYAGKKSEVVIVDNISMNTATNNARQLYSQIVGLNIYENNDAGLQLNIGGRGLNPNRTANFNTRQNGYDISADVLGYPESYYTPPAEALETIEVVRGAASLQYGTQFGGLINFKLKKPSKKPFQFITRNTLGSYNLFTTFNSVSGTVKDFEYYSYINYKKGDDFRPNSNFESYNGHAHLGYQLSEKTKLTFEGSYLYYLAQQPGGLTDEQFEEDPTFSNRTRNFFEVDWKLYNLRLDHKFSEKTDFSLSLFHLDAHRKSVGFRENRVSQEDDLDAPRELIEGNFRNWGAEARVLTNYELFGDDNVLLLGGKYYQSNNNERQGPGTNGTDANFEFATEDYPNYARQSDFEFPNLNLAFFGENIFNVTDKFSVTPGFRFEYIKTESQGEFKRINFDIAGNPILNEDVPDNRDFERNFVLLGIGFSYKPYTSIELYGNVSQNYRSVTFNDIRITNPSLTVDPNISDEEGYTIDFGARGRLGKYINYDVGGFFLSYQDRLGVILREVSDIEEERFRGNIGDAITYGFEGFADWNIWDTFSENKDFRLSAFTNLSLTDSEYTSSQENNVEGNNVEFIPDVNLKTGLRFGYKNFLGSLQYTYLSEQFTDATNSPRDLESQSGIVGEIPAYDILDLSVSYTYKRFKFETGINNLLDNSYFVRRATGYPGPGIIPSQPLTYYGTLQIKL

SEQ ID NO: 11192 - protein, 388 aa, Prosthecochloris aestuarii
MLAVFHQRVKQHWGKINNKGFKMMNNTLKAILLTSMLPFAANAAQELTPWYVGGGLGVNNYEPNCDMKTMKSCGKDDPYAWDVFAGYLFNDYFAVELGYRDLGRAEWVDYANKMNDVGAKGLSLGVVGFWPIANRWSLSAEAGAMNYTLSNNKEYGSEYYSDSGIAPYIGTGIGYNITENLKLQAKYRRYENLDEDKWNTLAMESNYWGLELSYRFGTPAAVVAPIVAAVVVDSDNDGVTDDMDQCPDTAANHKVDAKGCTIYTETTEQRDLGSIQFANNSSVVKTESFAHIEKLATYMNKKPESTVLISGHASDVGKADYNMALSDKRAKAVAKILVEKYGISQDRVEAKGFGITQAVIQGNSAEANKANRRIEAHVTGVKREALIK

SEQ ID NO: 11193 - protein, 1045 aa, Prosthecochloris aestuarii
MSRKLAKLTSRAMFTFVGGVLVINPAFAQDAATPAPAAQQQSQSQATPTQLDTVQVTGIRNSLSQAMDIKRDSAGVVDAISAEDIGKFPDTNLAESLQRITGISIERRDGEGAQVTARGFGPQFNMVTLNGRQMPGADAFGAAGQVAIGGVDGGTRAFNFAQLAAEAVNGIEVFKTSQANVPSGGIGATINILTGRPFDHEGTVASAGAKIVSDQSQPFDNDITPELSGIFSYTNPDKTWGVGVSASYQKRKGGSVQATNNYWNIQPWTGTMPGNPTVTNAPAIGALYGRPNDLRYAFADFERERINGQAVLQFAPTDAVTLTLDYTYSTNEIEENRGEQGMWLQNSNYTDVVFDTSGAVATPIYIREIAGTKDFGLEQQRSMQKYKLGSLGFNATWNITDRFKLSFDGHDSKNESRPNDPLTGGGSIFSSIAGTNNCTTGPQCGGTYVQEMVWNNGLPVGTQVWYPTAADAIAKTNGVVNGGFVPGEIGSQVLRINSQTQISEIKQGRVDGEWAFDAGRFQFGVDTSKQTTHRIQAAENYNTLGDWGVANVNGDVANGLMDLLQPVNIVGMFDDFNINSFSAWRGDAGRLAQWAGQYYGANLGVSPQNAADNRVEEKTNSAYMQIELDGDLGGHRTNTRLGVRYETTDVVSTSIIAIPEGIQWQANNDFRVLLSDEQQPFTEKTSYSYILPNLDFSIDLLDDLKGRISFGKSIARAPIGNLYAGPTAQQPFGSVLIDPSSRASGTAQNPALKPLESDNLDLALEWYFADASYVSVTYWNKQVANFIGNTIVQENLYGLRDPTSGPDAQAALGFLTSGACIAQVGPANAAACSANDTSLFTALALLRNNPAGLGAYDGTGAQVLATEAAYDLYGTAADPLYQFNVNRPINQNESKLHGWELGGQYFFGDTGFGVLANYTIVNGDVGYNDAGDPNVDQFSLTGLSDTANAMLMYEKYGWSVRLAWNWRDQYLILANQGSSRNPYYVEEYDQWDLSVGYTLNDNWSFSLEAINLTGEDVRWRSRTSQMMVKLADQDPRYMLGVRYRF

SEQ ID NO: 11194 - protein, 669 aa, Prosthecochloris aestuarii
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 11195 - protein, 246 aa, Prosthecochloris aestuarii
MRNYRKNVRPAVMAGLICSAALAGNANAQSAGSFTLATGWLYVAPQGHATPLTVESVGGMPVNQQLTGTGAHASSTNTLGITTEYYVTDNIGIATLFGLPLTVNLDGDGTLSKYGTLGTTRPMPPAIEVRYHLFDAQTKFRPYVGLGVNYTWFTQVRATNHQFITDSVGPGGSIHATLSASWNPVFEVGASYMFAKHWSVGASVGYMPLKTHMTIYGQTATGTQIVSKSTLRIEPINVFVNVAYTF

SEQ ID NO: 11196 - protein, 744 aa, Prosthecochloris aestuarii
MSVLKLSALCSALISAGVYAAEKPIQKDEQSIETLVITANPIGRSVLESATPVTILGGEALDNSQAATLGETLKGLPGVNSTYFGPVASSPIIRGLDGPRVKVLQNGLDASDASRVGPDHVTTVEAATATQIEVLRGPATLLYGSGAIGGVVNVVDNRLPRERQEDINGEVATSYDTVSNEKMLSGDINGGVGNFAFHADGFTRDSDDYDIPNEASDADSDSIGKLENSAIDATGGTLGIGWIGDDVNVAFSYARLDNEYGIPGHEHAHEEDEHDEEDHDEDDHDDEHEEEHEEESVFARLKQNRYQSRVDWQNIDGPFTQVHWLNAYTDYEHSEIEDGAVGTTFSNEAKESRLWAKHAPLSGWEGVVGIHYTSSDFSALGDEAFTPSTKTTSTALFILEEKQTGAFLWQLGARFEHTKHQPDNTFFAEEEHHEEEEEHEEEHGEINFSDGSFNANSFSAGVVYTLNDRSSLAFNYARSERAPSASEIFSNGLHISTGTFEVGAGFDIELDEDGYELVQSTRSVENEVSNNVDLSYRYHGDTITADVSFFYNDIANYLYEQDTGLDSEQLHGHDEEEELEDEHDHEEEVTPVFIFRQQDAVLYGFEAQLDWHLNDNLRIESFADYTRAKLDEAASEEGNRNVPRIPAMRLGMEFHWETDDWHAELGATHYAKQSHFASYETQTEGYTLVSASMNYYTSVADSDVTLFVKGNNLTDRVARVHSSFLKDVAPLPGRSFVLGARVNF

SEQ ID NO: 11197 - protein, 1012 aa, Prosthecochloris aestuarii
MQQKQNCGHPLRRKGSISRVSKVTCGLLFCLTTGVFAAGENVELLTSDRIENAVPDQVGKTVTIMVQDEMGPVAGANVVVKGTTNGNISDMDGKVVLQNVPNNSTLVISFIGYTTQEVKVSNQATIHVKLVEDAKALEEVVVIGYGSLDKKQVTSAITSLKADDLMVGVSGADISASLQGKIGGLVMNNLGSANSGTTFQLRGMTSINSGKAPLIVIDGFPGGDIRSLTQDDIKSIDVLKDASAGAIYGTRAAAGVILITTKSGSDTNGKVRLTYSNEFTKKQNYNAPEMLSGREYAEHNIGTDYGSDTNWWDELINKGNFSQKHHLALEMGTEKAQVYTSFFYEKNQGIALQDERQDYGGRVNASFKLFDDWLEVRPAVDYRQAARNNHYPNFQQAMRNNPTRSPYDPDSETGYNVWINESLDYNVVADAMLEDYYGLDKWFKPEVNLKLNIKPIPGLNYQQVVGYENRQWELHQYWPSTHRSEIDNSRKGHAHLAFSKTENLTSEGYFSYVKDFKGGHNLNATAGYSYFEVNGENFGMDNYNFSVDGIKYWDIGQGSYLTDGKAGMSSGKSVTERLFSFFARANYSYQDKYMLSASIRHEGSSKFAADNRWANFWSATAGWRISNEEFMKDFDWLDDLKIRFGYGVTGNNDFSATYMANMLGSDTNWMMPNGTWAYSYGKSQNVNPNLGWEEKKEWNLGVDYSFFEGRLYGKFDYYRREVDNLLFSVKVPQPPYTQGSQMQNIGSMESKGWEFEVGGDIIRTKDFTWSSSMNLSHNTGKILTLEGDNSYHNGNGFVAPGTPGDAARMEAGSTIGSFYMWKFAGFDDEGSFLLYNKDGEVIPAAQKTENDKQYIGNYTPKLIIGWSHTLTYKNFDLGINLRSWIDFDVYNTINMYYGIQGQGNLNVLKDAYGKFNHIKGEKQICDYFLEDGTFLKIDAITLGYTLPMKKYTNNLIDRIRIYGTVGNVCTITGYSGMNPEVDITGWDKGTEKFWSDFYPVVRTWTLGMQFNF

SEQ ID NO: 11198 - protein, 384 aa, Prosthecochloris aestuarii
MQKKIIALAIAGLASTAAFAQSNVTIYGVADATFDSVKATKGSSASEQAAFVTRQRVTANSSYIGFKGVEDLGNGLKAVFQFENGINNDNSSAGSWNNRDSYVGLSGGFGTVVAGNLTGPTRAVGAKYDVNQGATGIGANAALLGKLGTIAGDSGASAFDQRISNAVAYVSPTVAGFTGVIGYSTGLSSAAIAGTAAAVIGTNREATGAGDVQFNTARTLGLGYANGPISVDYAYTRVGLKDAQNDLQDHRLGFLFSQGWGSVGLLAERTSLQATTGNLTQNVFYVPVKVNVGKGRVIGQFGHAGNVKNTVASEGANHYVLGYEHDLSKRTTLKLVYSQINNKEGSNYDYLYGAGNANSTATNTSGVANDANVKGISLGLRHAF

SEQ ID NO: 11199 - protein, 976 aa, Prosthecochloris aestuarii
MLTVRGTSSVRLRCWLLLGSAMLGSPALAQGVSPVPDAASAPAEDIVVTGSRIARKDLTSSSPLVAIAPSALKTNASVTLDDTLTRLPQVTPSYGSGSNDTSTGGTTTVALRGLGAQRTLVLLNGRRLTAGTYTGAVDLNMIPTALIESIEVITGGASAAYGSDAIAGVINFRLKKNFEGVQLDGQTGITSRGDGFTSSLSLTAGGNFADDRGNAVLSVDYAKRRGVSNRSRAFSRISRPSGALPFGVYVPSALNLPAAGAVDGVFAGYGVAPGSVGPNSNLSFNANGSLFAPTSGINYDGSGQDIVRLGNGVFYNSTGVSGLTIPLERFGLFGRAEYEVADDINVYAEGGYQHFTSSLVFGPGFNTLTVPTTNPFIPDDLRTVLASRPNPNASFSVLRRYADVGQRTADFTTNSYRLLAGVTGRIEAIDGTFDVFASRGEQTVDRRDHNGVNLTTLNALINAADGGASQCAGGYDPFALNGGAACATLLRSTTIRNTKFKQNYVEANVQGRLFSWWAGDVRFALGADRRSDSYDFQPDTGVRTGQILGIEGVGVPAVNGSVTVKEVFGELLVPILRDLPLVKAFDVTLGYRYSDYDLSGGVDAYRIEGDWRVIDALRIRGGFSRAVRAPNVSELFTPQSPLTPIIGAPGAPGQGDPCDVRSAYRTGANAAQVRALCLAQGVPGQIIDSYTFNNTQLVDGGITGGNPKLKPESANTYTIGAVLTPRLPSSILSNLSLSVDYYSIDLKKAIGAIPGAAIVQQCYNLGGANAGYATDNVYCSAIGRSDQTGQINRLESFNVNLGRIKTSGIDVSLGGTIRLGDDAGAIDLSGTVNWTEKYAVTNFPGARPMDLAGSIGSSAGSNAGTPAAFPEWRAQANLTYRNGPFQVGVQYRYIDKMIDVSAIGIPNSTAIGTPAYHYVDLNTQLKIDERLTFRLGVTNLTDKQPPVYTSFYQSNTYPGVYDVLGRSFYAGATVKF

SEQ ID NO: 11200 - protein, 384 aa, Prosthecochloris aestuarii
MKMRKTAVCFALSLAYIAPTFAQSTVTLYGLIDEGLDYTNNVGGHHVYEMQSGYAQGSRWGLKGAEDLGGGMKAVFQLENGFNVNNGKLGQGGLEFGRQAYVGLASNTYGTLTFGRQYDSVVDYLGQTTANGNWAGYLFAHPYDNDNTDNSFRVNNTVKYASPDFSGFQFGGTYSFSNDTNFANNRQYSVGAQYATGGLLVAAAYLQADNPSATAGGAITNGGDENFRAKRLRVFGAGINYTFGPATAGFVYTNTSLTQPESTTYISGSILPATGTLNALKFQNFEVNFKYQFTPAFFAGAQYVFTAEHFEASSGNVSPKIHSVGLMADYSLSKRTDVYLQGAYQHVAGGKTGTALDDAYIPGADDASSTSNQLLVRAAIRHRF

SEQ ID NO: 11201 - protein, 378 aa, Pelodictyon phaeoclathratiforme
MKKTLAALIVVAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNFAKGEVKLGRAKTIADGIISAEDKEYGVLNNSKYIPTNGNTVGYTFKGIDGLVLGANYLLAQQRHKYTAAAAAAAAAGGARAVAGEVYPQKISNGVQVGAKYDANNIIAGIAYGRTNYREDITITPADKLGKKQQVNGALSTLGYRFSDLGLLVSLDSGYAKTKNYKAKHEKSYFVSPGFQYELMEDTNVYGNFKYERNSVDQGEKEREQAVLFGIDHKLHKQVLTYIEGAYSRTRTTTVGSKTNASKVKTEKEKSVGVGLRVYF

SEQ ID NO: 11202 - protein, 839 aa, Pelodictyon phaeoclathratiforme
MSATFRTLPLIAAVSLATQSLTVGAQQLEEVIVTAQKRAESLQDVPISVSAVQGEKIQDAGIPNMAALADYVPNLHIADAPVNTNIYMRGVGSGNNQGFEQSVGMYIDGVYMGRGRQYRAGFLDVERVEVLRGPQGTLFGRNTVAGAINITTASARAGDEFEGQIMASAESFDGRIVEGFVGGGLTDTLGARLAVKYRETDGFADNTFLGTPEGGVEELSYRLSLNWQPTDNLNVNFKYTQSDYERTGSTTTGKVFLTRDERNEFVPNRSAFADTAYSIMDVFYPGYKEQTGREFEVFKDNGFGRSQEDGIGIGINPDSSDNDLTNMVLNVDWQVGELTLTSVTGWSEYQYIDGADVDWLPLQFISRDDDQSFEQVSQEFRIASPGGEFFDYVAGFYYDQSDLEFDRQVAIDTNFDGLFPEFLSIVTPGNPPPEVLPQNLLFALTQGAYDMNQVARNHNYQLDSDSLAVFAQGTFNFTDTLRLTVGVRYTEENKDVISTQFLSDQNSGLLNPGDSYFLHLIQANSFNAYAYDFREERSTDALTPSFNLQWDVGDDSMLYASFSQGFKSGGFTAADDQNPGDLAPTAFPCAPNPDFTVDLDACYDLSNPNGDFEFGDEEVDAFELGGKHTLLDGGMTLNWALFYTEYTDLQTAIFEGLGFVVKNAAGSEIYGLEVDALWQATDNLRLGANFAYLDASYSDFDDGPCTAIQLDANPNCSIEQGNPLSGEPTLYASDYSASFFFDYIRPVGQMEFFAGGEVNYRDSFQSAGDNDPIDQIDAFTKTNLRLGLRSGDWEIMAYGRNIFDEEVFMQSYDTPVLAGSHSRYMDESAVFGARLKYTF

SEQ ID NO: 11203 - protein, 204 aa, Pelodictyon phaeoclathratiforme
MKKIALLLVLFSAFSNANDNISGFYLGAGLGATTFDDGGAFDYTGASINADDSTLKFMGGYQFNRIVAVELQYTKYGDINVNHPTAKAVGFKGIDIESTSISLAANLGYTFDSGWRPFGIVGLGSLESSTNVLGHSLSENNTSFHYGVGVEYAPKALSGLAFRVAYEGDMFIEENVYQDYGHYSYSDDYAMNIGTFYAGATYKF

SEQ ID NO: 11204 - protein, 1114 aa, Pelodictyon phaeoclathratiforme
MKKHLAFALAVSLVAMVPVSAFAQVLKISMTKTNVSIENVLRELEKQSDYTFFYNDNQVKLNKKVSINVSDAPIETVLNEVFKNSGYTYKIVDNQIVVSTAAAAAKEVQATQQQKQRKISGVVKDAMGEAIIGASVIEKGNPTNGTITNIDGEFTLNTAGKELQVTYIGYIPQAIVLKPGVNSYTVTMKEDTKTLDEVVVVGYGTQKKVNLTGAVSSVGADELKERVNTNVLASVQGQVPGVTIISRPGSTPSINMRGRGNLGTSSPLFVIDGAIADASFFSSLDPNSIESISFLKDAASSAIYGSRAAYGVVLVKTKGGKEGDLKISYDGSVAVKMATYTPDVLGSEWYARLSNEAALNENPNTSTLPYTDKEIQMFRDGSNPDMYPNTNWYDLVLKDEAVMTKHSVSFSGGNKVKYFTSLGYMYDDDFTPGVKSERYNLTTNISSDIKSWLTMRSNINYIQSTSDNDKGGVVYTHLLTIPSTYVARQSNGEWGSYEGGKPAATVNMERNPLRRLEEGGWSNSKTQNTLINLALDIKPVKGLVLTGEMIYKAWDYKSKTYTANKSKIKDFQTGAELNGTDVTNSKMEYSWEENSRLTYNALANYVWSNEKHNVNVLAGVSYEHYKYQKQKSYRLKFPTNGMTDMNGGSSAPDDTYAEGGSNEDKLMSYFGRVNYSFMDRYLLEANIRADASSRFHKDNRWGVFPSFSAGWRISQEEFMQDINWINNLKLRASWGQLGNINNVGQYDYFSSYQQGGNYNFEDAIVSGIVESKPANPTLGWETVTITDIGVDFDIFNGLLNFTADYYNKKTDDILLAYPSPKEIGIGSDFKVSQNIGTVSNKGLELSITHNKTLGDFAYTVGFNMSKNWNKVTNLGANDPIIESPWIKKVGYAIGTFYGYRSDGLLTQEDIDTGNYITDGLVPQAGDIKYVDLDGDGKLTDKDRTYIGCDVPDITYGVNLNLRYKGFELSMFGQGVTGTKVNFSMENAWAFSDYASPRKYHLKRWTVDNPNPNAAYPRIYPRTSKHSTYNQYFSDYWLFNADYFRIKNITFGYSFQKPVLQKLSLEALKLYVAAENPFTIRADHRMEDFDPETASGRGVNTRGTSSIAFGVNLTF

SEQ ID NO: 11205 - protein, 194 aa, Pelodictyon phaeoclathratiforme
MTRIVSMAAIAAALSTPAFAGNLEEPVVAPAPTAPPVVVANDGGDWTGAYIGGQIGQLDADTSNGLSGDDVSYGVHAGYNYDFGRFVLGGEIDYDATDVDLGGGAATVDSVMRGKVKAGYDFGPVLAYVTGGVAQVDTSVGDETGEFYGIGVAYRVTDQWTVGGEVLEHDFDNLGSSGISADATTVSLRASYQF

SEQ ID NO: 11206 - protein, 729 aa, Pelodictyon phaeoclathratiforme
MSHRKTLSLSLLSTALLTALSPQIMAQESDSQATMEQISIFGKQNPLNTVPGSAYKINQAELDTFKYTDIMRTLASIPGVYIQEEDGYGLRPNIGMRGTGQNRSEKISIMEDGVLAAPAPYASPAAYYFPTPGRMQSIEILKGSSTVKYGPRTTGGVINMLSRQIPEEELAGKLDVAAGQDGFGKLHAYAGGQGERVGAVVDFYRYQADGFKHINGVGGDTGFEKNDALAKVSIRSADDAKYAQVLEFKLKYSDEVSNETYMGLTDSDFETTPYARYSASQKDVMNTEHKQLQINHIIDFSNNLTLGTTAYYNDFARNWYKADQVDGLKLNKGGIEAASAFDKNPSTAPMDVRVKANNRSYISQGIQTELNWYLDSHDLAFGARYHEDEMDRFQWADHYNLDSNQVMTLTESGIPGSDSNRVDSAKALALYVQDKIQLGDFNITAGVRYEDVKTNRTDWGKENPGRDGQPSKDIDNSFSATLPSLSATYQINSEFLVLAGVQKGFAPASPGNSDKKEEQSWNYEAGARYNAGELSSEAIFFYSDYSNMHGECTASIGCDDDNIGNQYNGGEVDVKGLEFSLDYSFNTQNDISFPVKLAYTYTDAEFANSFKSDFDPWGDVTKGDKLPYIAENMLFASAGVKVDSWELTVAARYSDDIRTKAGQGEIAQEDLIKAKTIVDLSARYFISESQELYLTAENLFDEKYVTSKVHGSNFVGKPLTVSVGYTYTF

SEQ ID NO: 11207 - protein, 322 aa, Pelodictyon phaeoclathratiforme
MKKAALTTAVLTALVSSPSFAATVYKDDGTELKVGGRVEFRGDFIGSDGAEVDGTMEDKSRARLNLKGKTDIGNGLSAFGVYEAEQKTGKSEFKNRYMYAGVSADAGDFSVGRQDMAAVIISDMTDITEFSGVQQVIDSSSDKQDSVFAYRGEFDALQVQATYQANSGDSQDKYGISGLYSLPMGLDLGLAYSGGDVDKDNSEDQILGGIAYSLENLYLAGTYSQGSLDDSEDFTAYELVASYKLASKFTVAGLYTFQENDPNGAAKYDAVDGFELVGYYKLNSNFRTYLSYYMNQLDEEKNAEGKVTEGEDTLRLGVRYDF

SEQ ID NO: 11208 - protein, 1080 aa, Pelodictyon phaeoclathratiforme
MKTKFSGILTLLLAFVVQVSFAQTTVSGTVTEDNGPLPGANVIIKGTSTGTQTDFDGNYSIQASPSDVLVFSFVGFATQEVTVGNQSTINVALAADNALDEVVVTAQGVKREKKALGYAVSEVASEEIEGRTEGDVARVLSGKASGVQITSQSGASGSATNVIIRGYTSINGSNQALFVVDGVPFSSDTNTTGNFLNGNNGSSRFLDLDPNNIESVNVLKGLAAATLYGTAGRNGVIVITTKSGTTGNGGPKKSEITINQSYFVNEIASLPDYQDSYGGGFDQSFGWFFSNWGPSFNAGGVDGYLNDPAQLIDENGTVAHPYDTQAAFNGSRGDEFAGQRYEYRPYNNVSQFFRTGGVSNTSININGASEDGKVNFNVNYGHLEDKGFIPGNQLRRNNLSVGGRAQLSNKFTIAGTMNFSRTDVSSPPVAASRGNGTLGFSVFANVFFTPRNVDLAGLPFDIPETGGSLYYRNGNDINNPNWIVRNAGSKELTNRVYGTSTLSYAINDNLNLQYRAGVDFYNSRFEFGVNKGGVLGSGGVDDINGEYNTRDTNVRIWDHYVALSGDYDLSDKIGMTFVTGATSRSREIDVQGVNSTGQLVFGVQRHFNFLEQTPVQFTSFRNIVGVLGQADIDYDNMLFLTLAARNDWVSNLPKENNSKFYPSVSLSFLPTTAFDGLKGDALNYLKVRAGLGTSAGFPTGFPTVNTVSQFTNQFIDPFSINNVTTNSVSNFQANPDLKPELVSEFEVGFDARFLKNRVSLDLSYFNRSTDDLIVTKPLPPSTGFTSTQANVGKVEGDGFEIDLGVDVFESESDGFTWNSRINFTTSEQIVTEQEDDQIIYAGRPEPFLGGNAAIRGEQLGVIVGTRIQRDDNGNFVVNGAGNYVVEDNVTLADGRNITPIIGNPNPDYVMNWINSFSYKNFNLGFQMNHTKGGDIASSTIAVLLGRGLITETEDRENTYILPGVTADGSPNQTQINNSQYYFSNVLFGPKELQIYDASVLRLQEVSLGYSVPKKLLEKTPFGSFSVTASGFNLWYDAYNTPDGANFDPNVAGVGVGNGRGFDYINGPSSKRYGVSVKASF

SEQ ID NO: 11209 - protein, 985 aa, Pelodictyon phaeoclathratiforme
MTKSRFFCSVSAMAAVAALGAGGQALAQQSPTQVGEVVVTGSFIRGTPEDAALPVDVISQDDIERQGAPSTLELIKQLSVSSGVLGDTNQFDTRAQGSEGSGSINLRGLGAQRTLVLLNGRRMSPNPFGQAGAGIVDTNTLPTVAIGRVEVLKEGAAATYGSDAIGGVVNFITRTNFDGLEVSGSYRHIDGSKGDYTGGLLWGHTFDNGNILLSAGWQHRSELKVTDRDWAVRPFAENPEGGWSGGSSVTGFLPVAQTPTGAWVPAGAGVLDAGCAPLGGIPVAGALPQCRFHYIEYDNITEAEDRIQLYGEFNADLAEGHRLHVEALYAKTEVPNWKTSPSYLTLQTPTATTNPTVGSLTPAVLRGWFVPANNPGFVAYRAANPGAIPAAATGAHFPGVFYRPLSFGGNPIFDGNEGASEGMRQYEAARVSGSLRGDLPWMGIGYDVAVTYGQETGWRTGYDTVVSRLQLALRGYGSAATGAGGGCTAAETNNFTTNAGNEAIGCYWFNPFSNAFASNAVSGASNPQFSAAAANNPDVIRWFFDQVSTKQTQRIFVTDAVLNGTTGFELPGGEVRWAAGFQFRRDGFESEYNDLSDIDANPCIDTPVTGTGSCAVRNGPLVFLGTGEEADLSRDVWAAFAELSVPVSDAIQVQLAIRYEDYEAVGTTTNPKANVRWQVADWLALRGSVGTTFRGPPLTQLNNSSVTALSFIAGSFRAIDLFGNPDLEPETADNFSLGAIFDVGRFKATVDWWRFDFDNPIVGEPSGSIVNTMFPGGATTRCGTAEYAGLQSRFDFQGACSTATIARVRTQWVNGPKIKTSGIDVLADYDFGEVFGGNLRAGLSATYTLEYKIDDFEVEGVTVEQAYDAAGFLNYQLIATSLPELKGSGYVEYSTGPHNLRFTVNYIDSYVDQRAAITGPGKTIDETWLAEIDYRVLLPWDTTVTLSVDNVFDEDPSFARLDLSYDPFTGSPLGRTFKVGVRKRF

SEQ ID NO: 11210 - protein, 646 aa, Pelodictyon phaeoclathratiforme
MNKKVFLVVMAALLSSKGLLAEEQPKHFTGEETVVTATKTINSISNAGGASVTVITSAEIRASGKHTVEDLLKGVAGIDVSANGGPGSMTSLFIRGGDAKNTLVLIDGVPVNDPATTNRTASLSNLTLDNVEKIEVVRGSLSVLYGSNATAGVINILTKKGDGPMKSYAGIEGGAYGTYKINGGVSGKTGKSAYSLSLARLKSDGFSFADDRNPRIPHSGNTSEKDGYENTTLSGSYSYELTPSSVLETTFRFTDASVRYDESANGYTGDRFTYVWPSYVANPAGMKEQHNDSRQYVGRVAYKNCGKVIGNTLFVQFTNEERTDFDNDGVKTNTFTGKMQEIGWQGDIQVTDANMVTIGLSGKNESMNYHDFVWGAPLIDKSVLSGNIWLQDQWSVDNLKVVAGVRYEDNEIFGSKVTARVAPSYRIGETVLKASYGTGFLAPSLYQLYSDYGSETLKPETSTGIDAGVEHRFRDNLRAGITWFRSVYDDRIDFDMVTWKYAQVAGTSKSRGIESFIEWQPQRDLQLAMNYTHNKTEDPLGVQLVRRPENKVGISGRYRIGKSAAVGAGMQWVDERKEVASAKDSSGTPVGKLPDYFLLNLNGSYNLSEKVELYGRIDNVFNTWYEEAWGYATAGRSAYAGVKIAF

SEQ ID NO: 11211 - protein, 1007 aa, Stenotrophomonas maltophilia
MKAYSIKRAALCVALGACLGVVLPGIAMAQNVSGAVAGRATAGDQVTVVSSSTGLTRTVTVGADGSYRLGQLPVGDYQLQLSRDGQKLGDQVSVSVAVGGTTTVNLGSGGGVTNLDALQVVGTRVVNRVDVYSTETSFNINRQEISRLPVAQDLSAVALMAPGVVGGNSSFGGLSFAGSSVAENAVFINGLNVTDMYTRRGFSTAPFAFFKEFQVKTGGYSVEFGRSTGGVINAVTRSGSNEFEGGVEVTAEPSAWRASGGDHFHRDGTPHSYGSRDNNSFLKTNVWGSGPIVKDKLFLFAMYEDRSDKGHNTSSDGSTWFKNDSGNGFWGTKLDWNINDNHSLALLAFSDEGDVTNASYGYNWNADRIGSWGGDSVTETGGRNWSATYTGHFGQNFTARAMVGQNKQRAFTNSSLDQACSPVFTDSTYGPRLGKLQGLRAGCHPTGAAVAERDDTRDVARLDFEWQLGDHLLRFGVDRELMTTKQSTRYPGPTELSYTAYVARPGDEVWDGANAYVPAGVTEMLRARNRRSGGTFETEANAFYLEDIWNITPNLMLNLGVRWDRFENRTAAGKAFIKMDDLIAPRVGFSWDMRGDGSTKLFGNAGRYYLPVTNNINVNFAGGLTDEYSYYVLNGWEQKTSPTGSPYMAPIVGQQIGPTDTRMNTGGADLRQSVDRDLKAVYQDEYILGFQNMINQAWSWGVNATYRRMTRALDDIRINYTPCGPTPSTLWPIANPGESLTIWGDKSIGCANEGWITIDTANSGYRKGGSGEVIGYSKPKRTYKALEFQIDRAWDEKWMFNASYLWSKSEGNFEGPVNSDTNYGDTGMVQFWDHPATNERYGVLFNDFRHQFKLRAAYALNKQWSFGTTLQVQSGGPITAYGVMWPNDSIAGGSTSSEGSGGGTGWLCVANCSGPYNQRQFEYSPRGAFGRLPWTWTMGANVTWRLPVEGIDLSARLSVYNLFNNQKTINVHQRYEAQPGQYREATFATGTRWQAPRYTQLVVTWNF

SEQ ID NO: 11212 - protein, 426 aa, Stenotrophomonas maltophilia
MFDRYDAGEQAVLVHIYFTQDKDMEDLQEFESLVSSAGVEALQVITGSRKAPHPKYFVGEGKAVEIAEAVKATGASVVLFDHALSPAQERNLERLCECRVIDRTGLILDIFAQRARTHEGKLQVELAQLRHLATRLVRGWTHLERQKGGIGLRGPGETQLETDRRLLRNRIVQIQSRLERVEKQREQGRQSRIKADVPTVSLVGYTNAGKSTLFNRITEARVYAADQLFATLDPTLRRIDVADVGETVLADTVGFIRHLPHDLVAAFKATLQETRQATLLLHVIDAADVRVQENIEAVNTVLEEIDAHEIPTLLVMNKIDMLEDFEPRIDRDEENKPNRVWLSAQTGAGIPQLFQALTERLSGEVAQHTLRLPPQEGRLRSRFYQLQAIEKEWMEEDGSVSLQVRMPIVDWRRLCKQEPALIDYLI

SEQ ID NO: 11213 - protein, 985 aa, Stenotrophomonas maltophilia
MNVRTPAVRLGLLPAGIALALAPAFASAQEASAPTTLDRLEVTGSRIRSVDVETSQPVLTVSHEDIQRSGLVSVGDLLQNLSVAGTQTFSKAAVLASNPEQGGQYVSLYNLGEQRTLVLVNGKRWSTSLAGFTDMSTIPTSLIERIEVLKDGASAIYGSDAISGVVNIILRKNFDGAEASAYYGQNSHGDGSKTQYSLTLGASGERSSIVFGANYIKEDPVWAKDRGLTRYTYGQGHPKDGLSPAGPWGRFTDPRAAGTPGAGEYNEDGDWEATTWVVNHTGSWNTPVGVGQPSNSMDNYHPINTDDYYNASQQMMLNQGGESKSMFTSASYDINDNLRLKSTAMYSERDSKRQIAGYPLTGASQPTFPVAISKDSLYNPMGNWANPGAGVDITSWGRRIFELPRVTQNNVKSLHFDAALEGNFDFNNRPFDWDVGINYNQYDVTQTSTGNINLLALKNALGPSFINSSGVAQCGTAANPIDLGIGPGRCTPFDLLGGASAATPDALKYINTLLNSTGQSKSKQYFANITGSLFDMPGNAGEFAFAAGYEHREVSGYDHPDALSAAGYTTDLAAQPTEGKYKTNEFYLELMVPLLRDLPGAKELSLDVASRYSDYDKFGNTINSKFSVTWKPIDDLLVRATYGEGFRAPTLSDTFGGGSQTFDNFTDPCDAVFGQRSNGAVAARCAAEGLSPGFRQTDAAGRPVAARDTQGNAPFQSGVGNDSLQPETSKTRTAGLVWSPSFVSGLNVSLDWYKITVDNVITAVNANYVLNQCYQNGVDQFCGQYGRDAVTGQVNSLSRGNANLGSLETEGYNFGVRYRLPEYSFGTLSFNLDTNYLSSFRQQATKGSAWDDYAGYWNYPRVRGTLATSWTKGDLSATWTMRYYGGFRDFCYDQKAGLECNDPGYVTENGGWSGGTGANKKGAIVYHDISATWQAPWNGSVTVGARNVFGKTPPITYAVTNASAVQLDPMLDYDRFLFIQYNQRF

SEQ ID NO: 11214 - protein, 389 aa, Stenotrophomonas maltophilia
MRPIKFLFTLCLTSTASAAVAGDFNHWPLQYTFGNATEASLTGNFAYDYNNFSGDDRLKDRSFMRRKELGISIKKKDVYDAAVAFDFQSKLWLDVFFRIETKALFDQDYGRIRLGYMKTPVGMEALASSRAGSFMETALPVQSIYEGRRTGVEWVLERPQYLLQTGAYGGKDLQGDNPGTTQAIRAIWTPFKTTGDVLHLGVSYSQENPRGYHNGSNVSFSPRTRVRARPESGLTDVRLIDSGTLVDVDKIQRNGLEQLWIHGPLLVQSEALHIKVTRNNGLPTYNGNGQYIYGSWVLTGESRPYTAGTIGNVTPKHDYGAVELLARYSRLNLDNGSILGGRQHDWTIGANWYLTNYFKFQANYVKVNATRLGTRTTPDIVELRAQVHF

SEQ ID NO: 11215 - protein, 1073 aa, Stenotrophomonas maltophilia
MEFRRDNFPFLLTKNQFMKKVLFILLGCLLSFNVMAQVKAISGLVTDVTGEPVIGASVVEVGTTNGVITDLNGKFSLKVAPNSQFLVSYIGYKQQTIKVGSESTYNIVLKEDAEVLDEVVVVGYGSQKKVNVTGAVGMVSAEALEARPVANASQALQGVVPGLNLTVGNNGGALDGTLNMNIRGAGTIGDGSGSSPLVLIDGIEGDLNTVNPNDIESVSVLKDAASASIYGARASFGVILVTTKSGKSGKTNVSYSGSARFSDAIGVPDIMDSYTFAQYFNRASANKGGGDIFAPAVMERIKAYQEGTLKATTVDNGAGIWQKWANANGDTDWFEEFYDHWAPSQEHNLSINGGTDKTQYLISGSFLDQKGLMRHGKDKFQRYTLNGKITTAVTDWFKVTYSTKWTREDFERPSYLTGNFFHNLARKWPVHPAYDPNGFPMDEGEVEQMENGGKQNSQKDFYTNQLQLVFEPIKNWKINLDGSVRTTTQYQHWEVLPVYAYNVAGDPYYTVWDMGYGSYAAGSSRVNEYSWKENYYTTNIYSDYFKQFDNGHYFKVMAGFNAELYKTRNITAEKNTLITPGVPTINTATDDPQAYGGYADNSVAGFFARVNWSYKDRYMFEANGRYDGSSRFVGKERWGFFPSFSAGWNIAREPFMESFAEKINMGSLKLRASWGQLGNTNTNDAWYPFYQTMPVGSNYGWLVNGERPNYATNPGIVSSKKTWETVETWDVGLDWSFFNNRLSGSFDYFVRYTYDMIGPAPELSSLLGTSVPKINNSDMKSYGFELEVNWRDRIGEVSYGAKFVLSDDQQKILRYPNDSYDVGSYYKGEHLNDIWGLTTIGIAKSQEEMDAHLAKVDQSSVGTNWGVGDIMYADLDGDGKISNGTNKLGDTGDYRIIGNSTPRFKYGITLDAAWKGFDFSIFMQGIGKRDLWLDGCYFWGANGQGNEWQSTGFAEHWDFFRPEGDPLGANLNSYYPRVNFSGDRNTKVQTRYLQNGAYLRLKNVQLGYTLPRVWTEKAGISSVRVYVSGDNLATITSLSKIFDLEATGSLAGTGSGKLYPLQRVISVGVNVNF

SEQ ID NO: 11216 - protein, 379 aa, Stenotrophomonas maltophilia
MQTRHIMAAVVIGSIASSAHAQSGVTLYGIIDDGIAYVNNIGGAHSVQASTANLYGNRFGLKGAEDLGQGLKAVFALEGGFNGFNGRQGQGSREFGRQAYVGLADTTYGTLTLGRQYDPIVDTVSNFSAQNEWATDYAAHPGDADNLDGDYRINNSVKYVSPTYRGLQLETLYGFSNQASTGGGEGFSNNRAYGVSLSYANGSLNLAAGYLKLDNPNAANNTNGAVSGDFGGTLYVSPQSGAAATSQQVVAAGGTYAIGKATLGAVYTNVKLTYLDQTSLHLDNYEINGQYQLTPALLLGLAYTYTDGKSDMLTGAQHPRFHQAEIGANYFLSRRTAVYLVGAFQQAAGDARSAEIAELDEASSTNRQVLVVAGIKHSF

SEQ ID NO: 11217 - protein, 209 aa, Stenotrophomonas maltophilia
MKLQSLVLAAATALTMTTAFAVPAGTWTVAAGAHYVDPKSDNGTLNNGLSVDVDGDVRPTISGEYFIANNVGVELLAAIPFHHDFTLNDATGKEILTGKTQHLPPTLSLQYHFDDYNLPMNVKPFIGVGVNYTTFFKEKLNQPGADLKLDDNVGIAGHIGLDIPFAPTEAFRIDARYMDIKTDATLNGTDIGEIDISPWVYGVAFVKQF

SEQ ID NO: 11218 - protein, 873 aa, Stenotrophomonas maltophilia
MPKHSGAKTFLLGSAAMGALLLQGAFGPAYAATTSPDPSEVTQPRKPARHKPAPATHGAPAQGATQRQAADKAAASSALKTSSEDITVSGTAAPGNNVLSTSTRRHSTTQVTVISASDLKATGQTNLIQALSQMMPSVSAPPLPGVGNNAFVQTMQLRGLSADQTLILVNGHRRHLGANFNANAGPNWGTEPADISLIPVGAVDHIEVITEGATALYGQDAIAGAVNIVLKEDTQGLSADFKNSGYYAGDGQALDGSITKGFAIGRHGGYLDLSAQITHQLPTSRTGDYINPATYPNDLYYALPGGQVDPRAAALGRNIQRILGIPKQTRESISANMGIPITDSIKFYSTDTYGHRRVNAAENFRSAADDLTVNAIWPNGMQPYLDLEENDFEVDNGFKGTTAGFNWDTYVNYGRDIQRYWMQDTDNPTYGVNSPTKFDTGSAVTSQLTAGFRASHALRLGFLPKLANVEFGAEYRRDMFAMGPGVYESYGDGGVPILEGPNAGKTANPGSADHAGNPPLAVTNQNRDVYDGHVNLDFYVLPRWEWTLGGRATSYNNLATVTTGSVGTRYNFSDRFALRASINTGYRPPTLGQEYYFYSAPFATYSIDQLPSNSAPARALGAHALKGEYSRSYSVGVDATPVDNWHVTGNLYYIAINDRLASTTTLGGAGVGALLASAGLGNVTYASYYTNPVNTATYGGDIATDYSLPTRRLGTFRFAFSVSLTDNEIRSSNAVPQVLQSMNLAYFNQYARTVLLHSAPKNRENLSMNWSRGRWSAFVQESRYGSLIYAATPSLPTNLWLVQRPAFITNIEVSYRVLPQWTVAVGANNLGDKYPTRLNPKSIATSFNAYKYSFFSPYGFNGGMYYVRTGLNF

SEQ ID NO: 11219 - protein, 783 aa, Stenotrophomonas maltophilia
MTRNRFVMRRIATTLLVAGIIVSQAAYAQVTLNFVNADIDQVAKAIGAATGKTIIVDPRVKGQLNLVAERPVPEDQALKTLQSALRMQGFALVQDHGVLKVVPEADAKLQGVPTYIGNAPQARGDQVITQVFELHNESANNLLPVLRPLISPNNTVTAYPANNTIVVTDYADNVRRIAQIISGVDSAAGAQVQVVPLRNANAIDLAAQLQKMLDPGAIGNSDATLKVSVTADPRTNALLLRASNASRLAAAKRLVQQLDAPSAVPGNMHVVPLRNADAVKLAKTLRGMLGKGGNDSGSSASSNDANSFNQNGGSSASGNFSTGTSGTPPLPSGGLGGSSSSSYGGSGGSSGGGLGTGGLLGGDKDKSGDDNQPGGMIQADSATNSLIITASDPVYRNLRSVIDQLDARRAQVYIEALIVELNSTTQGNLGIQWQVASGQFLGGTNLAPTAGNGLGNSIINLTAGGLTNAAGGITGGGLASNLGQLSQGLNIGWLHNMFGVQGLGALLQYFAGVSDANVLSTPNLITLDNEEAKIVVGQNVPIATGSYSNLTSGTTSNAFNTYDRRDVGLTLHVKPQITDGGILKLQLYTEDSAVVNGTTNSQTGPTFTKRSIQSTILADNGEIIVLGGLMQDNYQVSNSKVPLLGDIPWIGQLFRSESKVRAKTNLMVFLRPVIISDRSTAQEVTSNRYDYIQGVTGAYKSDNNVIRDKDDPVVPPMPLGPSQGGTAAGNLFDLDKMRRQQLQRQVVPVPAQPLPEATPAQPQGVPLQAVPQQPLTTAPGASQ

SEQ ID NO: 11220 - protein, 953 aa, Stenotrophomonas maltophilia
MIHLHHRPLAVAVALCVTALAPLGAAAQSTTNLDAVEVTGTRIKRAEVEGQVPIQTLTRGDIERTGLTSIGEVLQQLTGSGSALNAKFNSSGNFGFPPDGSGVGAGSAQVDLRHLGAKRVLVLVDGIRWVNESSASGVGSATDLNTIPLAIVERIEVLEDGASSLYGSDAIAGVVNIITRRDFDGGQVTLNYGEYSKGDGTQKGVDLAWGKSGDRFSLFLGASWTKQDPVFAKDREQSRFPIPGTGLAFGSGGIPQGRFMFTDPNTGAVQNIVPNTGVSNPRYDGSAGCSRTDDYHCFTTADRFNFAEYNMVLTPSERKGLFGQFRFDITDNVQWYVKALGNRRESTNQAGPEPLFFGPDGATGNPLADNIVVSRLNPYNPFGFDLVSGDNMSLIGRRPVEGGARVFKQKVDTTYFATGLVGDFHAADRSWYWDVNGMYSKNKAEQTNYGSYDIYKVNMALGDPSICAATPGCVPLNIFGGVGSITPDMLKWIQPVVRDRSQNELSLFTANLSSELFSLPAGPVSFATGFEYRKYKGSYQPDPLTVIGHYNGVPSQPTSGSYDVNEAYLELSVPIFADSSFGKKLDLSLAGRYSDYSTFGGEFTPKYGLRWQVTDDFVLRTTYAEGFRAPSIGELYGSAARADLQLFDPCSVGLGGTPPRGSAANCAALGVPAGFQQANSQISVTTGGNRELEPERSRSFSAGFVWSPWFGNNASWSERFDVEVTFYRHAIDGAIQAINAQTQLDLCVDTLDPVYCDGITRASTGAVSSFNNRLTNLGSIKTDGWDVDLFWTLPQTSIGQFKLAWKNTFVGRYEATGAAGQKQPQKPGVEVADSSIPEWTSNASIGWTMDRWSANWTVRHISELTENCGDAAAFPVCSNQAAGTNTLSATTFHDMQVGYKIDWMKGLQLTAGLNNVFDKDPPICLSCSLNGYDASTYDIPRGRYWYLRADLRF

SEQ ID NO: 11221 - protein, 417 aa, Stenotrophomonas maltophilia
MSRAVFRGATCGLLCGWLPVAGAAGFVDDSKLKLQLRNVYFNENFRDEHGMSARAAASAKSERVEWAQGFLLDYQSGFTPGALGVGLDALGLVGVRLDSGRGRSGTGLLPVHDDGRAADEFASAGVTAKARVGQTVVKHGTLLPKTPVLVYNDARLLPQTYEGTQLTSTDIDGLTLTAGHLDRFKQRDSSDSTGLYLDGYAGGRSGGFNFAGADYAVSKQLRLSYFHGQLEHFYRQDFAGLVHELPLAGGVLSTDLRYFKSRDSGAAQGGAIDNDMFSGQMAYAHSGHTLGAGYQVLDGEAGLPYISGATVYSFSNVGIGKFIEEEEKTWMASYAYNFAAAGVPGLTFMARYLSGDNGRSGAEGIKEWERDAELAYVVQGGPLKGLGVKLRNYIYRSDFARGRDSNRLYLTYDIAIW

SEQ ID NO: 11222 - protein, 263 aa, Stenotrophomonas maltophilia
MNTRKSLLALSLLAASALAHAGGEYSFANVSANWLDWSDRTTQQSGKQDFGYLEAEGGLGAKWGELYGFFDIENPGKGNGNTQGRDRRFTTKVVGRYNLAEVGGVPVQLYGHIYDTRGNGPADRHFFTQNRVLGLGTDLSFGALSIKPFFGVHNQMDALMPAGSASGYNGFMTGYVMLYPFQAFGQNLMLTQWHETEFNRQDKFIGAYKSGDRPRVGQNGAIALWWTPTKAVTTGIQYRYADQKLGSTAYQNAVIYSIKYNIK

SEQ ID NO: 11223 - protein, 261 aa, Stenotrophomonas maltophilia
MGYLNNVTGYREDLLANRAIVKHGNFALLTPDGLVKNIIPGFENCDATILSTPKLGASFVDYLVTLHQNGGNQQGFGGEGIETFLYVISGNITAKAEGKTFALSEGGYLYCPPGSLMTFVNAQAEDSQIFLYKRRYVPVEGYAPWLVSGNASELERIHYEGMDDVILLDFLPKELGFDMNMHILSFAPGASHGYIETHVQEHGAYILSGQGVYNLDNNWIPVKKGDYIFMGAYSLQAGYGVGRGEAFSYIYSKDCNRDVEI

SEQ ID NO: 11224 - protein, 447 aa, Stenotrophomonas maltophilia
MTCRSPLTLAACLALAGVGSQVVAAEKSADGFMEGSTLSVLNRNFYFNRDNRDSVAPTHNPSKQPDNGYSEAWGHAVITRFESGFTQGTVGVGLDAFAMLGLKLDTGGGRNGGRSSFDVLPVDRDGQARDEYTKVGGAAKLRLFDTVLKVGDVFPANPVVAAGDSRLLPESFRGVTLENTSIKDLTLQAGRLHAMSQPMSSDLRENFVTFYGGPVDSPWIAYGGGDYRLNEHVSVSLFSSRLKDAWNQYYAGTSLSWPLSEALALIGGFNYYKAVDEGQQRLGAFDNDIWSAKLGVRFGAHTLALTHQRNNGDDDFDYLRQSDSIFLDNSIQYSDFNAPKERSWMLRYDLNMAAYGVPGLSFMTRYGKGTDADYSNANATYMRRDVAGNPLTDQKRWERDIEVKYVVQTGAAKDLSLRVRQATTRATAFESDLDEVRLIVEYPLSIL

SEQ ID NO: 11225 - protein, 1131 aa, Stenotrophomonas maltophilia
MGLLLRGKLLRRVSKGALFSFSLTLSGITVAAPPCADWMGKIIAVQGTLEKSLPQQSWTSLAPEQYLCPGDTLRTGQDSRASIYLRNNTYMRLSQNAIIRFPVNGEKESFWVQLKLGVAHFLSRIVNRFEVDTPYVNAMVEGTEFVVEATESGSVTVIEGKVLAFTDTESLRLTQGEQALSEADKRLRSLEVNTQDTVAWAIYYPPGAVLTELAAISDSLVATTLTQAQEMTERHRPDAALQTLRAGADDEPSIKLARAAILLTSGQQQEAGSLLESLQNDQRLGHLALAMKAVLAAVNSQSQQALQLAQDAVALNADSPSALLALSYAWQANINLPEAIAAAERATVAAPHNVIVWTRLAELQLTSGAYSNAKYAASRATEIAPTHPQAQIAEGFIALFEHKLADADAHFQRAIKADPGVPDAWLGLGLTKLRGGDLEAGRNNLEVAVSLSPNNAVLRSYLGRAYFEEKRSDDAGEQWLLAKERDSKDPTPYFYDGVNKLFSNDPVGAIEELEQSKQLNRNRAVYRSDGLLQSDSAARSAALARAYGEAGFDQAVLLEGWEALRQDPTSADGHRLLADRYLSQPNHQAARVSELMQAQLWQPVTAYPLQPQLYETGLPIVEGLGPSRSGVNEYHPLFLQDGVYGLSNGFVGSDDTWGEDIVVSGLQGPVSASLGQYHYESDGFRNGQDQDQEQNIYNGFLQWQVHPSISIQLEARKAEKDDHLFKLKTIAPDTDPESRSVDTKTYRVGLASRLDNHNSWLFSAIRQKFEEEQALAAADTVSDRKPRTYEVQYIHTASNFYAQTGAGRASIETKTNIQNPAGYINNDDDITHRNIYTYFGIQPTESIFLLVGAAYDNLQLERTSNTFIDFPFPLPDIDLSDSATDEIKQWSPKFGVEFTPTEQLTLRLATFRSLKRDIAADRTIEPAQILGFNQLYDDPNGSDVKTYAAAVDYKLGSRIGGGLEAMRRTVDIRPRLLQKEPERPHHEFENYKLYYFGVLSPSATVDIAYEYEDQDLEDSQFGTGSIYRAKTHSLPLGVTLYLPRHLSMRMESIYTDQTIKASFASDDQRDFNVNLWTFNVRLDYKLPRRFGELQFGVDNLFDNNKEILNSELDYPRYYPKRFLYSRIQLSF

SEQ ID NO: 11226 - protein, 732 aa, Stenotrophomonas maltophilia
MKRNCLSLMIGALLASGPVLAQETPQATPTAASTASPTNLDSIKVTARKREETLQEVPVAVTAFTSEALDKMNVQDISDLDAQVPNLTIYAARGASSTVTAYIRGIGQSDPTWGADPGVGIYLDDVYIARPQGALLDVFDVSRIEVLRGPQGTLYGKNTIGGAIKYISRGLPTQTEGFAQITVGNDSQLDAKAAIGGPIGGADSGLRARVAVASMNHDGFGENTFNGQPVSDKQINAARLNLGAYAGDDFDVQFALDWIDDQSGMRGSKMLAPNPFLRAYPPMDSRYDIRSGMRNLNNVESKGASATVNWRPNEDIALKYVVAKRESDSEANIDFDTAPVKLADVGGTYHDDQVSNEVQLNYDAGGRVRGVVGLYQFSGEAGGQIQNNYFSAQFADNQGKVLTDSIALYADWTFDLTSRLKLDVGARYTDEDKRAIVLNRLYADPGFSRPVAVTADFDKKTNFRNVSPKVSLDYQITPDIMVYGLATRGFKSGGYNIRANAVAVPRSAEPFDDETVDSYEVGSKMAFLDQRLFLNLSAFYNKYKDIQLSVFTGLDTNGDGIDDSFFGDFTNAGAGTVKGLEVEYQYLPNQHWLISGNLAWLDTRYDEYMDRGINVARQMKFTNAPEFSGAFNVEYRTDLANGSNLSARVSYSYQSEVWPTTDLSPVIRQQGYGLVNAGVIWRLDDAWTFSLQGTNLADKEYRTTGYNIPAVGTLIGFYGPPRQYGLSVRYDF

SEQ ID NO: 11227 - protein, 728 aa, Stenotrophomonas maltophilia
MRRPACVRSPFSSPPSTFTMKLNTSACHALLIATSLAGARTSFAQAADAAATLPAISVNAAAEHASYDGGHSRAATKTDMSLMDVPQTVNVVPHAVIEDQNATSLQDALRNVPGVGFSVGDGQRDQITIRGFNSITDQYVDGIRDDALYYRDLSNVDRVEVLKGPAAVLYGRGSAGGIVNRVLKRPLASPVNDVGVTLGTRGERRGEFDLGWNANDAARFRMTGAAENSNSFRDQFQLNRQAIAPSAQFKLDRDTVLNVEFDYLHDRRTSDQGIPAYLGRPVDVPINTYYGSADGVNSSYNDVSAKSATVSLDHRFNDSLSFHGAIRAYDFSLERKNYVTYEPIKTAAHPVVTLDQSTRQRTDHGIDGLFELTQKTSLFGMRHELLYGLELSQQQKFDTIYSVSKVATYDLFNPQPVVLPGVPTGTRAKTNASTVVGLAGVYAQDLISLTEHWKVLAGLRFDYLNQIRHDYTSSNVNLDRTDHAWSPRVGLIYEPLDWLTLYGSFSQSFSPLADTLISSGAFTNGAALAPQKTTAYEVGSRFDLGGKATASVALFDMRQTNQQIGDPANPGYALPIGTQHVRGMELGFTGEIAPKWSVYAGYAYLNGTVDGSAQSTAAGLAVSSNTPGLMPRHSANLWLKRELPYGFYAAAGMQFQSARYTSASDLVTLPSFTVFNLGAGYRSKKVDVTLTLDNLFNRRYFIAAHGNADLYNMPGDPRTLTATVKWHM

SEQ ID NO: 11228 - protein, 211 aa, Stenotrophomonas maltophilia
MRSIRILSLALLTSAAFAPAAFAQDSSSTDTASGKHFAVVGGVALLQPKNDPIDGIKKVDGGPAPTVSFSYYINDNWAVELWGAADKFDHKVKGPNNARLGNVEQQPVALSGQYHFGQADNVFRPFVGVGYYQSSFSNETLADGSSSDIRLKDAKGVIGTVGVDMNINSTWFARADARYMRSRPDVKVGGEKIGEAKMDPWTVGFGIGARF

SEQ ID NO: 11229 - protein, 470 aa, Stenotrophomonas maltophilia
MSLSRRQFIQASGIALCAGAVPLKASAAGQQQPLPVPPLLESRRGQPLFMTVQRAHWSFTPGTRASVWGINGRYLGPTIRVWKGDDVKLIYSNRLTENVSMTVAGLQVPGPLMGGPARMMSPNADWAPVLPIRQNAATLWYHANTPNRTAQQVYNGLAGMWLVEDEVSKSLPIPNHYGVDDFPVIIQDKRLDNFGTPEYNEPGSGGFVGDTLLVNGVQSPYVEVSRGWVRLRLLNASNSRRYQLQMNDGRPLHVISGDQGFLPAPVSVKQLSLAPGERREILVDMSNGDEVSITCGEAASIVDRIRGFFEPSSILVSTLVLTLRPTGLLPLVTDSLPMRLLPTEIMAGSPIRSRDISLGDDPGINGQLWDVNRIDVTAQQGTWERWTVRADEPQAFHIEGVMFQIRNVNGAMPFPEDRGWKDTVWVDGQVELLVYFGQPSWAHFPFYFNSQTLEMADRGSIGQLLVNPVP

SEQ ID NO: 11230 - protein, 1118 aa, Stenotrophomonas maltophilia
MNHPLHGRSSHSRSPLHSRLALAVSSSLLLAAAAPAMAGEALDAWQQQRQLQAAWAQPAVSAPAASTAATPAATGTALLGNPGDAASWRSDEFNADWGLGAMGADYAYARGLTGKGVRLALFDTGSALAHPEFAGRNTSSITIGPNCASPGTVGGTGACSQTQGDQPGINYYTLGAGVPASLQANIIAAGREWGFRYADHGTHVLGTIGANRNGTGMHGVAFGADLTTARVFGDTYYEWRRQASGGYLPEAVERTDPDGAARLDMYAQLQAQGVRAINHSWGISTRNMTVAALDAQYARIGAGYDVYGSIYKDSANAPASQLIQVWSAGNGSGAVAGITAALPRWKPEIEPYWLAVANVRQPNTANGETDYVINAGSSICGAAANWCISAPGTAILSTIVSGDIQGRLEKTADYVRLLIDSQNPTYDYGLKTGTSMAAPHITGALGLLMERFPYLDNAQVRDVLLTTARDLGAAGVDPIYGWGMIDLRRAIEGYGSLRVDTNVVMNQRAGGLKVWEGDAWDDWTNDIGGPGTLTKSGIGWLRLSGDNSFNGAVLREGTLELNGSNTLTSAVDVQGGRFLLNGSLVSTALTTTGGVSTVSASGVLKDGNLTVNGGVVSFNGMQTGGTTTVGSNGLLKGIGTLGSTRVDGTIAPGNSIGTLTINGDYVQGATGVYAAELAPGGRSDQLHVTGTATLGGTLVALPEPGIYYLGEQFNFIRADGGINGQFAKTDFSAFSPFLQFSLAYGANGTRIDVARGASLASAATTPNQRAVAAAADLLAINQGLPKPLTQLFPQQVGGVLDGLSGELHAATPLALVEGSRYVRDAALSRRAGAVAPGADAGDATGAWVQALGGNSRLDGNSNAARTEANSNGLLAGIDHEFSGWQVGVLAGTGRTDVKQQALRAKSKIDNTHFGAYASHNWGGLGLRGGVAWSKHKVKSTRDVDFAGFSDSLSARYNAHTRQAFIEAGYRFGGPEAGLESYLQVARVEVDLKPINERGGAAALHGKVDDTGTTIATAGLRFDKGLKASFQQDSWLHLRGGVGYRRASGDRSQLADLAFANSSTTFAVEGAPIADSAVVAELGLSAWLTPRQQLELGYSGQYGSESRDHSANMRWSVRF

SEQ ID NO: 11231 - protein, 765 aa, Stenotrophomonas maltophilia
MNPMSTPKVFTPSSPSGSRLKPLAFFVAVAISGGAMAADGKPLELDATQIEDSALLPADDAGQLGYTVERTRSSTGLDLTPRQTPQSVTTITRQQMDDRDIHTIEQALQTTPGVTANKSEVGGRTDYRARGYSISNWKVDGLQTQGGSDFSGSGNALNMDLYERIDIVRGANGLLGGTGDPSATVNLIRKAPTKTFGGSAYATYGSWDKRRLGADLNLPLSEDGRLRSRFVMTQQDANSFRDNQSERSRAALANFEFDLDEATTLGAGYQYEYNKVVGGGWGANIPLWYRDGSKTDLPRSTNVVPSWSFGEYTTRTAFGSLEHRFDNDWTLDLKGAQATTEALNHRGLAKVNSAGRGSYGGYWDQNGSGAVLNGLHSSSDTTQQSAQIDLSGPFQLFGRTHQAMVGYNDSRTVSWSPEYSCTMVGDGMASAPALGCQFRANNGFPLTDWRNGVDDDYDILASRTGRHSKTTTRLQGMYAATRLSITDPLSVIVGVRTSNYSSVTRSVAGVRSSQEENGIVTPYLGAVYDLNENYSVYASYTDIFTPQTSETSSGSKVEPIRGQSYETGIKGEWFDGRLNASAAYFRTKQENKAVLDGDLTTPTGGNAYKAGSGQETDGIDLEVAGALSPNWNVYAGYTYLHFRRVDSDGRSDPSHLFKASTTYRLSGPLDRLTLGAGVTAQTNIRAISSPAGQPTNGVSNGATDVNWSGYAIWNAMAKYQLTDDTSVSLNANNLFDKHYYTQYGFYAGAIYGDPRNLSLTVSTAF

SEQ ID NO: 11232 - protein, 644 aa, Stenotrophomonas maltophilia
MSPLSSRMIRLLAGSAAAFGPSTAALAQDLAFSLDPIVVQSRDEFAEAADRATSMYVADAELERARTGDLKDVFAGIASVSVGGALPLTQKIFVNGVDMLNLGVSIDGAAQNNRAFHHVSANAIDPGLLKQVRVDATISPADAGPYALAGSVVFETVDAADILAEGQSFGGNLRLSYGDNGQTAQGALTLAGREGGFEWLAYGKRATGEDYEDGDGETRLGTAANLTSVLGKLAYEAPEGHRVELSALRLRDDELRQFRANFGGLNGVEDSLRRYDTTRESWSLSYENTQAGGLWDPSVRLGYSESDIVIPEPYDSNGLSGTWSATLQNDFHLNATDRISAGIDWQRRFGEYSSPTYGEFLEETSHNIGLFAQARLEPTERWRLSFGGRFDRQDFEGVDGSDERHSGGSGNLSASYALTESLTLRGGLSSIFGGVDIEDNYIFDPGWSYADLRPSRAQNASLGFDWDGGALKLGGELFLTEIDRARSASENFDFESRGFNLGATYGWEGGFARFTLSHSDVKVDGEKAAGYEALDFGAPLGTVAAFEVQQDTTLPGLRLGGGLDLALDHDMPDTADFDLEGYSVVNVFAEYVPPQAQNLTLRLQVDNLFDTTFADRATYGAEYGTVTSLKEPGRTITLSAVTRF

SEQ ID NO: 11233 - protein, 784 aa, Stenotrophomonas maltophilia
MSLPFKRALLLGSAAVVAFESLPAPQAFAQTTLPEVTVTAPSPIVRRHTTPPARPATRVAAPARQRGAAPAETQPVVAQPAPALPGTLPIVTDQFATVTVVPNEEIRRNGGGTLGDLLNNKPGITGSSYAPGGASRPIIRGLDVNRVNIIENGIGSNGASDLGEDHFVPIDPLATNQVEVIRGPATLRYGSTAIGGVVSATNNRIPDALPPCAQPFQSYGLPVNAPAALGGSAGCMNAEVRSAVSSVDRGVEGAVLLDAAGNNVAVHADVYGRNTRDYNVPSYPYADAGIPFNGRQTNSASQASGASIGGSYLFHGGFIGASVTQNNSIYHIPGPEGVELGTKIDAKQTKFNAKGEYRPDAAAIDAIRFWVGATDYKHNEIGLADAADPTSGGVRQTFTNREQEGRLEVQLTPFNAGFAAVTTAVGVQASHQELTAPSPDDPTSPLNGLFDPNKNTKVAGYVFNELQFTNTTKAQVAGRIEHVELSGSSPSSVPEIFDLNTDPNAIGAATSRNLSFTPKSFSLGLIQALPWGLSASITGQYVERAPKPAELFSRGGHDATATFDIGNPNLKMETAKSVEVGLRRADGPFRFEITGYYTQFSGFIYRRLTGNTCEDGACIVGTGLELNQAIYSQRDATFKGGEFQSQLDVAQFYGGTWGIENQVDVVRATFADGTNVPRIPPVRLGGGLFWRDANWLMRVNLLHAFAQNNVADIAETTTPGYNLLKAEISYRTKLNPNVWGAQEMLVGLVGNNLLNEDIRNSVSYSKDNVLMPGIGVRAFANLKF

SEQ ID NO: 11234 - protein, 505 aa, Stenotrophomonas maltophilia
MARRYKTSSRRNVFGLLMMRPYVAHFLNWRSAVLSATIWCGFSTPSHAQSILGFGDLSDSFSLIPPPTFAAPEANQQMPLAVAPPLGENESYDGPLWDRDYLIGDPFHMRTYLNEKGVNISMMEQSEVLGNLTGGLHTGAVYDGLTSIALTTNLEKLAGIPGLQFNVSAFHFHGRSITLDNLSDLNTASGLEADRGFRLNELWLDQSLWDGLFSLRLGQQSVDNEFMISYYSMLFINGGFGWPTLPSVDLPNGGNAFPLPTPGLRFRFQPRPEYTLLIGAYNGNPGSYVTNPSGTAFPINDGLFAIVEFQYDLHHGGKDGLPGFYHLGSYYNSASFNNAASTVGLTPVSNRHAILTYRNDWAVYFSADQMLYREKDTEDQGLGTFIEIISAPSDRNLVSFNVNAGLTYKGLIPKRDLDTIGISVAYSHVSDGKGNGFIQPQNGVVQKGSETVFELTYQASITHWWLLQPDLQYVFNPSAGLALPTNPSTRIGNELIMGLRTTITF

SEQ ID NO: 11235 - protein, 809 aa, Stenotrophomonas maltophilia
MTRPVPPAALRRLAPTLLAACLCAALPATAQTAASAPVELHLPAGPLQASLTALARQSGIQLLFAADSVSGRSAPAVDGRYTPREALQRLLAGQGLAMQERSPGVFVVSAAPAPAKPRIPARAASSAPSSASTTSLARVTVSASTARMPQGETAMPNTITVLTREDIAQQLALGSDVSRVLSSQIPAFAPAREKMSNYGETMRGRGILYMVDGVPQSTPLRDGSRDSHTIDPAMIERIEVIHGANALQGIGGTGGIVNIITRSAPSEPGAFLLDTNVSYSAALPSRHDDNGQRGSALVGVRGEQFDLVAGLAYEKQGLYHDGEGRSIGTNAQGELMDSTSSNVFAKLGWNIADGHRLQVMANRYELRGLDNYLAINGDYRTGRPTISVPGDTPLDPPMNRSRSLTVDYSAADLLGGRFQAQAFAVDFEGRYGASQWDPWGNTGANAAWDQTQNESDKRGFKLTQSWSRIADTTLDVTLGLDGLRDRTHQVLLASGMNWVPQTTYQSLSPLLQLHWWPTDHLMLSGGLRYEKGELEVGDYTTLPRYGARKVAGGKPTMSETLPNFGAVWYINDRLNAYASYSEGYTVADVGRVLRAINRDGQRVDSLVDLSPVVSDNREIGLEYDDGRFSGDIAYYTSGSKLGSVLIYDPGIDAYAVQRQATRVEGFESNLRLRLGNSRLGLGYARANGRYDADVDGRLDSDLAGVNIAPNRLTAFWEQSWTPQLSTRLQASHAFDRDFDLRGAQVAEFKGYTTVDLVARYTLDKHAFTLGVQNLADRQYISYYSQTTPSNPSYFSGRGRVLTLGWQYRY

SEQ ID NO: 11236 - protein, 638 aa, Stenotrophomonas maltophilia
MHYKLKLLALALSVISPLTFADEIEKITVHGLQHHDDGTYTNVYLGSDVTVISNEMIQSAGGVDINKILSQFVPGLFANGRAGRHTDTDYSLQGSRPQDILWLLDGNRLNNRLYGSTYTDSINPMMIERIEVIKGSQSVLFGSEAIAGVINIITKSYQGSDAGELSLAADTLPSYDLSGFVSSEIDSFQLSLAASSSQSEGYALWPDEEYSPTAVLDKERGYQMNNLNAKLRWSLSDAQQLTVFAQYSDGLLERPLAYDAILSENDRKQTIAYADWQLQVSEQFLLQAKVNYQHWDSHYSEITLDEKGNAEVTYWQQYWGFKDLGASVTANYQTEAGSQWIFGGQYEEFEGADEVMLFTAEKDQSYSLFSQYQPEIDALPDTQLSVGARVNHLANDETIWVANLALTQDITQRLQFKASLGNGYRQPTASELHSQVGTLGNADLIAETSNSINLGVHYQGDISLTVDGFWRSIDNLIEPRAITGAEFIYDNLDARVESYGIDLHLVTELSSQLLMELSGSYASAERQDTGEQIERVPEYTGFAKLSYDVNDDIAVWVSGQYVGEFVDYGLIAGDYLLANVGIQAWITEQQDQQLSLTVDNLFDSEVTQSIFKHGHKAQYPIASLGAPRTLQLQYRYLF

SEQ ID NO: 11237 - protein, 398 aa, Stenotrophomonas maltophilia
MNASHYPHCRFAILILSAAAFGAGAAHAQSSVTLYGVVDDSIAYVNNQQGHSNVYLRDGNLYASKFGLRGDEDLGGGTHAIFDLQSGFNLNTGAQAAAGTIFNRQAYVGLRNDHYGTVTAGRQYTPYFLLVGPYASSNWLTGATGAHPGDIDGLDTTIRVNNSVTYTSPTLSGLTASAMYAFGGIAGATGKGNTFSAALRYANGPVGIAAGYLRINSSGSSAGFLNPATAASGSFAVSVLNQGYLSAKAVEQVAAAGNYTLGNLTMGLNYSNVKYLPGNGSAFTDTAVFNTYGALAAYRFTPTFSVAGAFAYTLASKANGVSGAARYQQYSLKESYSLSKRTTLYALQAYTHASGQTLGAQGAGHIVDAAPIVGDSQQLTPSTTHGQFVGMAGIAVTF

SEQ ID NO: 11238 - protein, 912 aa, Stenotrophomonas maltophilia
MRRKAMAWSIQLALMGVAASAAAQAPASSPVQQLDAVQVTGSRIPRAQVEGPAPITVIDAEQIRSSGFTSVPDVLRAMTQNGGETQSQQSSSGADFSPGAQQVDLRGLGPNHTLVLVNGRRIADFPMPFKGRSNFTDVSNIPLGMIERIEVLTGSASAIYGSDAIAGVVNFILKKKADGTTIDMRMGTTSEGGGESFDMSLASGFSRGNFNAVYSVELQSQTPLWAYERDIQDSTQDGPTEGSRIARRAYLRTDYNDDYLDPGAATCEALAGQNQGSTYRAYRPRYGYYCGSDSSIGYGTILSKRRGANGYASLSYDFDNGQQWFADVQLGYHTMSLMRDVTKWGRMDANGDESGYFNNQATGEIEFWQRQFSPEEMGGLRNAMVRSTQKTFSVTTGFKGNLAGNWDYEAALSHSQYQSRISWAQIIASKANDLFLGPQLGVDDDGFPIYNAAPSRLYRPLTRAEYDSIAARTTYSPKSRTETAAFTLTNSALFGLPGGDAGFAATVEVGQQAYALNPDPLATQYYYYSWKDSDGQGSRNRWATAAELRMPLHETVNLSVAGRYDQYRYSGHTIGKATWSGGLEWRPIDTLLVRGSYGTAFRAPDLHYVFAGPGNDETTAEDLYSCRADGASDCSDYERNLIRSRTGNRQLDPETSTSWSAGLVWSPAIGLDLSVDWFDIDMRKQVQDMDVRTLLANEANCRLGSADINSPTCVDALDRITRTSDGRLYGVRVAPINVARESTSGIDVGLRYRLQTGIGDFILNGTHTWVKKHDFQRYPGDPTLDQFAVNSGFDIPRTKTSLSVTWEKDAWSATVYGSRLGKLPTSDNYDQSFDWESGDSPYVKATYRYNASVQYRFDDHSRLSLSVVNVFNKMPPKDATYTAYPYYDVSWFDSVGRTINLQYTHKFGGSAL

SEQ ID NO: 11239 - protein, 493 aa, Stenotrophomonas maltophilia
MKSSTKIFLDRTSHDVSAWRVFVIGLLLLLISCGLKAQDTNHWGNQFGTRAALLGGAVLSDTTDNAGVFYNPGNLAFLDTTSLSLNANLYGLENIKIENALGEKADFKGLQFNTVPLLISGALKLKNGFRLNYGLLTPVSFKFNGVARIDRLSDLVEESESPGEEELLAESSINTRVQETTLALGVSKKIGPRLGIGLTLLNTIRTVDFTYQFSGKTLTNEVDPLLISRTSNEFVHYFNIRTALKGGINYQGQNYGLGFTLTTPGIKVLGNGTVAKDLTLVNNKLEISDNRISAYASDRQEKLKSKYKSPLELAIGGHKTFGKNTLSINVTHFLGIDNYKIIEAEPNQLIRPDIIEGITSSDFLNVETSMKSVTNFSIGMDHYVKPSLSFLGSIRSDFSYFDPDLVLGDQLRTEITQWDIFHLSFGAVKRNEQSNLTIGLTYSFGSTDSYVQEINYSETNPNPPLEGTFAITKAKYSNIGILIGYSLYFKKLN

SEQ ID NO: 11240 - protein, 1040 aa, Stenotrophomonas maltophilia
MPSTASACHRRATALALAVSTALLPLAWVPAVQAQPAIVAPVRQYTIPEQPLADAVRAFGRQADVQVVFRSDLVDGRRSSAVKGEYSQMQALQQLLRGSGVRAQRGMDGTWSLRAAAEAGEGEGVRVTETLDVAGRLQSEGGEARDRRGYDDVFALDLTTAYSGRDRVERYRGSNPADVVKDLVGVFSGDARNSGALDVNIRGIQGPGRVPVSIDGGEQALTVWRGYNGVSNRNYIDPNLIGGIQVIKGPGLVRDVHSGIGGALVIKTIDVDDIVAAGERFGGELKIEGSSNAVAPRLPRLHTGEDYRTVPGFPQGSPNSPYDDRTLVVPVKSRSGNNPFDGEDQAWRLALGVRGGNVDLMAAYAWRKRGNYFSGTQGSAYYEQDRREQFEYQGIDYITTLARYFKPGDEVPNTSSEQESWLVKGSWQINDDQQLKATWRRTLSHYGEIMPSRILSAPDYGRIQWPLSRVDSDAWNLEYRFQPAGSRWLDLYANLWRTETDSDTYSAGGFPNFAVGNPAWNPDASPILRNTALANARNDRTGLILSNRFALHSTLDLTVGGNWQYEKLGSRDPYFGTTDGWRMFPRAGRRQEGEGYLTLEWRPVDFLTLNAGVRYSRYWAFDDFLEAHPELLNKGVGGKEAQYTVNELPPRPANLQARIDALEARRAVWEKRGMGWFIDDSIRALLAPYETPRPVRYTRPWLPDADGNYTRAGNPCLNGEVAAVPGVQPVFAGSDQVCNIGNSVQSQPVDGRNSRRRDHAWLPTFSATAHLSPAARAYVRYSEAVRFPSMFESTIAFSGSLNPLHALKPEHAYNYEVGYVHNLSALFGNTADADVKLAYYVHKTRDVIERDGNFLFDNIDKQTIRGIELQARFDNRRFFTDLGITRTLENEVCDESTAVLLDANRGLVPNCVQDGFVGGYLLTQAIPRLSINGSLGTRLFDERLELGSRIVHYQRHENPDLQAYRDRLLSGGSGLLWQNVPFTWGNITTVDAYARWRFNEHASVELVGSNLGNRYYVDPATRSTLPAPGRTLKLGVTARF

SEQ ID NO: 11241 - protein, 352 aa, Stenotrophomonas maltophilia
MLPSISINNTSAAYPESINENNNDEVNGLVQEFKNLFNGKEGISTCIKHLLELIKNAIRVNDDPYRFNINNSSVTYIDIDSNDTDHITIGIDNQEPIELPANYKDKELVRTIINDNIVEKTHDINNKEMIFSALKEIYDGDPGFIFDKISHKLRHTVTEFDESGKSEPTDLFTWYGKDKKGDSLAIVIKNKNGNDYLSLGYYDQDDYHIQRGIRINGDSLTQYCSENARSASAWFESSKAIMAESFATGSDHQVVNELNGERLREPNDVFKRYGRAIRYDFQVDDAKYKCDHLKEIVSTLVGNKINVGHSQKIYKHFKDLEGKIEERLQNRQAEYQNEINQPSAPGVNFDDI

SEQ ID NO: 11242 - protein, 782 aa, Stenotrophomonas maltophilia
MKPSLLCLAILAASHAALAQVQGVVRDEQGLPIAGAQVDVVGSKLRTTTNERGEFNLPQLTDEHVELHVKAPQFTHRTLHVHRGDGPVELVLASTALEVVNVIGLPWHASNMESAQPVNVLTGDKLRDRQASTLGETLKHEVGVHSSYYGPVASSPIIRGLEGPRVLVAQNGLDAGDASRVGPDHAVATEASTARQIEILRGPATLFYGSGAIGGVVNIVDDRVPQGTDTYGEWRVEHNSVADDKLVSASGNTGIGNLGLHLDGFWRDADDYKIPGPAETHADGEEEIHGKRLENSFTEAKGLNLGASLMFDDGYVGLAYGRLERQYGIPGHSHHSDEADAEEIAVYADLKQDRVQLISELNLDDPLFSAMNLRLGFTNYEHSEIEAGTPVTTFTNETREARWELFHHPLAEWRGAISFHAKHSDFSALGEEAFTPPSSTNTLALALMEERHFGSLLVQLGARIEQVKIEADNFTADLNRHDHAEGEHGEEYLSVFSVDHKSTPFSASAGVVWDFTPGYNLGISYSHAERTPSAAELLSFGPHLGSGMYEVGALLRVLEDESGDYYFDLARADLELETSNNLDISLRKFEGDFGFIINAFYNSIDNYYYLAETGATYASSHNHGDETDHGHEHSEELPVFVYQAQDADLYGFETEFIWQATAPLKLSLTSDYIRARLDEGGDLPRIPPFRIGARAEYSLGNWHAEISSQYYFEQDRIGPLETRTDGYTLLDAQVSYAFSDGLKIYLKGNNLTDEYARVHASFLKDKAPLPARAFAVGITGNF

SEQ ID NO: 11243 - protein, 452 aa, Stenotrophomonas maltophilia
MIIRASMAGRISSAALALLITMTLSSETRADDRAAAGGQTEVQKQLADWGIQFNLTYIGETFANPVGGVRNGAIYTGRLDVGTTIDLEKLVGWSGATFHANAYQIHGDGLSRSYVGNLMLVSGVEALPASRLYEFWVEQALLGGKLLVRVGQQPSDVEFIDSKYDDLFANSALGWPGITGIILPSGGPSPPLAVPGIRLKAQFTDQLVGYLAVFDGDAAPPGPGDPQLKNPHGILFRVQDPPWVIGQLRYGFDLGSTALPGTIAAGAWYHFGSFDNQRFDSDGRALADPLSSGQPARMRRNQGVFAVFEQLLMRSPLDAAKGAGLFVRTSVSPSDRNLISFYLDGGIQFTGFSAARPDDKFGIAATYARISRDVRRYDQDLQLFTGIATPVRDFEAIFEASYSFQVTPNVAVQPIVEYVIHPGGGAVDPNDPTQTRRIRDAIVFGVRTTAAF

SEQ ID NO: 11244 - protein, 1007 aa, Stenotrophomonas maltophilia
MTSRTNVARLKRTALAVVLTSFIGAAAAQSTTGSLFGNAPAGATIVVQSDSGLTRSATVDSNGRYNLGSLPVGKYTITQQRDGQTVERRENVLLRVGGGTEVSFGGGASGATTLGTVNVVAANVPKIDVSNTVSKSVVTSEQLDVLPLGRSAEAIALLAPGVVQGSGAFTNGSRSVLSFGGSSVTENAYYLNGFNASNPLNNLGGVSLPYGSIDQQETYMGGYSASYGRSTGGVINQLGKRGTNEWHFGVQTTWSPDSLAASAATVMYPNRQLPDRYSYTDDALAGKLYRYRKDDVATRTTYSGYASGPLIEDRLFIHLAAEKDRVEGVSTNSEAASQQVRNHYTIDSPKFYGKIDWNINDSNTLEYTRVQNTDRDGGYYRSFDYDDLSEGDRTGTFPNTTKVKDDYDIFKYTGYLTNDLTLSAVWGRSKQSNLESNPANSLNPYLSSPGTQDPSITGGRPIRNDQPELYQKADDAGSKTRGLRIDLQYRLGDHELTAGIDNMYYQGHNEGQSMTGPGYAWIYGRVEPGESPSPGFDITPPPGDGYFVQKYIFSTTTSMSVKQKAYYVEDRWQVTPNWLLTIGVRNDKFTNYNSAAVAYVESGDQWAPRLGASWDVFGDSSLKVFANLGRYYLALPNSVAIRGASASTYTREYFAYSGIDANGVPTGLTALGPGPVSSNDEYGQTPDPLSVAPTDLKSQYQDELILGFEKTLGESWNSGAKFTYRRLQSAIDDTCASDRIVDKLDAMGVDSSNMEVPGCVIFNPGKTNTIMVKHADGSGYTPVRMSSSDWGFGNKKAKRDYVAIDLFIEHPLSNKWYGRLDYTWSRSFGNTEGQVKSDIGQDDVSKTQDWDAGTLMEYAGGYLANDRRHQLKGYGAYMFNDEWSASATLRIMSGMPKSCLGYYGTNESDPERYGAAYHYCAGSPSRPGDAGRQPWTTRVDLGVMYRPAFADHKLAIGLDVFNVLNQRRAVQTDAVYEDGPYTVSNTYGMGTYFSAPRSVRISASYDF

SEQ ID NO: 11245 - protein, 415 aa, Stenotrophomonas maltophilia
MHPFNTFNCSSRYHFTPTTVNDKCREIKKCFTSSFDVTFNLNKIKKQALCSAVLFFLAVPAYAQVDNAVSREFSDYRDTRQNNSHVYVGLRGGGANFEKACSSGSSKCNDDTLGYGFYGGYQFTSWFALEAALTDYGSISATYYGTNKVSVETWGSELSGVFSYDLFESLDAYLRVGASYQHAHKESIWPTEELVGDWGVVSAVGLDYRLSTSWSLRGEYQFIDDTGKNDLTHVDVHFVSLGLTYHFGQEKLFSAVAISAPLISEPIIAEPVIVTSVPVIAPVFVAKKTYFVTNALFSVNSSQFKTNPDLIDLIMKSLQSKEGNIIITGYSDNLGSVKYNQWISEKRAKVVANYIISEGISSSRLIVKSEGEFYPVASNKTATGRAENRRVELKFEKMMTEEVINNTSNNGGNRS

SEQ ID NO: 11246 - protein, 394 aa, Stenotrophomonas maltophilia
MNRIVAAILAVGLAPVALAQEAAAPASSAPAESSEVDTAALKGQVDALAEQLAEMKTDVSGLKKLKFSGYVQPRFGWLEAAQYEKGAPQRDGFYIRRGRFKAVYDTDLAQYVVQLDATPSGVGLKEAYASFKLPFLKGFAVDAGLQLMPFGYDVGVRSSSDLDLLERAMFAGHFLKGEYDLGVALRGAYGPVSFKVGVFNGNGVDGAAGKDNDQRKDVIGRLGVDLGMITGGVSGWYGKTIDYTSATNATYDRVRLGADLQLYLDLLPVGGTALKGEYVWGKTAIGTGAGGAGDSLGLIGYGWDVILTQNVGPWNQVAVRYDTFNPNVKLDRNLAANQGKVFVTDEVSAALHTILSSNLKLSVAYYHPMNREKGDTAPSDPKKDSFIAQLQAKF

SEQ ID NO: 11247 - protein, 712 aa, Stenotrophomonas maltophilia
MTKTKLTTLAIAIAASLSPVKSFADTDNVSTFEAIEVVGTRPDYKTESVSTATKMDIAPLENPRSVNSIDRKLLDDLQATSLDKALKNDASTVSTYESDGHENFYIRGFQLTTNDGYLRNGEQKYSLIQEPVEMYERIEVLKGPSGLLYGKGSPAGLVNMVTKEPEYQRRTMISQDVGSNNFSRSVVDTTGSATDDLRYRVIASKQSKDNFRHYVNGVHPTTRRDLLAIMLDYDLTDDTMLSLSYDYKTQKGHQDSGAYFDEDGNIIGDRDLILNTPWSTNEKEEESIGVKLTHHFDNDWKLTASYHKLNMVNTAKTSSIRPMKDSAQTGKYEFNTGKRDNSYDVHTGTMDLTGDFNTGSIEHKLLVGTNFVDHEYSRNSLYGGVKQAASTNPATPIYGFDPSKSGKPSSNVYSNFQTGLYVQDLITFNDYWQVLAGARADYYIKYRSKNDKRDGKGEDTEYFNVLPSAAVMFHPSADSTIYASYSQSFVPQTPISSSSDANDGMEREPELGHLYEIGYKQEFMDNSAIFETSLFQIVKENISVTDRKYRDPNNPAITKKTEQGGKQINTGIDTTITGRVTELLTVKAGAQYLIAEYEGQPKYDGKKIADVPQWTANAWANYELTDHIDLNAGVYYIGSRYGNSANDEPKKSAYTLADVGAIYRMPMDSGDELSFRAKINNVFDKEYETSGDYSGMSIGEGRNYMLSAQYEF

SEQ ID NO: 11248 - protein, 783 aa, Stenotrophomonas maltophilia
MRMMQFTPKFPSAKNQSDLARAIATALLIATSGAAGAATVNPGQTLVVNAGSLPQAYDVNGGTLIVEGATTNRIDTNYSGGQPARVIANGASISSMRLLNSVGTLHNSTVNGQFTLSINVGSGNSGLTRPHLTTAGSTFNGPFTGSGGGRLDSEGSTFAQGIRSLGTILNLKANTKVVGSTYGISLTNSAIAGSAGMQDWGLLLDSSHVAATSGPALLIGGTTTGYPVRVAIQNGSTLSSSNNVVIEGRDSSVFDVTARTSNLNGDITIADTASGTLRFLDGLDLTGRILGPADVIVDQGGRWTLSGDSNTGNLTLGAGSNIFLGAAGTAAYPQLTVNGNYTGNGGTLHFNTVLAGDDAASSRVHVTGDTSGTTQVTVNNIAGAGAQTVNGIPLVQVDGTSNGKFTLQGRAIGGMHEYFLHKGSPGAANGNWYLTSVYTGNPCDINPSLPECTPVDPVDPVDPVDPVDPTDPTDPVPVLRPEPGAYLANQAAAVQMFQLRRHDRGEPGFDRARIGTWVRAGRDQLQANVAGQVDARTHINTLQLGSDVWRWGDGRGQVGVMLGTGEATTQAVSTLSGYGTRGKVKGKSAGVYLGWVQDAQSSAGLYVDGWLQAARFDNEVQGEGIARETYDSRTRSASLEAGYAWAIRSTEASTLYLQPQAQLTWTDYDGDSLVENNGTTVEDGRGGGLNSRLGLRLFGQSTLQGNRVQPFLAANWLRGQRDEAMRFNSESLSAKTPENRYEVQAGAQLQLGQRWSAWGDLRVQRGDSGYRNHGAQVGLRAAW

SEQ ID NO: 11249 - protein, 815 aa, Stenotrophomonas maltophilia
MPVSQPIFRLSLITLACFSALAQNVYAENTSTAPDTNVERITVYGKQNSVVKNSGLATKSDMSLMETPAAVVVVDQELISAQGVDNLQDLIRNISGVTQAGNNYGIGDNLVIRGLGANYTFDGMYGGAGLGNTFNPTRSLTNVESVEVLKGPATGLYGMGSAGGVINLIEKKPQFESKHKITTEVGQWDTYSLAIDSTGGITDDVAYRLVAKTARSEGYRDLGADRDEVFGSLKWVLSDSQDVMLSGAYIKDAIAVDSIGHPIRIYNADSVGGKTAGEVTWQDLINDPNGQGIQLTDEQRQQLAASLASGDGLTPYAFGDAGLISPMAKDNEGEELRFKLTHNIYFTDNLFLNQQLQYRDYTTGFARQTGAYNYVYWNNKGKINADPRAPLVENGVLYPFAARRQEYRKLDAEETSWQYFADLRYDFQIGNIDNELLVNANYEDRTIRLEQFSIYDADQVIKDKKNNVIYRGSLPYIYDIRNPNWGTGKFEDYDPLKTANYNKKVSAWGLGVQHVGYLGYGFTTRVGVAFNEIKQSYEHLGLDARYSAGQASPTPEADSKDNGITYNLGLTYMPIDDLSFFVNHSKGRTAYSILGSITGKNTDREDSESVSNDLGMRFKAFDDQMLASLVFFKSSRTNVPYNNPDYNAGVSTADVPVYFYDGSEDTQGVELDLNAHLNEQWRVNLNGMYQDARDKQNPNDKANYDSRQKGVPYVTASAWVTYGADWFALSSPIELSLGAKYVDERSTHSKDFGIPDGYVPSYTLVDSAVSYATDSWKLQLNINNLFNKDYYSKAMFLGGMPGEERNVKLQYSYSF

SEQ ID NO: 11250 - protein, 875 aa, Stenotrophomonas maltophilia
MYRTTLNLLAGAIALGLTAGAAGAAETADTGKDSTTLGAVLVTGSNIKRSDTAGPNPVQIVSREQIEQTGRSTLTDVLRNLSANAGNSFDEQYTGSFAAGSASIGLRGLSPKNTLVLVNGYRVSNFGFALNTQDTFVDLNALPISAVERIEVLKDGASAVYGSDAIAGVINIILRKNFQGVEVGGGFGTATQGGLNERKASLLAGFGDLEQQGWNVLFGLDLLKRDRLDADQRAYTRSGDFRDKPGGRLAGWSTAGGNWLSNPRAPQPFANCPDGSQLRPYSDFGSTLPGQACAFNAQPFKTLQPGAERLQASLSATYRFNDSVEAFADVLYSHNKADQIFSAPLTVGPGLRAYNPATGTLIDVPAVLPVGHPNNPGSAPLPFEYTFFDLGPRLKDNTQVFYRALAGVRGSGERWDWEVAALTSQSAQREYVDNFVNRYAFEQILRDGSYNFLNPSSTPGALDALRLQTKRPGWYKLHSLNVKASTSLWELPAGAVGFAWGAEFRKESLDARTSAQVLSGTELRPAINVVNGERQVSAAYAELSVPLHRTLELQVAGRGDHYDDFGNAFSPKVALRWQPLDSLLLRGSFSRGFRAPSLPEIAPGQTVSYGSVIDPLDPLQPGGSRGVTNIRTGNPDLKAERSRNFNVGAVWSPDGDTSIGLDWYRIEQDNLVKPDSAQFIVDNPTLFPGRVQRDAQGRITFITNQYANQGELTTSGLDLEANRTFRTDGWGNFTVAGSWTHLLSFKQPLVAGQAPYEGAGNNRHGALPRTRGTTSLNWAVGDWSSTLSLQYVSGYDQRVATATSNPGLRDRIKPYHQLDLYVAYEGIPNTTLSLSVLNLTDKDPPFDPAGGSNGFDISQYNLRGQFISLGARYRF

SEQ ID NO: 11251 - protein, 982 aa, Stenotrophomonas maltophilia
MKLPCPSPRPLAIALCLALATPCLFPAAAHAQDAAAAVRWQIPAGPLDQALTAFGQQSGLSIAADARLTRGRHSGGVQASLNTEAALAQLLAGTGLSFQRDASGVVLQAAPATDAGVRQIGTLRVAGQAGDGASPWGLADADAVYRDSGSRVHLDHQQLERFRGQSIGDVLAGAVGVHTGDVRNGGALDVNIRGLQGQNRVPVIIDGGQQAIDVYRGYAGVQQRSYLDPDLISAISIEKGPSLAANAASAIGGVVYMETLKAEDILDDGQDWGLRVRGGVADNSIDRTRTFKQIARGSDNRNSLRDPRDWNGSVAFAQRGEDWQLVAAYARRRQGNYFAGSNGAHRYDDQHLSSGGTGMSSQAVSKLYHPGDEVLNTHTDNESALLKFTWTPDPDQRLELSHRFFNSSFGEIMPSAIGRVGESNEWVTYVDKANTMFQFEPGKMRVNATSLRHRYRPEAHPWLDLSSTLWFTTATSRMFNSNIANTPLFKEMASDQMPDTLGETYGPGLQSDVKTRRWGLDSSNTTRFSNDLGDWTLRYGASFQHEDTAPNSPVLPVDYNNNRYLRSGTRREASVVASLQWQPWDWLSLTAGGRFIDYRTRDRNRVAFVSESRDLRYTFARLSKGGQLLPGWYKEWYPDAQGNYTYDSLRATPYGGSTLGQTYDFDGFIRDPRGANGFYTKQIPTAWGYKPAIRRSGHGFAPYAEARFNLDADMFFYVKYAQGWKMPSLFESTLGNSTSAPVADLKPEKNRSWDIGFSLLKQDLWRDGDRLAFKVAWFKNDIDNAITRRFDSSNWAFYVDNVDNYTVSGYELQSGYDAGIAYLDLSASYYQRARTCDAATAKRMREDPYAKWSKLDTTPDCVVGGFGTSFVNAQNPPKYSIHSTLGFRLFDKRLDTGIRRTYNSGPTHELDKPWNTTGSTGLQNIYLPTAIYDFYARWQFTPKAEVELVVSNLRNTYYMDTLAMSLMPGPGRTARLNFTARF

SEQ ID NO: 11252 - protein, 70 aa, Stenotrophomonas maltophilia
MPIGGDVKADQETSGSRSIKRIGFGFIGGIGYDITPNITLDLGYRYNDWGRLENVRFKTHEASFGVRYRF

SEQ ID NO: 11253 - protein, 772 aa, Stenotrophomonas maltophilia
MNTPPTTRLALAIIAAITAPAYAADTHDAAHDSPTTLNALQVIATPRGAAVAPTQVVGPNRYIIKADDLDAMVTGNNGLAMLKQVPGASYTATDGLGLDISATSLFVRGFRMNEMGITFEGVPLNDNGFLSLTGTSVVNVGVPDGIGAITVSPGGAPVSVFSSSVNGGSLEYRLRELQDTPSLRVKQGVGSNNTLVTTASGQSGQLGEHGPKVLVDLQRVSADKYQGEGTQNFLRGDLKLQQDVAWGDFTVFLSDSKAKVWGYNNISFDMIRKLGWKADIFYPDYAWAYYVASPENADKSCGAYTCGELSELIPYDTGQITRDRVSSISHRFQISPALSGNVQLYNANSHTQATLTDPTVPSPNGAPFSEQVQTPRLNRLGGMLNLQFEAGAHTFTAGFWQEKSKAAAKTEWYQQPLLGEGPPLKATGPFDVYGPAFKTDNASSWVTRSRQFYLQDDIVLNDTLKLGVGFKAVDFRTSGGGLGDAKDRPVNGTLRAKSNFLPHVSLFWSPTESTDAFIDLANTMNGYRVAQRGNIGYTASAWTITDQEEFDRVAGTLRPEKNWNLTVGASHRFDRLTITGDVFYNDIRNRLLSAAIGTQFAQINTVRLMPKMHVIGADLGITADLTDHLQFYQGVAVARSYYDSDFVVGDTVYPIKGNAQPGYPQISLVSDLSAHFGDWRFGATSTSYLRQPFTYENDIRVPTFWQVNTYAAYRFGTDSAVPGLELRLDVSNLFNRHNIGTATIAGSSFSGDYQTLQRSAPRQLMFSTSMAF

SEQ ID NO: 11254 - protein, 91 aa, Stenotrophomonas maltophilia
MHRRSIINHSRPDKLKRGMHVEIASNVINDLQFFDQQIRWAKADLVQQVSRNRLNRARTYRGYLNQCLPHELVADIQRAVIKSINAISLIN

SEQ ID NO: 11255 - protein, 620 aa, Stenotrophomonas maltophilia
MLNYRFASLAIFISSSLFSPLTLADEYRESDDVVISASLVETKRVESGSSITVLDEQYIKENQARSVAELLQDIPGVTVSRTGSIGARTSVSIRGAKSNQTLVIIDGVEVNDPTNINGGFNFNTLMASNIERIEVLKGAQSALWGSDAMGGVINITTKKGTSGFNPSLSIEGGSNQYHQESFNINGANKRSHYSFSGSNLQTDGISAQTETMGGNEDDAYKNQTLSIKGGHTFNDIFSLDGIVRYNNSKNDYDNGNNASTNSGYLLNTKQNLGKINAHLNLLDQKLKNTLSISHSQYYSKGSGRKSWDNYEYDGKKTKALLQSNYYFTPHSAYTQRLSFAGEYERDNYQSYGMSKPQKMNATGLVLEYSADWDKSVFFGLSARQDFNNHFENTQTYHGDISAWVNEGTRLHSSLGSGVKNPTFGQLSGLDGNISSGNSNLKPEKNTTWDMGVEYNFASRDAYVDITYFNARYQDMIDYSMPKSMYINIKNATSQGIELTGHLNLSDKLRINSAYTYNKTIDKDSNAPIIRHPKHTANINANYHYTDKLSANIGLRYIGKRLDIGDVELSSYSLLNLAVNYQINTHISVQGRIENALDKDYVELVGYDTEPLTAYLGFTLK

SEQ ID NO: 11256 - protein, 1067 aa, Stenotrophomonas maltophilia
MKTNRSTLSPCFSKTVIASLLVPLCSPLYSWAVQTASITDGSTMVISGGYDTEANNHSAVFVQGSGSTINGGSDVVIETTGFGAIGAYSSEGGTLGLTGSTIKTESGTAFGVLNDKGTVNLQGGTITTKGQTAYGVYSSGLGSNTDIHSSVITTSYSLTHAIYGAGGTGLTLNNTTVNTSGSGSYGIYLNGPGGSLTGADNTINSTHATNGAGIYISSGGSNATLDNTTLNITKGAVGVNVGEGSSITMDGLIATGNITNLFKVNGNASVSNANIELAAGGLLMAQGHSASNQAVIILNNVDAISNSGGTTLVDVNKDADVTINEGSYHSKGNNAKGIWVRDNSSSLNVDNAVIITEGVNATAIENRGTAIVENTTVITKGNNSHGLYSEQSLDATNMAISTAGIGSIGAAAAKGGNLNLNDALIETTGNSGMVLGTFADSSISAKNITGLSTGAGAYALWVDDGSSILLEESQITTQGQGAGGIYASNTGTGSHTAYTQVTLNNSQIHSEQGPGIWANGADINVDVKNGSQLTGGNGLLVYASSNAGAASNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYQIDDHRWNLQSNLIKPDPGVDPGEETAYRPEVPGYIAAPWLNAFYGFTTLGSLHERRGSAEGAAEGFNQDSWGRIRGQHNNFEAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDAISEIGGTDYSVGQVRAGLRLFSDSSEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 11257 - protein, 798 aa, Stenotrophomonas maltophilia
MPALKSLKAIPAALAAAGFAASVSLPAMGQGAGMLEEVIVTAAKRQQTLQEIPIAVSVVTAEAIEQSQVLDVKDLQTLVPSLRVTQLQGSAQTNFIIRGFGNGANNPGIEPSVGVFIDGVYRSRVGSALNDLPKLERVEVLRGPQSTLFGKNASAGVINVVTAKPDLLGHSGEVGVTVGNYNQKIVKGYLTGPISDNLAFSVSGGMNQRDGYYDNLELDTKQNEINRWNMRGQLLWNPTDRMEVRFIADADSLDEVCCGVANLVNGPTGALVQALGGNLVPEEPFAYEGFYDFDPQNRIDTQGVSMQIDYDFDSFTLTSITAMRKLEQFDLGDVDYTSARLVTPDAANQRDLEIDTFTQELRLTSATDGPLQWMVGAFYFTEELESDGAFGYGDQFRAYADGLTGGGVSGVEAALGPILGIPAGTFFAEGAGFPSEVATLDDDTLSLFAQIDYDITDAMTLTLGANYTESRKEASVNIVSTDVFSSLPLGAFGLEALQPLQFLPPFLSFPNAVEDGETDDDDITYTVRLAYDLTQNINVYAGVSTGFKASSWNLSRDSRPFPEDIAALGAAGLLVPNLTSGTRYAGPEESTVYEIGLKAEFDTVSVNMAIFDQTIEGFQGNVFTGTGFVLANAGEQSTDGLELDVNWAPIDGLRLSFAATWLDPLYDDFQGATGPDGPIDLSGEQPSGIPELSTNTSATYNFNIGNAMSYARIEHVYEEEVQAVDNISADVASREINMFNASFGMTFSNGVELNFWGRNLNGDEYLLSAFPSVAQAGSISGYPNQPRTYGATLKYSFE

SEQ ID NO: 11258 - protein, 1218 aa, Stenotrophomonas maltophilia
MSASFKLKPLVLAMMPLLFASNSATVFAQDTDAQDTPSSEEEKEKKKKAEEDLEVIKVSGYRGSVIRSINAKKFSDGVQDSIFAEDIGKSTDQNIADALSRVTGVTVQESDGEGTRISVRGAGAALNQISLNGVALTSGLNGSGSNQSVSDESVDLSTFSSDILSSINVIKTAAADHDEGSLGANVILKTFKPLSVEEDRRSIEVQGRHNEYAEKNNFKVSGTFSEKFLDDNLGIIVTASKETQDTRRDSLGGDWLSPYKTARIREGGATNLDGEVITEERDAIIANGRSFNTFVNTRDRDTLTMGIQFLPTDVTDVQLDLSYSKQTFEQDSHSINVTTPDLSVLGSAVTNFHNTEFNGSVPETQAHLGTVFTDPQQDWWILDEQSNTLVKSINRFASGGFSRQLSGNETENKVATLKINHELTEDLLVEFTAGYSRTDFESLPNASVRTQNWNRVPIPELAEVPVVDPNGNAVLQPVGFDCSTGQCVLVTGDQPVSYVPINAGGAQSNISPTGFSPYDLNANHLGGLSRYNEDQIDTNKSVFLDFDWAVEFVGVNKVEFGFKYSSRDKEVFTDYQDFSNTDDIVLNPETGEVISGLGQGDITVADFTAGTGLPVSDFFDGLLGSNASEYNTNYLNGWAILDPEKAFAERFQIPNSVLVSNNNGDRKITQDNVSAYAKLNFEYFDSKLTGNIGVRYVKTENTSIGNSTFSFNGQNVAFDPVALIYGKQLANTSLAPCPEAVFIDGSVVNADPNIYPCYDDGFSGIVTNDAGDSVDRGFAVEYDANGNVVSPVGQFPQNEPVTNNSRNWYQLLDHRDTSTQSASAQALLDAGLISSLREVNNRAFAGTGENESEIWLPSANLNYAINDELIARFAASKTMARPRFDSLTPGFSASEDPWGVDSSSIRTNNPRLQPLTSNNIDISLEWYFNKAGLVSVALFRKDMKNFEERVSAEVYLKDIRTDYGLESISLDEIVINPGAETEVTNPNDGRVTQVNEVTPFNSDCLPFRVVQVQIANVLPVECRNFQASVLRNGKGSVTQGLEFSYNQSYDFLPGFWSGLGVNFNYTFADSENESDFDETLQRVVQPVPQAYTPRHSANTTLFWEKDGHQLRLTHRFNSDQFVGEVTNGNAWQDSTTKLDFSATYKWDENITFTFHALNLTDDITRTYFTSRDLTLRDADGNVTVLSEGNALTDDVYQGRTIGEYKTGRQFRVSARVNF

SEQ ID NO: 11259 - protein, 411 aa, Stenotrophomonas maltophilia
MLCFFVILFFLSIVSVMLILRGFTVLRCFFVTAKFSAAQEELNNYKLLQERRMKKTLLAVAIPTLLLANSAMAAEIIKTEDGTVDFYGQLRTEVKKLEDKDVTLNAGSSRTGVDARYKLTDTTDVYGKVEFGLNYKADGSDYSMNNRLHYIGIDSEFGKISFGRQWVVSDDVYGADYSYFFGGTALRYSTLSGARHDSLIKYNFDGEDFWVAANYGLSEDDDNQELAELYVGTSVGSFNLHAGGGQNRDKSHKIGTETVTPEASLPAFTQEKEITADIENIYFEGTVEYTVGAALIGFTYYNAELSDKNSNLSIDENGYSLAGTYSWADNATAYAGYEYTEQSADGVEDQDGTLVYVGSDYNVNSWFRVYAEYGYGDGTTLGYSNKGSDSFIGTTEVDSESSFALGARVYW

SEQ ID NO: 11260 - protein, 849 aa, Stenotrophomonas maltophilia
MAKQKLLMGSAHTFSVFTLILGASGHSLEAQESPTSDQVQASAVVQDVVVTGGGWERPRSDQRVILDSPSPIDVISAQQLHQTGRAELSEAITKLLPAFNFGNTTAGVNSIVRPVTNHGLGPAYTLVLVNGQRRHNSALLTNGGGDTSGVNPVDIDMIPLSAVDHIEVLRDASAAPYGSDAVAGAINIILKSSDHGGHAAALAGNLYQGNPGSDRSTAKGEADAGFKLGDEGGFVHISADVRKRGMDWWNFYAKNLPYSPASNPLNATWTGDGAHNGDPEIRAYNLAYNAEVPLTPNINAYSFATFGVRDTVIGNNFRRPNTNADFDALFPGGYYPLNNTHEYDLQFNAGFKGRLYDWDYNLGTSYGINHNKQYSDFTINPSLGPTGPTQFKDLATYQFSQQVTHLDLNHAFATSTLPKPIELGLGFEHRIERFSTLPGDPLGYMNGGYRYQPGDQALSHDPNLGSYAAVGAQGAVTINPANATSILRNVVAGYGSLGIYPVDNFYINGSLRGEGYDDLPNFIYSTKLTARWDIAPDFAIRGSLGTGQRAPSLTQIGYAQTDSRTNIDPVTGLIVPSLSTLARNTSALARALGAQTLTPEKSTNFGLGFVWKLQENRNITLDGYRIDLRNRIFRTNYIYGSAVDPLIVANGGSAGTWIQYFANGVNTSTTGIDLVGEDTEDYGDYGSVRYTLGFNWNLNVIDSVAQTPAALTALASANKGGSLIWFGRATAADLTVNQPRTKLMFAVNWSIGDFIVSATTTRYGSYQYIQSQLPSQDRSFGAKWITDLDVTYKIAGGLRISAGATNLFNIRPSANGIIDANTGASGFAYGNSPFSPAGGFYYTRLAYDF

SEQ ID NO: 11261 - protein, 1038 aa, Stenotrophomonas maltophilia
MTHHTRRLTPAPLSLALAAVLSAFAATATASSPDPQTTADQTAPDQAGDAPDAKRLDSVMVTGSRIGRVGFDSLEPATVVGAEYIQGYGFTNIADALFIQPSFGAGATSRGDQSGYGAGVNFIGRFGLGSNRQLTLVNGRRFVTSNPPTVFGPSGGGTQVDLNVIPTILIDQVETIGVGGAPTYGSDAISGVSNLILRKNFDGAEVRMGYGLTDRGDNERFNYSALLGSNFGGGRGNITIALDADNSQGVLGTARRFYRDAYSTRANPSASAIANFQPGRTPANDGRVNPGIGFNTGPNDGIPGRVLIRNRRISDMTWGGLLFPSDAGTVRDASGQLRGFGANEDQFVQFDRNGDLVNYNPGTNFGISDASGGDGVNLQETTQIISDLDRKTVFALGNYDFTDQVSGFFEASFYTSTARELVDQNVYNATGFGVGSVDGSGDQSGSLNFNINNPFLTEQNRQTLQNLGVEDFVLSRSSRDLVQNQSSTDTNLWRAVVGLQGSFDAAGRGFNWEASVNHGEGNFDYYNDNLIQQNFINAINVTRNSAGQIVCDSSAAGTTVDPNCAPLNLFGEGVASRAARNYVIAPTHAEAQMKQTVFNANITGAIIDLPGGELRFNAGYERRKEEGSFTPSTFERLGQGRSVPIAAASGEFTTNEYFGEILAPLVNPDAGIPGLHRLDLTGKIRRVENTVNGWFSAYTYGLQYEPFQGVQLRGNKTRSFRAPSIAELYTSQQPAYYFIPEPCSAAQIGSGPRPGVRARNCQAFFDFYTNADPASFEEAPSSQLGSVSGNTRLQNEQAESWTAGIVLQPEWVKGLRIAADWYDIQITNSVTTLSEEDITSGCFDSDTFNANDVPNANNFCSLITRNPQTGVANSIRTEYTNGPYTNFRGWTAEVNYRFDLADVDWGKGIVDLSFYGYFPKTLESAAAPGIPPDEAVGEIDNPKRQFQWNARYMTSHWNLGLSANYSSSVVYDLTDTVETRAPLGVPSYTSYDANVGYAFDTNTSVNLAALNVTDKLVAFPNVYDGLGRRYMFTLNHRF

SEQ ID NO: 11262 - protein, 192 aa, Stenotrophomonas maltophilia
MLNGMFDFGGKNDGVSGFIGGGVGVARVALNHYSLGGSGSFANDNDAHFAWQVIAGIRKPVTKMIDFELKYRFFNVNGLNFRTTDMGNMSGRYRSHSVLAGLVFNFGERSCSAAPPPMPAPPPPTPPGLRPPKNRLRHQSQLFRGRSWCSSTLISITLRQKRLLSSTTLRLPTPRLGRLAWLLLVTPIPQSG

SEQ ID NO: 11263 - protein, 706 aa, Stenotrophomonas maltophilia
MPPKRLCLSLAVLGTLPFAQVASAADTVAAADAGTLPTSTVKGARSSTSYDTPIANTATKIPVPLREIPQSVNVVPRAVIQDQGALSINDTLRNVPGVSASLGDAQRDQVTIRGFSSINDQYVDGLRDDSLYFRDLSNIDHIEVLKGPAAVLYGRGSSGGIINRVTKKPLATPLAEVGVVVGTERQKRAEFDLNTSINDDAIRARITGAVEDSGGFRNDYFLRRQAISPSFLFNLAPDTKLTVQFDYLHDKRIADQGVPSYHGRPVDVPIGTRYGSADAGAGNVESTVKSVTGTLDHRFNDKWSFHSVVRNYEYSLGRNNYTTVSRVTDGPIPTVTLAVNQRNRSDRGTLWQNELTQKAETWGIQHTLLYGIELGYQDKSDRVAAAPGSTTYNLFNPTLQVLPTVPGNAVPTNYGLSHNETYAAYVQDLIKFSPQWTVLAGLRYEILKQSRDDLTPRNVDLSRTDKPVSPRFGVVYHPVEPLSLYASYSRSFQPLADSFTFFPNSGALAPQSTTNYEIGAKYDLSAGASVTAALFDMKQTNLTAADPVTLLGVPIGTQRTRGLELSFTGEIVKTWSLMASYAYLNGRLENPNDRSGGVAVNGNQPSLTPRHSGSVWLKHDLPNGFYVAGGVRAEGARYASQYNLTTLPGYMTVDLGAGYRSKHLDVTLNLQNLFNRAYYVSAHGAAENYNMPGAPRMALLGVRYKM

SEQ ID NO: 11264 - protein, 424 aa, Stenotrophomonas maltophilia
MSLTAIVIFIKRPVDTVRFRSPSKRLKERRGTANILTARRFALNKKLLTTAILAATASAAHAQSSVTLYGLIDAGVSYVNHSKSASGSDKLFKYDDGIAQGSRWGLRGAEDLGGGLKAIFVLENGFNSGNGTIGQGGAIFGRQAYVGLSHKDAGTLTFGRQYSFTTDILGANYSTGGNTVAGNYAYHVNDIDQLTSSRINNAVKFQSANYAGFTFGALYGFSNSTSFAGAPATTTGTTTTPGSSRAYSFGLNYANGPIGLGAAYTDIRYPSQATPAFTTNIANLTISNVRDLRSFGVGGRYIWGPATLWALWTNTRLEPVTGGSTTYNAYEAGGKYAFTTALSAGVGYTYSRVSGANSGHWNQVNGALDYALSKRTDVYLLAIYQEASGKNLQAQIGSSTSYFNTSGTGSKNQFAARVGIRHKF

SEQ ID NO: 11265 - protein, 829 aa, Stenotrophomonas maltophilia
MAAGLSGLAVLVAAIPSPASSAIAAGPDLGQAIRPVIRVAASHPAEDGAVVFTIPAGPLDEALAAFASASGVQLIYDAQTSGRLNSTGLSGRYSRDEGLRRLLTGTGLVPHFTSARAATLIRVVAEAVLPGQDGTAVTLDMLEVMGESAVGPVNGYVARRSATATKTGTPILDTPQAINVIGRKEIEDRQAQTLTQALQYTPGVIGQYGNTDLRVDWLTVRGFVPGRYLDGLRLPFGARGYSQPRIEPYGLERIELLKGPSSGLYGQNSPGGLLNLVSKRPSSVPLGEIQLQTGSFGRVQGAFDLSGPIDPDGRILYRLTGLARTTGTQVDFLEEDRVFIAPSVTFRPDSDTSLTILSQYLKIDSPGGGAPQALPTLGTLYANPLGRIPTRRFIGEPNYDRFRLEQGFVGYAFEHRFNDVWTVRQNLRFSHVDTDTQRVQGIALGADRRTLSRYAWAFPERANLFNIDNQAEARFHTGPFAHTLLIGLDYLREDARYDESQLRIVPSINVFAPVYANTVTRPPVGTRITQGRNQTGLYAQDEIRIGGFTLTLSGRQDWADAVTRTRTVATGATTQVRQDDAAFTGRVGLSYLFDGGLAPYVSYATSFLPTSGTNRLGSPFAPTTGEQIEAGIKAQPVGTNLLITGAVFDLTQQNVLTPDSSDFRFNTQAGEARVRGVELEAKASLTDSLDLIASYAAMRSEFTRANANAAGTSIVGNELPFVPRHQAAAWLDYTVRTGPWAGFGFGAGVRYIGTSVGDNANLYRIPVVTLVDAAIRYDFGYRYPALKGVDLAVNATNLFDKTYVTTCIAATGCYYGNRQTILATLRYRW

SEQ ID NO: 11266 - protein, 956 aa, Stenotrophomonas maltophilia
MKHSKLSLALAGLIAVGAIAAADDVMAMSYHVQGDRIFLSGGVTYADVVSLPALLAKAQAEGRPIREVVLRTSNGGALIAGEWLQGVIRTSGLNTIVSGHCISSCSIMQSGGVERYLAGDLPIVDSVQIHAASNSGKVIYTPSPRMTQIYTGNYGGGIDAGLLHKAMYEVVQPNGLLVFRDPARTTGASVTFDPDGSGSKLESFPGQDIYSNRVITAKGYRDPGDTLNVTANVSGDINPGYLRTGRQLQTFVDDDFARWNTNWQSSYINLAQSIYNASSNGPQGIGANSVQDYQNDPTYKALLLSKLRLGDLDVSTLDNSMGVIRVTNGATWRTSATTGADFMLVDNGTIALEGGALRASEVRVMAAGMLVGNGDVAGTAMDLSALASGTRPSWREDGFNRLRVYGTLMPRGGDLVTHGYVNIMPGGKVLFDVTENGGAGSGRLRVGSFFDSKQTDGALVISKGAFLELNVAQGYYGQDFRRDLVQGPIYQGGFEEVVRLGDTGYSASITGGEVFRPRHNSLLSFNVKQAADGLWLTANPGFDQLGLFTNGTSGDGLGRALATASDRRDGGLKSLLGALQFADRDVIAQQAGALRGDAHATLRLADNALVGSIGNVVQQHQAAMRSGGDADGLASQAAQSVSAQPGMRHGSLFNQLAMHLVEPAAGGGEGSGFGRNRGLWARGFASHGRIDADGGVAGLSHNIGGIVVGADTRVADDRVTLGVSVAAADMSTKGRDGSDFSGDVRALDVGGYLDATYSRGYLSAAVRYTDLRHDTRRSVSGIDGLQQPLRAKYSNDAISARVEHAFSFTTGKGLVIQPLLPVVDYARTSATRFNEGQGAGALVGRSGSLESIRVGAGLQLFRTFEGNNGERITPRARVVWQKELGDSQARYSTGFAAAPDLVFGASSQAVGEQVLAWNLGVTSRASERLSIMADYVGERRDGQIQNGVMLGLGYKF

SEQ ID NO: 11267 - protein, 630 aa, Stenotrophomonas maltophilia
MSLSLNRITSSILTSLLVLTSSSGLAAQSIERITINGNRNATQSPVATTANVNTLNPDDSDSTPTNLARLLHSVPGISFVGQGGLFQTVGLRGMSRWRVPTFIGDIPLYTERRAGTTASFIPPQFLESVNVIKGPSSTYYGSGALGGLVQLNPKHAHNVAASLTLTDAKYDQQTLEAGNEQWSVALSRQHAGNSEDVQGNTLYDHFDQQSALIDHHWAFDNGLESDTFYLYSNGDDIGKSSKDYPNKKIVSYPDEQHHLLQWRLTRPHDWSLSLFAHDQSLETETIRPAKRVNTVSNESLDLGGHWVKEWQGGDFNGRWGADYIARRGVKASEFERSLKNDSTSQQQNIDASQDEYALFADASTQLDSWQLVAGMRAARYQQSGEGAEDHSDTAVTGFIGAVYTRGEQQEWKINLGNAYRFPSLTEHYYSGSTGRGTIVANSDLVPEKSTTAELTLTDVYGDFAWQLAAYYSRVSDYIERVSIAEETLSYRNVDSGSIKGLEYRIDWRPSEQFTLGSTGQWIDAVSDEGDRLADAGRNELGVNMEYRWSDFSFSTGYRYLAPVKEPASGELTRDAANLVEAAMRYQITPNLSAKVWSENLTNESYFYSSDELATLARGRQFGITLSYQFQ

SEQ ID NO: 11268 - protein, 1009 aa, Stenotrophomonas maltophilia
MSRAVPRAFRPRRLAVSVLQALAVPSLLLTTAGVAWAGCNNPALTAGQTVTCDANAPNPQTVPITASGVAGITVNVANGAQLQQNGGGSAIALVGAGGHLLSNQGAISSVGGVAVQLGGGSRVENLGSISTGNTIALQFVGGGNSVLINRGTISGRTGVQFDAGNDRLEMQAGSIAGGVLQGDGNDVLQLSDGTIDSVDQGTGDDQVTVTGGTVTGVVVQGSGRDDFVMSGGTIGALQQGDNIDTFRMSGGRIIGAFEDGDQAWMTAGRVGRVNMKLDKNLWDQSGGIVEGNVVTGFDTDTIIISGTAYIGGNISVSGGADSVTITDGTVRGQVLLSTGNDIFNWRGGGIVYGAIDMGPDNDVANLGSLNHANLGAVPLFDGGSGIDQLNFNNVKTAGVGRFQNWETISLANSTELTFDGDLVLGDSGTGTGTLTVDDTSTVYAGSGGHAVRPFNSGALVEMVNAGRIDLTGTGAGDVFTVRGNYRGDGGGLYLRTVLGADNSTSDRLVIDGGTATGTTGIGVLNAGGSGAATLADGILVVQALNGATTSPGAFSLFAPVAAGAYEYFLFKGGVSSGSGENWYLRSTVVAGPAPAPNGIGVNTTPPPPTPPVAPPPPITPAPPPPPEGATDPDLTAGETAPPPPPPEPAPVAPPSDPAVPDVPVAGGSLPGIGTPPTPGARPAEGTVVPLYRVETATYAVVPPLLRETSLASLGTFHERQGEQRLLYNQGAFRTAWGRLVGQSSEIHWKGDAQPGFDGDVMGLQAGLDVWAAANDSHRNQIGVFVGRTRAQGKTTGLALGWENVQVGQNRLDDKHVGLYWTFTDSSGGYIDAVAMQSRYDGRARSSRGLGFGIKGDGTSVSVEAGKPLLHFGQSAWWLEPQVQVIWQRTSLDDRRDDVSSVRFDNDNAWTGRVGLRLAGDYQLADNGWQPYFKLNYWHGRSGEDRIRFDDDVIINSQRSRSLEAGVGVVGRFNRTISAYAVADYARELGGDRNEKRRIIEGNIGLRADW

SEQ ID NO: 11269 - protein, 735 aa, Stenotrophomonas maltophilia
MPAHTPRLKPHSLALALAALLPSVAFAAGQDTAHRDRHLTELSSVQVTASPLQGDAESLARPVEVLAGERLDEQKAGTLGDTVAKLPGVQSTFFGPGVGRPIIRGQEGPRVAVLSNGMGNMDASTVSADHATSIEPFLADQIEVLKGPATLLFGSGAIGGAVNVVDGRIARELPERPLSGRAELRGNSVNNERSGMFRLDGVSGNVVLHVDGLVRNGDDYRIPGYAVIDSLEDHHDDHDHDHAGEEGEEPRRGRLDNSSIRTRAGGVGATWLGDGGYFGVSASTYRTNYGIPNGAHVHADGDDHGHDHGHDHGDEEEGGDEHDVRIDMVQNRFETKAGIYNPVSFLKNINARVAYTDYEHVELEAGTPSTRFTNRGIEARLEAVQQQIGGWDGAFGLQFGNSDFGAKGEEAFVPDTGTKNIGLFVLQEKQFGPFKLELGGRHDQVKLDPTGDYRRRTFGATNLSAAGIWKLNDAVDLRIGVDSSERAPTNEELYAAGAHIATRSLEIGDANLKTERGQRVELGIHTHSERLDFSASVYQTRFKDFIYLADTGITEGLPVRTWTQQDAVFRGAEAEALVHLFEGGAGDWDLRLFGDYVKAKLDGSGSRNLDIAVPHGDHNHNYTVELANTGYLPRIAPARVGADLRWSKDGWRASVGAVRYSRQKDVAQNEAPSDGYTLVDAHLAYRWDRNASNSYEVFLDGSNLTNREVRPHTSLLRDYSPLPGRGVAFGIRAFF

SEQ ID NO: 11270 - protein, 700 aa, Stenotrophomonas maltophilia
MPSRAIFSTFVLSVIVAPLTQAQELKPIVYTTNAPLAHPNQTPEQYAQEMKTTEKKKDTHNNDLNIEAHSDEHEHTEQVEKIVVQATRSGRIADDQPIRVELIDREEIEEKAAMRPGNISMLVAETGGVRVQTTSPALGSANIRLQGLYGRYTQLLADGLPLYGNQASSIGLLQIPPTDLGRVEIIKGSASSLYGGSALGGVINLVSRTPGDSLNGEALLNVTTRNGQDLTSYVESPLSDDVKGSLTVGAHHQNKEDIDDDGWIDLPSYERYTARPRLFWEGENGESLYATAGFMTEQREGGTMPGAVVADGNPYEQTQDSQRIDGGLVFNMPMLDTLTLNARASAMVQDHDHTYGVLAEDDKHESYLLESSIAGYSGAADWLVGLAYQTEQFTSETYNEFDYTYEVPGIFTQLDYEWNEQLTTSVSARLDEHSEYGTQFSPRISMLYRPGDLTIRGSYGQGYFAPTPFVEEIEAAGLSRLEPLQNLEEEQAETASLDVTYRFESIEASVTAFGSNVENVTELQAFSSNNTNELDRVRLINAEGETQIRGSEVLIRYYWRDVKLTASYLYLDATEVSPDNSGRREIALTPRHSAGFVAMWEQHGNFRVGFEAYYTGPQRLNDNPYIDESNPYWHLGLMGEITVGRASWFINLENLLDVKQTDEHPLLLPSRAASGQWTTDIWSRNDGFIANAGVRVKFGS

SEQ ID NO: 11271 - protein, 1018 aa, Stenotrophomonas maltophilia
MMHTTFRTPARRLLSTALVSCLMLAAAPNVMAQSANASLRGQVSGAQAGAEVTATNVATGTVRRGTVRADGSYSLMGLDPGTYDVVANGQSQKVTVTVASTATLNFAGAASSTPGTTAATNLDTVNVVAPTLLQEVRTSEVGKTVSLQQIQTTPQVSRNFLEFADAVPGMIFTRDAKGNTSLRGGATNSDGTNVYIDGVGQKSYVKGGGVAGQSGSAGNPFPQLAIGEYKVITGNYKAEYGQVSSAAVTAATKSGTNEFKGETFYRYTNDSMRAMTPAERQPGKGKEDSAEKEYGFALGGPIVKDKAHFFVTYEAKRFDLPVTIAPHGSVTNKANRVPADAQAGLGPASQPFQQDLIFAKVDFEPTDNDRLELTFQDRDETQQQFSDQTAPMHGKETKNTDRRYALRWNHSGERYYNELMVTHEDSFNNPKPLSMGNGFNYTAPDGKNEERAIVSIGGSSAMSSQVKGQKGWSIEDNLTLDGIQWAGDHTIKMGAKYKQIDLYASDAAQINPQFYYTIDNPTFPDSIPYKAQFVKPVTGVSGVSGEVRSKVKQIGLFIQDDWQVNDHLQLNLGLRWDYEKNPSYLDFVTPPEVVNALFAQDPRAAAGQSYADTLALSGLNINDYISNGHNRKAFKNAWQPRLGFSYDINADEQHVIHGGAGRSYDRDLFDYLQLETTKLALPQPTIYFRNPATGQCFQGNAACYDWNPNLLNGIGNLQSLVGSTSNAGLEVDLLNNNLKVPYADQFSLGMSNQIGDWLTDATISRTLTYDGFAFTLGNRYPTGNFFDDPRLCGGTEAGLGQAWSCNVPGFGSLIIGQQGIKTRATQILLSAQKPFTQESGWGTSIAYTWTTARHNRDINEHYAFDRGVIGDYPTIRSNGAPRHRLVVTGSYAGFWGITFGGKITLATPTAINDWYGVPQANGFDLPTPMAAVPGGNGKFLLGGKIFGYRSVDLQATKTFKMPGDTELYARIDIINVFNFDNFSNYNYYKNGKLTASYNETGDIVGTPRQVKAEVGFRF

SEQ ID NO: 11272 - protein, 745 aa, Stenotrophomonas maltophilia
MRSGLQGIRCGSLVTLAWAVFVGCSSQLFAASVATAGGVVSIPRKADLQPVRTEARELLASPLAQAVPAASAPEPTAQRPPDDAEDLDEVTVTGERRRRYLVPDTSTATKIDTPIRDLPLSIQVVPQQVLEDRKVRNVTEAVETVSGVVDGGDLFGAPSGARIIRGFEQSGNFRNGYRDVGYYALTGVGTIEQVEVLKGPASVLFGAVEPGGLINVVTKRPLSEPYYNVAIQAGNLGYYQPSIDLSGPLNSDKTLLYRVNANYQGLDGFQNFVTTNLTTISPTVTWKLGDKTVLNLHYEYIRFFANPPESYAVLLSDGRMTPRNLYLSYPSLAFNDIVTQKYGYSLSHQFNDDWQIRNSFSVAASNTKEAQVYGTSLVSDRFVDIDAYDLKYAQDNYFGQIDLIGKFKTGSISHQLLLGFDFNRFVDVYNGYFNTDLPALDILNPNYNIPKPDYVPFFDFYQPIQSYGVYLQDQVTFLDNLKLLVGGRLDWVSQKFATGTPDAPIQNDSAFSPRIGLVYQPSESVSLYTSYSQSFNPTQGFNPDGAAFKPTKGAQYEAGIKVDFLDRRLSTTLAAYQIIKENVRTVDPNNPLFSIQVGEQRSQGIELDFAGQVLPGWKIIGSYAYTDGEVTGDNLIPAGNKLRNVPEHQASLWTTYEIPQGNLKGLGFGLGLFYVGSRAGDLPNTFTLPDYLRTDAKLYYRNSGLNAAINIRNLFDMDYVRSSFNNIFLQRGAPLTITCSIGWEL

SEQ ID NO: 11273 - protein, 766 aa, Stenotrophomonas maltophilia
MAMLCLVVTSNFAQNIEGIITSEKGEPVPFANIIVLNSLKGTATDLDGKFTLKLNSGKYQIQFSAIGFASKIKNIVVTEEKINLVITLSDQTESLGEVLVTSNKIETDLQKTPLAVTALNSKQLKEYRVWSISDLTALAPSAFTIEHGNSTGSNFLNFRGAMGFTNEQSVATYVDGVYQFDFYSAPLNFNNIDRVEILRGPQGTLYGRNAFGGVLNVITKKPTNKTTGFVEVDFGNYQQQRYSLGFNTPLIQDKLFVNTGLQLNKRGAVYENPTLDTKDFDGKEGYSGNLNMKYIVSDKWTLDFTSRYENNKDKGAYPWVATDSIALNEPYKAFGNYDNIEKRTNFNASIAAKYYGETFNFTSITAFLDYKNWFEDKYDFDFTASKLISGDTWNKQNQITQEFRFTSPANESKLNWTVGSYLFLDKSKSKYTTYYEEDFTLFDSTAPYSTITNGVKDNMGIAFFGQANYALTPKLDVTLGARYDMEHRKLTQNSSYEKDDVVTILSTDSSDDKTFYAFTPKFILNYQLTDNSILYGSYAKGFRIGGFNFGNDTNPTYDPERSDNYDIGIKNNLWNNKLKLNVTAFYFQQKDQQLTNTTDGAVYATQNIGDMDNYGLEIEIAVLPIKNLQIDWTASTSHSEYKKLELFDFNTFTTIDYKGNKAIYTPEYQSMIAAQYSVSFPKSNQNLKAFVRTEFKYIGEYQLDFENSNSQEAFSMLNTRFGISSNHIDLAFWVRNLTDKRYLSWGYGSYMLGSPRMWGATLTTKL

SEQ ID NO: 11274 - protein, 776 aa, Stenotrophomonas maltophilia
MPSHSDSRRLSGLSSSFVSFRRHPLALACAGLALVGSFGAAAQDSAPTPTGLDTITVTAEHREQNLQEVPVSVGVVQGERMRDFTAGGDDTLLALSGRVPSLYAETTTGRIFPRFYIRGLGNIDFYLGASQPVSIIQDDVVLEHVVLKSNPVYDVDQVEVLRGPQGSLFGRNTTAGIVKFDTLKPTQDYTGRVSASYATYNSVSIDGGFGGPINDIASFRVSALYQHRDDYVDNTYKGPSADGTVSPKKNAMGGFDDRNVRAQLLLTPSDQFSILASAHARDYEGTSTLFLRGALTKGSNKTDVPRDKVAYDEADNNPQAYKTYGGSVKARYDFGAIDFTSITAYETTSGYSRGDTDGGAAVNFPVNGVPNGYGQSMGRIRDLDQWTQEFRLASHDDSALQWQAGAFYFNGSDTTDFYQRAWFLQGAARNPNNWVRLRNKNTSWAGFGQISYAFTDKFTVTAGLRQTKDEKHTRLLKTADTAAGVVTYKGRTDVRMSDTTPSWDLSAMYQITPDVSVYAKVARGFRGPTIQGRSAVFNADFTTADSETILSWEAGVKSSLWDNRLRLNATAFTYTVNDIQLNGNDSDGNGVLFNADKAKAYGFEADMELRPIPNLTLSAGLSLLHSEIKDKRVYAQVCGLNGQVVCTVNDPTIKVGANTFAQIDGNPLPNAPKYNVNLAARYDFPVSDAGTMFVSTDWNKQGYTSFVLYDSKEFNSKGDFEGGLKIGYSGNYGAYEVALFARNITNEKNLKGVIENYMAAVYNEPRTVGVSLNMNW

SEQ ID NO: 11275 - protein, 687 aa, Stenotrophomonas maltophilia
MTHPLKFPSRPCALHQIAAAGLLGLAAIPQAGAQQATDASPSLQPVEVKGQTARGASAAYTTTVIEAEDIANAHVSHPQELLRQVPGMNVQNYQLSGVGDAIVMRGFGGGGHGGDVGVVLDGIPLNEAMSHADGYVDLGVIVPLEMERISIYKGPVSALYGNFNRAGLMAIETRKQGDYTPYREADVSLASHGTLDAQAALGLKPGDGEFLNLAAQHYRTDGFRAQSQMQRSTASLRWSKRLSSQLEVALSARLHHGEGDSPSYLTAGQFARDPHGIDPRAMNDGTRKNFATLRADVQYALSPRLTWLGYAYTTQQSFTRWFSRPIDALQWRQREESYDRAVYGAGTSLNGRHVTALTPLNWVAGLEAVRESTDYQFYDGLQWRERTGAAIDDRNSRLNTLSAFAEVDAPIHRLLQLSAGLRWDRFTGGCRPNGPETGSDPCGPLARTSHASPKLGLRSQVAPGVLLRASWSEGFALASDFAKYALGAARLDPNIFRQTEVGAQIKPMPGLVLDVAAYRLQSSGEIRNVAPGVYENFGATRRTGVETSALWAVRKNLDLQLAWGSAHSRVTENGNPALVGNQVAGVPRQTATVGLAWRPLAQWEGTLTWRRVGRYAVTADNSVFYGGYATWDLGLSWRLPSARSRIYAVVSNLGDKAYATSASVIRGVPLFAPGAPRTLKVGVQTQF

SEQ ID NO: 11276 - protein, 88 aa, Stenotrophomonas maltophilia
MNYTTFFDESFNGTGTNAGLSDLKLDDSWGLAANVGFDYMLNDSWFLNASVWYANIETTATYKAGADAKSTDVEINPWVFMIAGGYKF

SEQ ID NO: 11277 - protein, 823 aa, Stenotrophomonas maltophilia
MINRKRLFWATTAIVGTLAAAGAASAQSTGTQATEVDEIVVTGARGPRSIDGAIVAENVGKSRSTITQEYIATQAAGQSINEVLNLVPGMNFTNNDPYGSSGGNIRLHGFDGNRIAQTFDGMPLNDSGNYALYTNQQLDSELIDRATVNTGTTDADSPSASATGGTINISSITPTEEFGGWVKGSLGDFNYKRVMGLVNTGAVGPWGTRAWLAYSDQSYDKFKGIGDLGKIQYNAKVYQPIRDNGDFVSLAAHWNRNRNNNYNGPNLFRNADGSLGSTADTSPFGWNVDFVPTYTAPTFRNGFADVDSNGTSYWGLRVNPSDTGNLRGQSRFTLAEGLIFTFDPSFQYVLANGGSQQTTLTETNAVLRGSKTTGGVDLNGDGDTLDTVRVMAPSNTHTQRYGINSSLIWNVNDDHSLRLAYTLDWARHRQTGAYGTIDFSNPSEPRFSNYFGGRNGETITNLDGYDLRGRDRLSYAELNQVAFEYRGKFIDDHLRLSLGVRAPFFKRDMNQNCYSAKGSSSVACTTQTTTVSPNSTSKYTYYRIGTSTTDYIAPYSREKTFDDILPNLNAVWRFDGASSVYFSYAESLTLPRTDNLYTVLYNTNGELISPILDPETSKTYDAGYRYQTGTLIASANVWYTQFQNRILSAYDPETNISTDRNVGDVDMMGFDAQLGYSPIESLSFYASASYNDSEIQDDYRRSSSSVIPVGGKSLVETPDWTFVLSAKYETGPLSAGIQAKYVGERWLTDVNDLAVPSYTVVNADARFDLGYFGFEGTDIQINVTNLLDEEYFGSLGTGLDANSSLYANQGPPRTIQASVRYAF

SEQ ID NO: 11278 - protein, 751 aa, Stenotrophomonas maltophilia
MTSRRCDSITGSRLIATVLLATAGATSVAAAAEQPAALEEVIVTAQKREQSLQDVPVSISVISGQRIQDMQITDLRSLQGYIPNLAILNSGVNPIVYIRGFGSGPNNVAFDQEVSVYLDGIYGGRSAQFTAPFFDLERMEVLRGPQGALFGKNTAAGAISLVSAGPTNELQGSATAAYNFDRDGWEGSAFVSGPISDTLGARLAVKVVDQDGFLKNLATGRDDPQLQQTLARLTVAWRPNADFDLTAKAEYGKHDLDGGVTHSGSLTGPTRFTDTHYVSDPYGPAPLSDGSGITSWNLAATANYRLGEHTLTSVTGYSAFRTNRLTAFDEFNPDRTVQPNGGNALFANGFPEDFEQYSQELRIASPTGRRLEYILGLYYDYSDYHLINTTYYERVAGTITGSHRNDFYQIGRTYSAFGQATFHATDALRVVGSLRWSQTNKKGDFKSRLVSGSRLNAQGAAYGKLEEDYTDPSVTVQFDAAERVMLYATLARGSKSGGFVSNTSTTTDASFQFRPERSTNYEAGVKSTWLDGRLTVNAAIFHMKFEDLQQSTYDPDVRTFFTRNAAKASSEGVELDVQWLPVDNLQVSLGLAYLDAKFDDYPGAPCLAFETVAQCNSADPASLANHNIAGQPLLFAPKWSGNAGVRHTLDLGGDLRVTSSLTALFRSKYFIADGYSPIWGVQDGWTKWDARIQVGPVDGRWNVALVGRNLTDEKTVGQAIRLPAPITTTSRSINWMDEYRSIAIEGTFRFF

SEQ ID NO: 11279 - protein, 365 aa, Stenotrophomonas maltophilia
MNNWKWLAPLLSAAAATPAFAQSSVVLYGRIDTAIEFANMGPRHVARIGGGNLLATQWGLKGVEDLGGGYSTIFKLENGFNSANGTLGNGGALFGREAWVGITGPFGGLQAGELYTILHTTFVTYSLPGYGAGLAWGNASNSFVGPAFLRTHNGLRYTSPRIGEFLLRASASRGTNGASGQPSSLGDTYGVGLNYARGPLSLDVDYMVQRFSAASAASLSATSPVAAGNYVLGGFSYDFAFMKLALLYMRHRGGPDVAAVVDGASAYPHHDLYELDATVPLGRASLLVSYGHYRKIGDSEGNADSYGVRLDYPLSKRTVLYTGAAMVRNGAHATFTVNGAAGGGVPVAKPGATASSIVAGVMTSF

SEQ ID NO: 11280 - protein, 332 aa, Stenotrophomonas maltophilia
MSPTIYDIARVAGVSKSTVSRVLNKQTNISPEAREKVLRAIEELQYQPNKLARALTSSGFDAIMVISTRSTKTTAGNPFFSEVLHAITAKAEEEGFDVILQTSHNPAEDLQKCESKIKQKMIKGIIMLSSPADESFFAQLDKYDIPVVVIGKVEGQYAHVYSVDTDNFGDSIALTDALIESGHQNIACLHAPLDVHVSVDRVNGYKQSLAAHNIAVRDEWIVDGGYTHETALKAARQLLSQSPLPEAVFATDSLKLMSIYRAAAEKNIAIPQQLAVVGYSNETLSFILTPAPGGIDVPTQELGQQSCELLFRLISGKPSPQNITVATHMTLK

SEQ ID NO: 11281 - protein, 929 aa, Stenotrophomonas maltophilia
MRRHLIHFLLVAVLTVCSAATAIAQVTVKGQVVDAETGEPLIGAAVTIVGTTQGSVTNLDGMFTQKAASGSTLLIKYLGYKEFSKKITQKGGTEDLGVIKMAADAMVLNDVIITSSVAVSRKTPVAVSTVDPVFIEEKLGTQEFPEVLKSTPGIYATKQGGGFGDSKVNIRGFKTENSAMMINGVPMNDMEWGGIYWSNWAGLSDVTRSMQVQRGLGASKVAAPSVGGSINIVTNTIDANKGGFVSYGMGNDGLNKILFKVSTGLTKSGWAMTLLGGKTWADGYIQGTNYEAYNWFVNITKRFNDNHQLSFTAFAAPQWHNQRGNKDGLTIEGWQEVAKNYMNGEKPYRYNPTYGFGLNGQRKSSAYNVYNKPQLSLNHLWQINEKSSLSTALYASIGRGYGYSGQGLTSADRSNWYGSNNGNLNMTFRKADGTFAYDEIYALNEASENGSVMAMSKSKNFHNWYGLLSTYTTKFGDYFDFYGGIDYRYYKGTHTNELVDLYGGDFYVDSSSRKSVLASNNAAAAAGSSFVNQKLKVGDIVYRDFDGYVMSEGVFAQGEYNRDKLSAFISGSVSNTGYWRYDRFYYDKAHAKSKTVNFIGWNAKGGLNYNLTENHNVFANIGYISRAPFFSGGAFLNSTVSNATNPDAVNEKVFSFEIGYGYRSSFLTVNINAYHTRWMDKTTTRSQDITNYYEGSLSEPYDASKLVSTKSVINMQGVNALHQGVELDFVAKPFQWLDLSGMFSIGNWRWDSNASGSFTVEGQFVNSASIKGSDGKDVTVLVNAAANGLEPGTMKLNLKDVKVGGSAQTTAALGATFKIDKALRLGIDWNLYARNYADWSLNSNDLVMNSEKDFSTPWRIPTASTFDLNASYKFNFGKLNAVLSGNVNNLFDQTYISDATDGSNHDWKTAYNVFYGFGRTYSLRLKVNF

SEQ ID NO: 11282 - protein, 754 aa, Stenotrophomonas maltophilia
MPACFLSSLLAFERFFIMYQQKLPLAIASILCGLGFSGSGLAADSVPPAVVKAAQPKAAVAKTSQQTEEVLVTGSYTTRSMNGATGLDMTLRETPQTVTIMTSQMIEDKGLVDMEQVLDHVPGISKVGDASEYSLMYVRGFQLDTGVQVDGLITTPANATYSGDVSQSIDPMLAERIEVLKGAAGILGGQGEPSATVNMIRKRPTRDFQASLQAAAGSWNNWRMEGDVSGALNDSGSVRGRFLGAYSDGDSYIDRYSREKKVLYGILEADVSEQTLLSLVIDNTEVNASGVYNWSSNPAFYTDGSLIDHDVSFSTGQKWAYRNIKQWSIAPEVKHDFGNGWIVRSAYRYSNATQDVSNASFGNYIDKETGSYVGGWNTPNSLYSDRESDTDSVNLMVNGDFSFLERNHDLVFGYSYSRNEFDLGFDYAAVDPLNFYTNTTPAAPDYSNAFNSSFTRETGTQSGVFGTVRFSIADPLKLMLGGRVSDWSYKSVDLLNGGDAVYVSKDNVVTPYAGIVYDVNEFLSLYTSYTGIFKPVSQYGADGNILEPTEGTNTEAGIKMAFFDNDLNISAAVYRANKDNVAQWADLGQLPNGNWIYESIDGIKTDGYEIEIAGSLSEQWNISGGFTYNKAEDKDGNVRDTYIPGKMFKITNTYRFVGAWEGLTLGGSARWQSDSYYESSIAADVSATGERINVRQDQPAYWLVDVMARYNLNEAFSVSLNIDNLFDEFYNRSMWGYADFGEPRSVTVSGKYRF

SEQ ID NO: 11283 - protein, 247 aa, Stenotrophomonas maltophilia
MNISNSQVNRLRHFVRAGLRSLFRPEPQTAVEWADANYYLPKESAYQEGRWETLPFQRAIMNAMGSDYIREVNVVKSARVGYSKMLLGVYAYFIEHKQRNTLIPAGFVAVFNSDESSWHLVEDHRGKTVYDVASGDALFISELGPLPENVTWLSPEGEFQKWNGTAWVKDAEAEKLFRIREAEETKNSLMQVASEHIAPLQDAVDLEIATEEETSLLEAWKKYRVLLNRVDTSTAPDIEWPTNPVRE

SEQ ID NO: 11284 - protein, 337 aa, Stenotrophomonas maltophilia
MRNTLVASAFTMLSIATASAQLTIPKEYLPEVHGTIRGKYEVQTTNGMQRFQVRNARVSLDGKVLPVIAYKAEIDLSDEGSIKMLDAYARFVPNDTWNVTLGQMRVPFTIDAHRSPHQQYFANRSFIAKQVGNVRDVGATGAFSLKKGLPLKLEGGLFNGSGLTNQKEWHNTLNYSVKLQLMPWKNYNLTLSTQKIHPDKISIYMYDIGTYYEFDNWHIEAEYLYKTYAKNSFDDVHAFNAFVNYDLFIKKGLFRKISFLGRYDSMGDHSNGNADEDGKLYITDYSRQRVTGGVTLSFGKAFQADLRLNYEKYFYDKLSLAKESEQDKFVMELMVRF

SEQ ID NO: 11285 - protein, 758 aa, Stenotrophomonas maltophilia
MRTHKIATLALAVSAAFSSSVLAQEAATTEKKEASLEQITVTAQKRTQSIQEVPISVATLSGEKFESLFSGGEDILALAVRVPGLYAESSNGRVAPRFYIRGLGNTDFDLAASQPVSIIMDEVVMENVVLKSFPLFDVQQVEVLRGPQGTLFGRNTTAGIIKFDTVKPTQDLEGYAKAGFGSYGTMNFEGAISGGLTDELSARLSLLSQERDDYIDNAFTGENDAIGGYDEKAYRLQLLWEPSADFSALLNVHGRELEGTASIFRANVFDKGSNELNANYDRETVYYDGDLQGDGIDNNPQEYDGFGASLKLEYDMDEVTFTSISALETADGSSLGDVDGGFNLADGTSGPGFIPFSAVTQDNLDDLEQYTQEFRLSSNSRDALNWQVGAFYYDASFNVTSIDGYFGATTVFHDNQTWAVFGQTSYQVNEKLNVTGGIRYTHDSKSLVVGDQNVDGFALVTGDALIQDYDDIDVDDGQTSFELSANYRVTDDMSLFARYANGFRAQTIQGRDVAFEGAPSVADAETINSFEVGIKSDLFDDSLRLNAAAFYYTVDDMQFSAIGGGNNFTALVNADKGEAYGFEVDAQWLATDELTFTAGYSYNHTEIKDDTLTVSPCGTNPVFGSTGNCTVTDPRPDGFVASIDGNPFPQAPESIFNFTARYTIPMGDDGEFFVFTDWAFQGETNIFLYEAVEFTTEDNFEGGLRIGYENFAHNYTVALFGRNITDEDNVKGAIDFNNLTGIVNEPRVWGVEFKYTYY

SEQ ID NO: 11286 - protein, 721 aa, Stenotrophomonas maltophilia
MSSVNTLSRLAVAIALGVPLSSVLADEGSKELGTLTVVGDWLGEADQAVVQNHPGARSVVRRKDMVESGAQNVRDVLRKVPGVQVQDNNGTGGSDISLNVGVRGLTSRLSPRSTVMIDGVPAAVAPYGQPQLSMMPLSIGNLESIDVVRGAGSVRYGPQNVGGVINFVTRAIPEKLSGEVGTTLEHAGHGGWKKLNQAFLGGTADNGLGVALLYSGVKGADYRDGNNDNDIDDVLLKTHWQLTDSDQLAANFHYYDAYADMPGGLTQAQYDDDPYQSLRDWDNFRGRRKDFSLKYIRQVDDLTRFELLTYYSDSFRGSRIAARNLRTITSYPRDYHVFAVEPRVSRIFFAGPTTQEVSVGYRYLKEAMNERASQLALVDNVPTVRPGADGHTYQDRTGGTEASAFYIDDRIDVGNWTITPGIRFEKIDSDWRERPVLGLNGRPVQEKKRSKDYNEPLPALSLMYHLSDEWKLFANYSESFGSLQYFQLGQGGSGNDTAAGLEPEKAKTYELGTRYDNGSWGGEITLFYIDFDDELQYVSNDVGWTNLGATKHQGIETSGHYDFAALDPRLDGLSVYGSLTYTRATYEGDLPSFKGRDLPLYSRRVATAGLRYEVERWTYNLDAFAQSMQRAPGLSTDSQGNFTHNYITEPSGDGQYGDIPGYVTWNARVGYDFGPQASNLKLGLGVKNLFDKQYFTRSSDNNSGIYVGQPRTLFMQASVGF

SEQ ID NO: 11287 - protein, 678 aa, Stenotrophomonas maltophilia
MKHPFVILSLCNALVMPHIIDSTAHADQNETTAQPDQQSTETKSADTTLDRMVVTATRIQESTLDIPASVQVITQEEIRTSSARDAGELMAEAGIGHVHKYNGAQTGNVEIRGLSTDLFTESSSRVLLLVNGNRAGTTNMAKIPASEIERIEIVKGPGSVLYGSQAMGGVINIITKRGTEEGVHGSIGAEGGSWGYWKSGGDIHGKKYGIDYFISGAASASDDYRTPKGSYDNNAYESEELSTRLGYSFLNDHRVSVGFQRWVGRDLGSPGAVYAKDPDDYSKKARNSFDFEYTNKTATLKYYINNNKDDSYSTGGMGMPGPGNADRFTSNNRSQGVSIQNVFPIGVHRIIIGGQWDRNSVDTSSSSGAPYYPDSRYDNYAAFAEGRLSLLKEKLLLTAGVRYDYFDNNTLSTKGLTSTPVSRSMDHVTGRGGIVYKITDGLSLKAAIGTAFRAPSPRELASDYTLYGYRTLGNRDLGPEKSTTYEGGVEYAKDHLKGGFTFFHTSFSHKIASYYDSALGATSYKNLSSATIQGIEMNAAYDVGLAAGLDISVQPFANVTYKTRYDGESKDSASHGHLLNVPEWTGAFGVKAGQEKWDAKLIINYSGNEYITDYSASYPYPVVNKGGFMTMDIKGAIRPLKNLELTLAVENLLDRYYEYINGYPMRGRTFVGGARWIF

SEQ ID NO: 11288 - protein, 948 aa, Stenotrophomonas maltophilia
MERTMMVRSVLATALAMALTACGGGGGGGSNVRVDPPPTTPTPPTTPPPTTPPPAKPQEPAFDAHLSVTNARAAQAAGLTGQGVRIGIVDSGVQRNAVALNGRVLANFNYIDPARNNLAVDDVVGHGTAVASLAAGAAVGTWPGGIAPGAQIVSARIISDKPPTDDGSGQGNAFSGPLGVAQVHQDLISYNVKVMNNSWGGLYWTDLPTTAQVAAEYRPFVINHGGLVVFAAGNDGRSEPSSLAALPSQKGVAGTLPAADLERGWLVATAVDPFTPGALASYSNACGQAARYCLAAPGSAVYPDANGGSYYWNYGTSFAAPLVSGAAALVWQRFPYFNNDLVRQTLLGTAKDIGAPGVDPVFGYGLLDIGRAINGPGRFDWGDVVANVDAGSTNSMWSNDITGSGGLVKQGGGKLVLAGNNSYSGATRIERGILTLQNGGVIRSNVTILAQPDPDSTGLQFNGGTPRVIGNVVNGGSVFLTTGNTTGTIEGNYTQQPGAQLMIALGANALQVTGNATINGGVRVHGFVSGYVPQNGTRQDLIHAAGGLNGTFSTQATSTGLQGLTLVAPTYGYDSNNAWLNVNQVSVTAAASGLSASAQAAAQRLEGAFAVLDGNTGLQGSPFGTAAGALQWAGGGQQGLADSLQSLSGQAHARAEAATFDSIDMSRRAIAERFDRVQATPRLRGSWQSALGEAGQGSFAGNAADSRGWMAGQDLPLGGNGLMGVAFGETRSNGGSSFGGDRGRDRQAQAQLYAGWSLGRGYALAQFGSGQFTRALDRQLLLGAGAYGVSARYGGRFSSASVEGGYRLGRAGASLTPYLGASTTRVDTDAFNELGGFGFGLRGDATRAQRSQMLAGVRGERGWGRWNLRGHAEWQQRLDGGDADWQASFVGVDAWAPLAGWNAPRGSALIGVALESWWGRNGRLSLGFDQRIGGEGARQAALRYSTGF

SEQ ID NO: 11289 - protein, 450 aa, Stenotrophomonas maltophilia
MRHSLTAALLATSILCLPSTARAQTMTAEEAAALRAELAALKAQVATLESRLDAATGQPAPAAQPKSPSVAAKPASEIGWKGAPEIRTADGWSFKPRGRMQVDLAAVDTPVGATDARGGLKTEFRRIYLGVDGKIPGGFAYRVEADVANNSVELTDVYLTYGTGPLSVTAGQIKPFWSLDEMTSDLFTSFMERAAFAQAFGFERRVGLSAQYRRGDLLLQAGVFGDNAGDLLDDSNNAVSLDGRVVWMPKLGDTQLHLAASGHWRDPNDPAALGRYRARPFAHTTDVRLVDTGLIDVASERGIGLEGAVIAGPFHAAGEGYWHRVNRTGPADPTFFGGYAEVGMVLTPGDRRGYKDGGFDRLKPTKPITAGGVGAFEVNARYDHLDLNDGGIVGGRQQAALISLVWAPVDYIRINANYGKLWVGDARVATATGDRDYTADTFGLRTQVDF

SEQ ID NO: 11290 - protein, 842 aa, Stenotrophomonas maltophilia
MKTSSFIIVILLCFRIENVIAHTFSFDASLLNHGSGGIDLTLLEKGGQLPGIYPVDIILNGSRIDSRDIFFYTKKNRHGEYYLKPCLTRDILINYGVKTEEYPNLFRQNSEKNRDSSDCADLSVIPQATEDYHFIKQQLILGIPQVAIRPPLTGIAHETMWDDGISAFLLNWQVEGSHWEYRSNTRNSSDNFWASLEPGINLGSWRIRNLTTWNKSSGQSGKWESSYIRVERGLNNIKSRLTFGDDYTPSDIFDSVPFRGGMLGSDENMVPYNQREFAPVVRGIARTQARIEVRQNGYLIQSRIVSPGAFALTDLPVTGNGGDLQVWVLESDGTIQTFNVPFTTPAIALREGYLKYNVTVGEYRPSDDSIEGAYLGQLTAMYGLPWSLTAFGGIQVSEHYQGNALGLGLSLGGFGSISLDTIYSRGQQKGYSNEIGKTWRVRYDKSFELTGTSFAAGYQDSSAGYHSLADVLDTYRNGTAYRSYDNRIRRTTINISQALGEWGSVALNGGRDEYRDKVKQDYIGASYSNSWKGITFAVNWSRNNNIGDYYSNSLRTENNLNLWMSIPMKRWLGGDDKGVTATAQIQRITGQNTLYETGLNGRAFGQKLYWDIREQIVPGSKYDADTSLLNLRWSGGYGELTGMYSYNRNTRQMNVGTSGSMAIHSGGIAFGQKTDDTMALIAAPGIAGASVGGWPGVSTDFRGYTLVGHVSPYQENIITLDPTTFPDNTEVSQTDRRVIPTKGALVQAEFKTRVGNRALVTLTRKDGTLLPFGTVVTLERKTGEAFESAGVVDDKGKVYLSGLSEAGKLKAQWGTNSQCYADYKLPLKKGMSGIFLTRAVCM

SEQ ID NO: 11291 - protein, 992 aa, Stenotrophomonas maltophilia
MHIFTFNVKLNLLLMLFLLTTATLKAQQPVTVTGTVKAVSDRIGIPGVSILLKGTNVGVVTGPGGEFSLKVPGGTGILQFSFVGYKTQELSIPASHILNVSLADDAAALSEVIVVGYGTVRKQDLTGSVAVVSAKDFQKGSITTPEQMLSGKVSGVAITSNSGQPGSGSTIRIRGGSSLSASNDPLIVIDGVLLENNAVGGASNPLSFINPNDIESFTVLKDASAAAIYGARASNGVLIITTKKGLSGDLKVGFSAVNSITKLTKQVDVLRADQLRDIVNTLGTTTQKEQLGGFDTNWQDMIYQDGFASDNNLSISGGLKDFPYRLSLGYQNQSGVLRTDKLEKTSMAFVLNPTFFDKHLKLDINLKGSAQKTRFANQAAIGAAVSFDPTQAVYTNRSEYNGYWEWLDPTSPSGLVNLVGRNPLGLLKQREDRSNPYRSIGNVQLDYKFHFLPELRANLNLGYDAAIGKGTVFVDQDAAELINRRGVSTQYKQNRMNTLADFYLNYVKEFASIKSRVDATAGYSYNDYQTKFFNYADFDATGTKIANTDPDFPYNTPQNRLISYFARVNYSYDDRFLLTGTIRRDGSSRFGPSYKYGYFPSVALAWTMKNESFLKDNQLISALKLRASYGITGQQEGIVNYGYLSTYGLSTPNASYQFGDTFYQMYRPTAYIPDIKWEETATTNIGIDAGILDNRITGSVDYYRRKTSDLLNQVPQPAGTNFSATAIINVGDMTNEGVEMNLNFVPVRRDDFNWDFSINATYNKNTITNLTVIPNDPNYRGFPGGTIAGGVGGQNAFINAVGSPKSTFNLLQQVYDQSGNPIEGVYIDQNGDGLISENDFTKGKSADPKVFLGFSNNLGYKKWNLSFTLRANLGNYLYNNSFSQRGNLAQILGTAVINNASPNYLTTGFREQQLLSDYYVENASFLRMDNINLGYKLGTFLKNKANLQLNASVQNVFVITKYQGLDPEVPSGVDNNLYPRPRVFSLGLNLNY

SEQ ID NO: 11292 - protein, 182 aa, Stenotrophomonas maltophilia
MKLNSLLTAGMLLAATTPALAAEDLGFYLGGQVNHTSVEDNIGTLDESAIGLGIYGGYNFNDSFGIETSIFLTDSLVDEMDLRIAAVTISPVIRHAFTDSVTGYLKAGLVVNKTYSNDDGVDEDYRGTGWLFGAGVDVTLTESLALRVSYEMSETEPEYSELENYYADISLKQFGVGLHYRF

SEQ ID NO: 11293 - protein, 519 aa, Stenotrophomonas maltophilia
MNRATPCRGAVRALALALLGAGMWTLSPASTWALELPPPLTDEELRLVLPTGGMSLDDFKRGLEQAAPGSVATPAPPLPKVPVPGPAPGASPGAGSSPPGGSDVPGGASSSPGEKPPAVADQGKGQGNGAGGGQPPQAGAGGANGLPPGGADPKPPAAAGGDAGPKPPEGDGGDEGPQRPQGGGEQGGGEQDAPEVPPVAPAPPADNGVYEPGTHTLSAPASAAVSLASSSHGVWQAEMNALSKRMGELRLTPVAGGVWGRAFGRRQDVDNRVAREFRQTISGFELGADTALPVADGRWHVGAVAGYTNGRIKFDRGGTGDDDSVHVGAYATYIEDGGFYMDGIVRVSRIRHAFKVDDAKGRRVRGQYRGNGVGASLELGKRFTWPGAWYVEPQLEVAAFRAQGADYTASNGLRIKDDGTNSMLGRLGLHVGRQFDLGDGRVVQPYMKLSWVQEFDGKGTVRTNGVRHKNRLDGGRAELDLGVAAQLGKHGSLYGSYEYAKGSRQTMPWTFHIGYRYAW

SEQ ID NO: 11294 - protein, 439 aa, Stenotrophomonas maltophilia
MPAASSRADVAGLAPPADVGARARYSQTASQNNGFTARRHTTMNKQLIAAPLLLSLAGVAAAQSSVTLYGIVDAGVTYRSNERVGSAGAYTGHSSVGLTTGNLSGSRWGIKGSEDLGGGMRALFVLENGFDITNGTSGQGGRQFGRQAFVGVGSDRYGTVTLGRQYTSLDDFVSPVGPSSFIGGFGAHPGDIDDLDQTARVDSSIKYTSANYSGFTFGALYGFGGQPGSMKQRNTWSVGAAYAAGPLRVGVGYERSDNSKKGATDPTAGKWQSTDDGLFNSSINEGYASAQSQQVIATGATYDFGPAVVGVNYSNVQYRGGAQSLFSGHATFNVAGVFTRWNVQPQTQLFAGYSYTRGSDVDGIDNRAQYHNVTLGAVYDLSKRTSVYLLGAYQHASGTTLDALGRPVDATASVSDKANGHSSDSRSQAIVSLGLRQKF

SEQ ID NO: 11295 - protein, 363 aa, Stenotrophomonas maltophilia
MTRKTLLALAACTIPAAAFAQSSVTMFGLLDAGISYVSNEGGHGNAKFDDNIFFPNLLGFEGKEDLGAGTRAIFRLVNQFSLANGSMIGGGLFARTAYVGLQNDRYGTLTLGNQYEFMVDSLAASGNEVAQDLVGLYGFRNGPFDKLALPNNPTGAFDWDRVAGSNRVANSVKYTSASIAGLTFGALYGFGNVAGSVGANNTVSVGASYDNGPFGVGAAYTNQKYGAADGRPATTVRNWGAGAHYTLGTVTAKALFTTVHNAWNGAGAWSTEAGAAWHPSPVWVIGASYTYMKGNDTLENAHAHQLLAAVQHWLSKRTMVYVAGVHQRASRGSHAQINGVMDANGASSGAQQSVARIGFSTRF

SEQ ID NO: 11296 - protein, 611 aa, Stenotrophomonas maltophilia
MSIRGFGARSSFGVRGVRLYVDGIPGTMPDGQGQTSNIDIASADRVEVLRGPFSALYGNSSGGVVQVFTEEGSRPPQLVADISAGSYGTRRYGLRASGATESALGLIDYNVSASHFTTGGYRDHSAARKNLGNVKLGVQLDDASRLTIVANGVDLTAQDPLGLTRSQFESNPRIAAIQAKTFNTRKTIQQTQGGLVYERDIDANHSLRAMLYYGQRNTVQYQAIPVAAQQPPGSAGGMIDLARSYGGADLRWTSRLSVADRPLTLIAGLSYDSMVEQRKGYENYTGSLNAPTLGERGNLRRNETNRVYNLDPYLQMSLQASPQWAVDAGLRYSTVSFDSSDHYIVSGNPDDSGNLRYRKALPVAALRYTPAKNTMLYASYGRGFETPTLNELSYRPDAQPGMNFGLDPALSDNFELGAKKEVAGGLLTVAIFRSDTQDEIVPATSLGGRTSYRNAGRTRRDGVELGWNARFAGDARVQLSYSWLDARYRESVSDAIRAGHRIPGTARQAAYATVAWEPREGWQAGIEGRYLGSVAINDANSDAAPAYFVAALSAGYVWRAGSWQGRVYARADNLFDRRYAGSIIVNEGNGRYFEPAPGRNWSAGIGATYTF

SEQ ID NO: 11297 - protein, 1010 aa, Stenotrophomonas maltophilia
MSLKSSKNNKMRSGQFALSPVAKWVRTAAIAGVASSCVFSAHAQQEQAKATEVEPDVEIISVTGTRRTIQDQIAIKREATTVVDGLSSEDIGDLPALSIGEALESITGAASHRENGGATEITIRGLGPFLSATHINGREATNGSGDRSVNFSQFPSELVKKVAIYKTQDASMIEGGVAGVIALETVTPLDYGKQRLQGEVKLNYNPDESNVDNSLQSDLGYRGTFSYVDQFEFDNGQAVGFSFGVQRQDISQPEAEYRSSSPSGSSLWACLNDPTNTNEGFYRSSAGDCEDQVNGSNNQGYDTEIDPDTGKAVSDGTPYAWTGSSRSFRQNETSDERDAVFFAFQYQPSAEWDINFDSQISDRTQREARHDLIFLQKRATPGVTGPSLVTNDVGGILHWEGEERIESAGEQFSREENYRGYGLNIEHTVNDRLTIDLDLAYSKTSREELQISNRGRTAGRNFFSWDMGDNIPHFTLTDFDVTDISNFTDSLRTRIDRENVRDNKVVSARLDFNYLVDSGMFTTIQGGVRTSELSFTQFGGTNGNGSRNQFTLGSGAEALDVLQGCQIDFPESGFLSSVSDGNIITHVDSDGNVVDTGTGSSWATYDNECFSQAVVASNEGGVFEYPEVEYQNAGTIDVTEKTTAAYLMANYDTEMFGKFIRGNFGLRIVDTEVTSIGFRNSFDVVTSDTGVLSLVESDTGTLDKIKGGGDYTKFLPSFNLVVDYSEDILLRAGIYRGMSRADPSDLGYSRSFQQDTSDTATTISDLLVGVNGSGNPDTQPLMSWNYDAAFEWYPNEDSIFALSLYYKQFQGGFQQRTVIEDFVVGGETVSLPITNSVTNDEESEILGLETSFSYRWDNGIGVKFGYNYADTDFEFEDSLYGDTFVTDVDGNTTQLKEGIVEPGSVPGFSKHVFSSQLYYQIGGFDTAVIYKYRSEYFQPYTSNGTRLRYVDSVGVWEMRASYKINKHFRVKAEAINLFSAPKSQDFFVEDNLGEVNDYGPRLFLGLSYKL

SEQ ID NO: 11298 - protein, 369 aa, Stenotrophomonas maltophilia
MQTARTAAGLVGGRHIAMIEGGSAGLQGSRWGLKGSEDLGGGLKALFVLESGFYSNNGVLNQGGAMFGRQAYVGLSHSIGTVTLGRQYDPVVDFYGPFLAAPQWGGYMTSHPGDLDNALNSRRINNSIKFRSASYRGLTVEAMMSLGGTAGSFPTNWIWGAGTSYAAGPFSFGAGYLNVRNPNTSFFGANPNAGPATSNNLGSAGSATSPESNPVFAGYASANRLEIAGVGAGVTLAALSVNLAYSNTRFEGLGSASGPNALRYAGTAAFNNVEINARYQFTPSLLAGVAYDYTRNGGAGGKGGANYNLVSAGVDYFLSKRTDVYTVAVFEKASGTDSLGQPAVAQITGLTPSATDRQVSLRIGLRHKF

SEQ ID NO: 11299 - protein, 366 aa, Stenotrophomonas maltophilia
MAQSSVTLYGMLDAGIGYTSNINGHSRFGLDGGAAGSNKWGLRGQEDLGGGLQAVFKIENGFNIATGGIGGQGPIGTTRSLFNRQAYVGLASSQYGALRMGRQLDAVTEMVQVLTGDAISASTFSTPGDVDNNDNTTNQNNAVKYISPIIHGFQAEAAYSFGGVAGATGSGQSWSAAATYAQGGLTVAGGYFRAANQGENGWTNATAQPSFGGALGYPSSGYNGGNAFKSAGIAQIAAQYEVGPYTAGLRYSNAQYKGNDGQPSIHFNVLGALLQYRVTPALSLATGYTYVYGSAATPTQAAEGRTMASINQVSLGATYSLSKSTALYAMGAYVHAKGAQASAADFGNTSSGGNQVQVNIGMFHGF

SEQ ID NO: 11300 - protein, 118 aa, Stenotrophomonas maltophilia
MGMGMGVSLREAYTSSKRTLDQITQDKYDNGDRAEAWTGDANNVYLAANYTRTYDMTYMGDTLDSLLLIYSIVISGRFWRPFLLTILLRFPEYAFCYCHLSVPFLNDKRDSWGWMFET

SEQ ID NO: 11301 - protein, 751 aa, Stenotrophomonas maltophilia
MQLSCESSQRWCMGRAVWISLLWLGALSAAPIEAVESPPVPVEAASPVLPPEALPLEVPVTVVRGQGARPPPVAAGDFHIQVGQLADVPRNSATELLLLAPGVMLANHGGEGHAETVFIRGFDAGEGKDVEFRLNGVPLNEVSHAHGHGYADTYFIIPELVDALHITEGPYDPAQGDFGVAGTVEYQLGLKQRGLKVSGSYGSFHSRRLALVWGPRETGESTFVGLLLRQGHGFGPNRAYANAGAMAQGELAVGDTSRLRLFGAGYAARFSSAGVIRETDWVARRLDCGPSEDEQFFCLYDPNQGGAAQRYLGSVELMTRLKRGGRFIQQAFGVQRQMRIRENFTGFLNDQTPPVGEPQRGDNTEQSYTGTTLGLRGRYTPGITWWEQPQPLELGYFIRSDTVHTRSRRLRDRGGAPYLTLFDNEVRVTNLGAYVSGKLLPRPWLLLRGGARLDSFLFGVEDQNRPEEDRQGARIPSEAIEAYGFTLSPRLSVEARLTPRLSWLTSVGLGARSSDAAALSDAEFAPFARVTSAETGLGYTAGGETLTVEARGAVFATRVSQDFVFDEEAGRNQPVGASQRVGAFSMARLTLQERVDVQASVAWSRASLPASGASPWKLFEGTVMPYIPGFLGRLDASVRGEAALWGERVGWNVALGHSTIGPKPLPLDRFSEPIFLFDAALRGRWKAVELGLTVENLLDARWREAEFNYVSNFRGAEAPASLLATRHFSAGAPRTLRGTLTVYLDFEEEHP

SEQ ID NO: 11302 - protein, 324 aa, Stenotrophomonas maltophilia
MKMTRTSIAIAALFSASAANSAVVYEDQESVLNIHGRAQGMYYFSDDKNADGDNSYIRVGLSGESKINEDLYAFGLYELEFKSNRRDADGIEDDEFDIRKGYVGVGADYGTVSYGRQYGAVTLVSDYTDIFPEFGNEAAGVSADLYGTGRSDSVFKLTTSYEGLNIHVSYQAENDEVSTDAASYGAAADYKLPYGFKVALGYNEGEGQSGAEDAELLTGAIAFEYDKFYASVLYSDGENWAKDGSESNIDYTGIEAVATYEVTDKLWALVGYNNLERDDEDVVDYYSLGAEYDLTSNFKALAEYRITDVDNEDDILAIAARYSF

SEQ ID NO: 11303 - protein, 209 aa, Stenotrophomonas maltophilia
MRKTSPLILAGLAAALSLAAAPAMAQSKGDWTVSAGVHQVAPKSNNGWLAGHTLKVDVDNDVKPTITGEYFIADNLGIEVLAALPFKHDININGLGRVGSTKQLPPVVTLQYHFNSKGKVSPFVGAGVNYTTFFSEDTTGALAGSKLKLQDSWGLAAHAGIDFAIGEKGALRVDMRWIDIDSKVKLNGEKIGTVNIDPLVYGASYVFKF

SEQ ID NO: 11304 - protein, 239 aa, Salmonella newport
MKNFFAVCIIPLVVAWSATASAQEGIYITGKAGTSVVNVYGINSTFSQDEIVNGHATLPDRTKGVFGGGVAIGYDFYDPFQLPVRLELDTTFRGETDAKGGQDIIAFGDPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 11305 - protein, 696 aa, Salmonella newport
MFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNNNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11306 - protein, 238 aa, Salmonella newport
MLDGLDVYGKAGVALVRSDYKFYEDANGTRNHKEGRHTARASGLFAVGAEYAVLPELAVRLEYQWLTRVGKYRPQDNPNTAINYNPWIGSINAGISYRFGQGAAPVVAAPEVVSKTFSLNSDVTFAFGKANLKPQAQATLDSIYGEMSQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 11307 - protein, 392 aa, Salmonella newport
MNRKVLALLVPALLVAGAANAAEIYNKNGNKLDLYGKIDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNENGGAGEGTGNGGSRKLARENGDGFGMSASYDFDFGLSLGAAYSSSDRTDNQVACGYGDGMNERNNYAGGETAEAWTVGAKYDAYNVYLAAMYAETRNMTYYGGGNGEDNGGIANKTQNFEVVAQYQFDFGLRPSIAYLQSKGKDLGGQEVHRGNWRYTNKDLVKYVDVGMTYYFNKNMSTYVDYKINLLDEDDDFYANNGIATDDIVGVGLVYQF

SEQ ID NO: 11308 - protein, 234 aa, Salmonella newport
MIVRKRRGRRTLCCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLAFTDPLWHASVSTLGWRVNSQFGDVRPWAQISYNQQFGENIWKAQSGLSRMTAGNQAGNWLDVTVGADVLLNPHMAAYAAFSQAENSATDSDYLYTLGVSARF

SEQ ID NO: 11309 - protein, 377 aa, Salmonella newport
MTIKITALAASIGAAVAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGATDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11310 - protein, 656 aa, Salmonella newport
MTQKRTLLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSIQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHFLSAKFSNIQRSITLGALRRVEEGETNGRLWGARLTSGYDFVMVPWLTTGPMLQYAWDYSHVNGYSEKLNTSTSMRFGDQNAHSQVGSAGWRLDLRHSIIHSWAQINYRRQFGDDTYVANGGLKSTALTFSRDGKTQDKNWVDISIGADFPLSATVSAFAGLSQTAGLSDGNQTRYNVGFSARF

SEQ ID NO: 11311 - protein, 746 aa, Salmonella newport
MNKKIHSLALLVNLGIYGVAQAQEPTDTPVSHDDTIVVTAAEQNLQAPGVSTITADEIRKNPVARDVSKIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 11312 - protein, 475 aa, Salmonella newport
MRTFRLFLSVAALIAVTQFGSTRSLAASSSDEIEALREQIRQLDQKLRALERKQELRDEAAATAAKPPVVTAAASGFGFAAADKAFELRIRGLFQFDARFFLDDGAPNRDQFLLRRIRTPLTGTVAGIYEFNITPELGGGTNSSTTVALWDAFVAARFSPAFGVRFGKFPSAVGLEPGSNRHFIESPFVNSLLPNRDLGVEFFGTLTDGLIDYRLGVVVGVPNNTTNFGGASPDLNDGDRTLAGRITLHPFTQLKDSPFAKLSLGVGFSHGNEQGVAGANLSNGLSNVTSQAQQLIFNYGPTLYAAGTHTRISPSAEWYPGTPFSAVAEYAHEEQDIAVDATGLTRTFENTAWRATVGYVLTGEEATKSGVNPKTAFSVGDGGWGAFEVVARVSGLDLDSALTRPVAAGGAGLSRNNNVKSAFAYGLGLNWYLNRSARFLINLENTEYEGAKTPTAAIGARDDELVFITRAQLTF

SEQ ID NO: 11313 - protein, 230 aa, Salmonella newport
MKSLNTLVILTSVISTSVFAGAYVENREAYNLASDQMEFMLRVGYNSDMGAGIMLTNTYTLQRDDELKHGYNEIEGWYPLFKPTDKLTIQPGGLINDKSIGSGGAVYLDVNYKFTPWFNLTVRNRYNHNNYSSTDLNGELDNNDSYEIGNYWNFTITDKFSYTFEPHYFYNVNDFNSSNGTKHHWEITNTFRYRINEHWLPYFELRWLDRNVGPYHREQNQIRIGAKYFF

SEQ ID NO: 11314 - protein, 312 aa, Salmonella newport
MKKHAIAVMMIAVFSESAYAESTLFIPDVSPESVTTSLSVGVLNGKSRELVYDTDTGRKLSQLDWKIKNVATLQGDLSWEPYSFMTLDARGWTSLASGSGHMVDHDWMSSEQPGWTDRSIHPDTSVNYANEYDLNVKGWLLQGDNYKAGVTAGYQETRFSWTARGGSYIYDNGQYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11315 - protein, 614 aa, Salmonella newport
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLHFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGMTYQYLGSRYDSDYSAYPYRTVKMGGVSLWDLTVAYPVTSHLTVRGKIANLFDKDYETVYGYQTAGREYTLSGSYTF

SEQ ID NO: 11316 - protein, 358 aa, Salmonella newport
MDDNEAQKMKKTAIAIAVALAGFATVAQAAPKDNTWYAGAKLGWSQYHDTGFINNDGPTDENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 11317 - protein, 230 aa, Salmonella newport
MKINKYLLGMVSFIAFSSYLQAATLDYRHEYADRTRINKDRIAIIEKLPNGIGFYVDASVKSGGVDGEQDKHLSDLVANAIELGVSYNYKVTDNFVLQPGFIFESGPDTSIYKPYLRGQYNFDSGVYMAGRYRYDYARKTANYSDDEKTNRFDTYIGYVFAELKLEYNFTWMDSDQIKFDNKKTNYEHNVALAWKLNKSFTPYVEVGNVAVRNNTDERQTRYRVGLQYHF

SEQ ID NO: 11318 - protein, 724 aa, Salmonella newport
MSFIQYRRDKHLPSTAAPSLLAMGMAMAFMPAAFAAEDTVIVEGATTTDAVNREEQDYSMKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGATTSLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTAIFQPQNKRDKAGQYLAPITGNNYEAGLKSDWMNSRLTTTLSVFRIEQDNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11319 - protein, 724 aa, Salmonella newport
MRVKKFIWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGISGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMTVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11320 - protein, 185 aa, Salmonella newport
MKNIILSTLVITTGVLVVNVAQADTNAFSVGYAQSKVQDFKNIRGVNVKYRYEDDSPVSFISSLSYLYGDSQASGSVESEGIHYHDKFEVKYGSFMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 11321 - protein, 178 aa, Salmonella newport
MNKMLLAGSAGIVLLSAAASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSNVAITLGYEGADFDATHNSGSLNSNGFNLGVGYRF

SEQ ID NO: 11322 - protein, 383 aa, Salmonella newport
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNFMTGRANGVATYRNTDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTAPGYAGGVANKTQNFEVTAQYQFDFGLRPAISFLMSKGKDLTYNNVNGDDKDLVKYADVGATYYFNKNFSTYVDYKINLLDDDDQFYKNAGISTDDIVALGMVYQF

SEQ ID NO: 11323 - protein, 706 aa, Salmonella newport
MKIISVRQRLYPALLLPLTFSPVLQAASAPNEQTMLVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQNVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGLNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11324 - protein, 239 aa, Salmonella heidelberg
MKNFFAVCIIPLVVAWSATASAKEGIYITGKAGTSVVNVYGINSTFSQDEIVNGHATLPDRTKGVFGGGVAIGYDFYDPFQLPVRLELDTTFRGETDAKGGQDIIAFGDPVHINVKNQVRMTTYMVNGYYDFHNSTAFTPYISAGVGLAHVKLSNNTIPVGFDINETLSASKNNFAWGAGIGAKYAVTDNIMIDASYKYINAGKVSISKNHYAGDEHTAYDADTKAASNDFMLGITYAF

SEQ ID NO: 11325 - protein, 350 aa, Salmonella heidelberg
MNKSTLAIVVSIIASASVHAAEVYNKNGNKLDVYGKVKAMHYMSDYDSKDGDQSYVRFGFKGETQINDQLTGYGRWEAEFAGNKAESDSSQQKNRLAFAGLKLKDIGSFDYGRNLGALYDVEAWTDMFPEFGGDSSAQTDNFMTKRASGLATYRNTDFFGIVDGLDLTLQYQGKNEDRDVKKQNGNGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAIGLTYQF

SEQ ID NO: 11326 - protein, 174 aa, Salmonella heidelberg
MKRRSSFLVFLGLLLASPLALANDQHTVSFGYAQTHLSSLKNSDSKDLRGFNFKYRYEFNETWGMLGSFTATRNEMENYTWKEGKLHKNGSDSVDYGSLMFGPTYRFNDYVSLYGNAGIATMKFNKHSKEDSFAYGAGVIFNPVKSISIDASWETSRFFAVDTNTFGVSVGYRF

SEQ ID NO: 11327 - protein, 696 aa, Salmonella heidelberg
MFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVSLTSRKPAFDAGGEVKLFAGNHNQRGAAFDVTGPLDDNERVAARLSGMTRYADSQFTPLKEERYALMPSLTWRITDRTRLDLMAYLHRDPQGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREQHKLRQTGYYLQDQMSWDRWRFTLGGRYDRVSVSNIDKLHDSRSDLNKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11328 - protein, 978 aa, Salmonella heidelberg
MWCASMAMRLRAAHRSCRARTARVSISPTDRRCLPGSNTAVACHRSQWTASAMHCLCSRDRAGRPLVLHLVSYRMQHPRSARRLSCAIALALSAPVFAETPVLSTTTMDAVTVQAKHVATPGSFDEQRLSSSVNSVMSKQQIDDIPSGGIADVVAHMPGLSAYSDMHLGQATTGENAYVSIRGMDASYNAYTLNGVGMPETDSSTRAISLNMLAPFGIQSVQVSKSPTPDMPGDSIGGAIDMRTPNAFDFDRDLYAKTTAQGQFNALASTLGGKDSGGTLQQELAWKFGDGHAFGVYASAYYGKNNNMAQAPAPNSKYVPADPALANATDLRTAGPLISTRYKYSLYTSQIERYGGNLSLDWQGDTSALYARAIYGSYGVTGQQDQSSARLETYRNQPTAVRGGYFNTHDIDETVATLQLGGKTTLDRLHVDYGASVGRGTRSRPDYVSASLYGFTPGSFAFDLSDPTYPSIGPSSAALKAFFYDLDASLLWKVQGHDAGSHDNRVNAHTDIAYQVDGDLLDSVKLGLSADHADRGAYDHPFFHKDGNFVTNGPYFGGPNYAFPTAGGPPLSAIPGRITGNAFNGHYAGPFKLLDRNWMLAQALPYKYLNDPTGAGVYTANDYNANTTASTEAIYSGYAMAALHIGSVSVLPGVRYELTRYAADSWQSRGDGSTGEFVGTGSTYGQVLPGISINYRPDDLTVYRASLRRSFSRPAFGLISGETVYSIDDTQTVVGISKPNPDLQPSKADNADLSAEFYDHDGGVLSASTYYKRITGFIYTSQSATSNDNTLGGLVPTGTTFENGVPVTMPQNGGTATLYGLELAASKRLLALPGIWSHFGINANLTLQHSAADSKRADQPEKTWLPRAPERIYNLDLFYDDSHLRTDLSYNYTGLQLLGLTTDRLNYYLQPVKSLDFNATYHLPHHVDVGVSAKNLLNAATFYETQGTSKRYMAYDPGADGAYVQTGRAYMLTVGYTY

SEQ ID NO: 11329 - protein, 397 aa, Salmonella heidelberg
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNEDPGAGEGTANGSDANSGSRKLARENGDGFGMSASYDFDFGLSLGAAYSSSDRTDNQVARGYGDGMNERNNYTGGETAEAWTVGAKYDAYNVYLAAMYAETRNMTYYGGGNGEGNGGIANKTQNFEVVAQYQFDFGLRPSIAYLQSKGKDLGGQEVHRGNWHYTDKDLVKYVDVGMTYYFNKNMSTYVDYKINLLDEDDDFYASNGIATDDIVGVGLVYQF

SEQ ID NO: 11330 - protein, 753 aa, Salmonella heidelberg
MTIKFLRHAHPARVDRARRRRRAITLTVPALAAGAFHLAPAVAQTDDAVHRHGALGATSGVANDAARGASSAKSNARANEATAVTRSATNRATAGAAPEAAMLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTVVKGPQTVLYGPGASAGTVLFERVTPRFKTPGMRFDGSVVGGSFGRNDQNVDVTAGTPDFYGRVIANHAHSQDYEDGNGRTVPSQWDKWNADAALGWTPDDNTRLELTAGTGDGYARYAGRGMDGAHFRRETFGLTFDKKHIGDVLDRIEAQVFYNEADHVMDNYTLRMPDPTSSMPMRMASEVRRRTLGARVAATLRFTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGAVNAFSAIKPEKTTQLDIGAQYKSDKLDAWVSAYAGYVQDFILFDYATGSMGQTTQATNVNAQIMGGELGASWRPLAPWRFDASLAYAWGRNVQSGAPLPQMPPLEARFGVEYTRGPWSAGGLWRIVAPQHRYALNEGNVVGKDFGPSAGFGVLSLHAQYNVSKAVQISVGIDNVLDKAYAEHLNLAGNAGFGYPANMPVTEPGRTAWVRLSTKL

SEQ ID NO: 11331 - protein, 656 aa, Salmonella heidelberg
MTQKRTLLKYGILSLALAAPLSACAFDSLTVIGDSLSDTGNNGRWTWDSGQNKLYDEQLAERYGLELSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMILEAVITAGLGAAAPPALKAALDALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHFLSAKFSNIQRSITLGALRRVEEGETNGRLWGARLTSGYDFVMVPWLTTGPMLQYAWDYSHVNGYSEKLNTSTSMRFGDQNAHSQVGSAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 11332 - protein, 802 aa, Salmonella heidelberg
MSAVSSYRLRPLLHFSLLLTLSSSPLFVSTSWAETSGKRAYEVPAGSLSAALTRFAGQAGVNLSVDPALVNGRNSSGLSGEFAVEEGFARLLQGSGLQLVPVGEQAYTLIPAPDSASAGLQLAPTSIVGDSGSTDGQEYAGGQVARKGSQGMLGSRDFMETPFSMTTYTKDAVKNQQARTLGDLIASDPSVRATNPAGGRYEQFTIRGFSLFNSDVSYNGLYGILPTYTIDMEMAERVDILKGPSQLINGISPRGSVGGGINVVPKRATDKPITELTTSYASKGQAGAAVDVARRFGEDDKFGIRFNGVKQSGDTEWDHQSVDREMAVLGLDFRGDRLRLSTDIGHTERDTDAPQERVQVGANAKVPNANDVRDNYAQSWSKARTKDTFGAVNAEYDLSDSVMLYGGVGARKSNHDFLRHAVSVTNDAGDFSVQPRDFTRDENVRTATAGARSWFNTGPVSHEVNLAASYFYMDFENGGARYAAAPSNLYNPVDTPTPSNPTRADSKVYTENRFSGVALTDTLGFFDDRLLLTLGARWQRVKVDDWTDNVKGDTSYDEEKVSPSGGILYKVTDDFSVYANYMEGLSQGKIAPSTSVNEDQIFPPFVSRQIEVGAKYDLGSYAFTASVFRIKQPAYETNTTSRVFGPNGKRRNDGVELAMFGEPLKGFRLLGGVMYIDSELTNTVNGTFDGNRAPATPEYNVNLGAEWDVPSVKGLTLTGRGIYTSSQYLDQANSKSIDSSERFDVGARYAFKVDQKDITLRANVENIMNKYYWSSAGASDDSEPGLTLSTPRTYLLSATIGF

SEQ ID NO: 11333 - protein, 437 aa, Salmonella heidelberg
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQIPSDTKIAHLNGNKWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 11334 - protein, 614 aa, Salmonella heidelberg
MIKKATLLTAFSVTAFSAWAQDTSPDTLVVTANRFQQPRSAVLAPVTIVTRQDIERWQSTSVNDVLRRLPGVDIAQSGGTGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDLSTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 11335 - protein, 363 aa, Salmonella heidelberg
MMKRKILAAVIPALLAAATANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADSTADLAKYIQAGATYYFNKNMNVWVDYRFNLLDKNDYSSSYVGTDDQAAVGITYQF

SEQ ID NO: 11336 - protein, 1079 aa, Salmonella heidelberg
MEKHRFLMWFALLFIGVVSGYAQQLAITGRVLDSKKEPLIGVTILLKGSANGTVTDIDGNFSIKALKGETLVVSYIGYKTQEILLSSDKTTMTVELLEDSEMLDEVVVIGYGTMRKKDLTGSVTQVRPDALANEAPKTVQDVLRGTAGLNVGFDKSAKGGGSMSIRGQRSVYSDGGHNDPLIILDGMMFYGELSEINPNDIAQIDVLKDASSAAVYGAKAANGVVIVTTKKGKSEKPVISFSANVGWATRADGRKVYDADGYLNYRRDFYTTDTYGVNPSTGKYEAYQTGGLPAGYFDRPTDANLGKYGLTMDAWRNQTTQDAGMSSDEIWARRIGLNASEVTLANFLSGKTFDWYDHSFQTGLNQDYNVSISGMTERVNYYLSLGYLSNEGIVRGNEYNAIRANMKLDAKVTDWFSVGANVNFQNRSDGDIAVDWYRQITSNSPFTSPYNEAGELVAHPQGENAYWKGYNFDFDRQYLDLEKGFTVLNTILTAKLTLPFGITYSFNAAPRLQYFYDRYYRSSEHPDWQAETEDRVNREQSKRFDWSLNNTITWDYTFAKKHHTILTLVQEAEERQSWADRIQARNILPSEALGFHGTANGDKNLSEFRSTDNRETACGYLARLFYSYDDKYMGTFSFRRDGYSAFGTTNPYANFLSGALAWTFTNEDFWKWGDILESGKLRVSFGQNGNRSLANSYIALANLALGMYSQGYINSTTGTLLDMKYLFVDRLPNTGLQWEKTTSWNVGLDLSFLRGRINASLEYYIMPTTDMIMNQSLPDFTGFASITTNLGRVENRGFEISLNTRNIETKNFEWNTSFSFSRNKNEIKKLYGEYETIVDAAGNTITKEKDDVDNKWFIGHPISAIWDYEVTGIWQVNEVEEAAKYGQKPGDPKVANHYTADDRKNADGTTTAVYNNNDKRFLGETTPPIHWSMRNSFILYKNWSFSFNLYSYMGHKSLDSNYLNNDNNYSQITNCQNIYTKKYWTVDNSSNTYARLSAQGPTGLAAPSRVVDRSFIRLENVSVAYNVPAELLSRFKIQNAKIFATVRNVATWSKEWEYGDPETGDIAPRTYSLGINLTF

SEQ ID NO: 11337 - protein, 1042 aa, Salmonella heidelberg
MDDLILYYCIFLILFMVISPSSLAKNAFRNEIFQFNIPRQSADVTLIAFAEQANLTLIVPFDEVRVITSNQVVGRYSIEEALSILLLGTGLEAAFNDSIRITFVSNQDTGNTMKIRKNFLSAMLGVIFGTSQVADVIAQDDTPKRGNTSLNDKTIEEVIIMGSNIRQSDKETAAPVQYIDRASMDLTSSATASDVIINLPANAGSVIHPVGGSNIGSANLNLRNLGPGSTLVLINGRRAGKSPLGDNLGNQFYDLNQLPLSMVRSLDVQTDGASAIYGSEAVAGVVNISTRKGFDGVELSYRREDSSNEANIINFAYGSNSERSSFALYATSYNAGKNYRSDFDFINERSGGTLLSTSGSPDEYQTLDPLTGARGSGKIIDPHCAEAGGIVSGGHCRYNFYDNTSPIPAAERLSFFAEFDYDLGELFTFDGVKVFGEVGYTDNKATRAFGAQVNGNGSYNGKFLIPGSHPFNFFVEGTDGLEYVDPTTAAGAQYWQANPDAAANLTTSGSLRPIGQAISGRNSEGVDIINTSDRYMFGFDAYRGDWNVSAWYQNYEHENSSLSSGRSIASALQAGLMEGTFNPFGIAYADPSFLSPKDGVSTAEHDIQRYMNEIAYTEVVGLTSSQETIDLVVSNSELFELSAGYVGFAFGFQKREETFSSTPDQLTNAGLGSIASGGFPLVDGKTSVDSVFAEFAVPVTDRIDMQLALRHEDHGDTVGTTTDPKIAVLWQMTDEMLLRTSFGSSFQAPSAIQTGGIAGSAAVDFQVANGRVTCNDPNSTTADYIPRTAAKVTGGLSPQSADNFNLGIVWQPAEKSSLSLDYWRYDYSGLIVNVQSAQSVLDADCDDGILNDPNITRGSDGVPLFIATALQNADSATTDGFDAKLSYGFSGDLGEFEFGLTLSHVLSFDAILSGVKYDVAGKRNAKTNSFGSMPETSGNVSANWTRNNHKLGATIRYKDSYLQDDSSRSNKLFGKNIDSFTTLDVQYRFDSSELFGLGSWLLVGANNLTDEEPPEYGAREFFDDQVHPLRGRVLYAEVGLKF

SEQ ID NO: 11338 - protein, 274 aa, Salmonella heidelberg
MKKVIAAGAVACMSTLASAQQAGDNVATLGWLHIMPQDSTNGLTTNLANMPINGPLRLPGSFTSPGTSLTVNNADTVGLTLTHFFTDHIAVTSVLGVPPEFTLTGHGVIRPPGPSGALGSVDMDKTSNQPAVKNARQWSPTVILQYYFNAPTAKFRPFVGIGVAYSWFSNIELNGNFARDINENLGSVLAAGAGKPGPTSVEGKASSSFTPVYNIGASYAIDKHWGLTATLTYMPLKTYSSLVIKAADGSTLATTRTRLKADPLITFAGISYKF

SEQ ID NO: 11339 - protein, 724 aa, Salmonella heidelberg
MSFIQYRRDKHLPSTAAPSLLAMGMAMAFMPAAFAAEDTVIVEGETTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIIDADLGATTSLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQDNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11340 - protein, 374 aa, Salmonella heidelberg
MKRKVLALVIPALLAAGAVHAAEIYNKDGNKLDLYGKVDGLHYFSSDSKKDGDQTYLRFGFKGETQINDMLTGYGQWEYNVQANNTESSSDQAWTRLAFAGIKVGDYGSFDYGRNYGVLYDVEGWTDMLPEFGGDSYTYADNFMAGRANGVATYRNSDFFGLVEGLNFALQYQGKNEGQNAQDINVGTNNRSSDSDVRFDNGDGFGLSTSYDFGMGISAAAAYTSSDRTNDQMTQTNARGDKAEAWTAGLKYDANDIYLATMYSETRNMTPYGNDGVANKTQNFEVTAQYQFDFVLRPAISYLQSKGKDLYNNGRYADKDLVKYMDVGATYYFNRNMSTYVDYKINLLDDNDSFYKDNGISTDNIVALGLVYQF

SEQ ID NO: 11341 - protein, 694 aa, Salmonella heidelberg
MSLIKDKSYFFLLLFVTGISLAQKQEMKQDSVQVEMLEDVLITATRTKRQLSSLPLPATIVSKKDLKTINAVRLSDILNEQSGLITVPDFGGGEGIQMQGLDAAYTLILVDGVPLIGRSAGTLDLDRITVGNIKQIEIIKGASSSLYGNEALGGVINIITDTPKYGINGSIQQRTASFETYDTRADIGYKNDKFSISGFINRYSSGGFDLNENTITNTVEPFENYTLSAKATYDFSEKTNIVLSGRFFTQSQDNIASEILQGESTIDEWNLHTKLDHTFNEKWESSMEFYATNYKATEFLNDNSNNTRFSDAFFDQIMIRPELRTVYKASEKASFIGGIGYTYETLDRTFFSESPEFKAPYVYAQYDGNPLKKLNVIIGARFDNHNVYQSQFSPKLALRYEITPKLAVKGSAGYGFKAPDFRQLYFNFTNATVGYTVLGYDAVPEAIAQLEAEGQIANQIVPVSVFSEELKPESSLAINAGFDYKPTQKISIGINVFKNLIDDLIDTRIIANKTNGQNVFSYTNINEVYTQGLEFSSTWKITKNIKFSAGYQLLFAKDKTAEEAFENGEVFARENPSSPSFQLESSDYFGLFNRSRHMANGKLFYKIPKWNSNANIRTVYRSKYGIADSNGNGYLDKYDDFVNGYSIWDIAFNKTIYDKYTFGLGVDNLFNFTDPQNISNIAGRIIYGNLTIQF

SEQ ID NO: 11342 - protein, 706 aa, Salmonella heidelberg
MKIISVRQRLYPALLLPLTFSPVLQAASAPNEQTMIVTATPQTVSELDTPAAVSVIEGEDMRLATPRVNLSETLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTEFEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11343 - protein, 749 aa, Salmonella heidelberg
MARLKTAQPNSSLRKIAVVVATAVSGMSVYAQAAVEPKEETITVTAAPAQQESAWGPAATIAARQSATATKTDTPIQKVPQSISVVTAEEMALHQPKSVKEALSYTPGVAVGTRGASNTYDYLIIRGFAADGQSQNNYLNGLKMQGNFYNDAVIDPYMLERAEVMRGPVSVLYGKSNPGGLLNMVSKRPTTEPLKEVQFKMGTDSLFQTGFDFSDALDDDGVYSYRLTGLARSANAQQQGAEEQRYAIAPSFSWRPNDKTNFTFLSYFQNEPETGYYGWLPKEGTVTKLPNGKRLSTDFNEGANNNTYSRNEKMVGYSFDHEFNDTFTVRQNLRYAQNKVSQNSVYGYGMCSDPLYTKDPANSPCASVPQSDWGHTLTRQYVIDNEKLQNFAVDTQLQSKFATADVDHTLLTGVDFMRMRNDIDSWFGYAGSVTPSDIYNLDRSDFDFGSHPGPSGPYKVLNKQKQTGLYVQDQMQWDKVLVTLGGRYDWADQESFNRVYGTTDKRDDKQFTWRGGVNYLFDNGVTPYFSYSESFEPASQTGESGNIFAPSKGKQYEAGVKYVPSDRPIVITGAVYQLTKTNNLMPDPNGSSWSVEGGEIRSRGVEIEAKAALSASVNVVGSYTYTDAEYTTDTSYKGNTPAQVPKHMASLWGDYTLYDGALSGLTLGTGVRYTGSSYGDPANSFKVGSYTLVDALVRYDLARVGMAGSNVALHVNNLFDREYVASCFNTYGCFWGAERQVVATATFRF

SEQ ID NO: 11344 - protein, 1950 aa, Salmonella heidelberg
MQKKKLISIAIALTLQSYYIPAIAAENNDDEKECPSNISSLPKEKRAKLSPTCLATLPENDNHWGWVAGGVAALVAGVAIGVENNGGGDSTHSYTPPTPDNGGNVTPPDDGGNVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPTDNSVTTFSNGVTIDKGKDTLAFDSFKLDNGSVLEGAVWNYSEQDDQWQLTTEDGKTLNVTGWDVTDANAAVIEGTQENGLYWKYDSRGYLIIADDNTTVITGDGESHTSDRGMDISGQDRTGVIISGDRTVNTLTGDSSVTDGATGMVITGDSTTNAISGHSTVDNATGALISGNNTTTDFSGDITVSGGGTAIVIDGDNATVQNTGTSSISGAGSTGTTIDGNNARVSNDGDMTITEGATGGHIIGDNAVIDNVGDTTVSGAGSAALYVDGDNTLIINEGDQTISGGATGTRIDGSKARIANTGDIAVDGAGSAAVVINGDNGSLTQAGDLLVTDGAMGIITYGTGNEAKNTGNATVRDQDSVGFVVAGEQNAFRNKGNINVSLNGTGALVSGNTSQVTLDGDINVISVQDSDGVFRGATGVNVSGDSNTVNIAGNVNMSAEHEQDSLIARQPSLIGITVSGANNDIALNGALDINVGDLSTVSGQALDVTGLDITGDGNNVNIRGGIDITHSEGGDTSSSTVTGINLNGDSEVTLSGQSTIDTTTVTGGEVILARVSNGGSLILDDDSTIDINANYINVDAYTDNALLVANGENSSIANQGDITSHGVYSIMRADNGATISNSGEILIYATSNNGGDDRTAVTRANGAGSVVHNQSGGDITIISDRQPVKNYGISYFPLKWYSHTFYAMLASGYGDVVNDEDAAIHLQGAGVYGVSASRGTALNAGDIYLDGFIPTLDDEGNITSTSYWHPSSLYLTSAGMVAGSTDGDGDATATNTGTINVNNAGFGMMALNGGVAINQGTINLTADEGVTKTDDNQLVGMAALNGGTVINDTTGTINIDASYGKPFLADNNSSVINYGTVCFDSNCQSSDQNNPTDSNVSLAFADGDVITAAGETLTGETIITSPIATQTVHVTNAGIVSGGKVTVRNYGDVTNESTGSISSVGIDKGGVYTNEGTTAAVSVDGGVFNNTGTVTGKTGTTVAGSIINNSGSMNAVEQWASTMNNTGTVSAWVGASGSTVLNNYSGGEIDKLNFTGAATVNNAGIINNGSVDKGGTFNNLEGGVVTLINDGLWAGAFNNWGTVNSDADIATGGSGHTLYNGSTGVINGQITTAKNNGGSKAINDGTINIDKTGNVAMSAHGSAKMVNNGEINLGTKGTTQTGMVGMQLESDAKSDAVIENNGTINIYASNSYAFSQLGSNGHIVNNGTVYIDDSVTGSGFIKQSGKTIEGSGENGDGTEVHYVDFIAPTEPTINDGMATVTTGDSAGSSTTNNLSGYVVGTSADGSAGKLKVSNASMNGVEINTGFAAGTADTTVSFDNVVEGSNLSDAGAIQSTTVVWNAQGSTDSDGNVDVTMTKNAYADVATDASVSGVASALDAGYTNNELYTSLNVGTTAELNNALKQVSGAQATTVFREARILSNRFNMLADAAPQMGNGLAFNVVAKGDPRAELGNDTQYDMLALRRTLDLTTSQNLTLEYGIARLDGDGSKTAGDNGLTGGYSQFFGLKHSMAFDEGLAWNNSLRYDVHNLDSSRFVSYGDTNKVADSDVRQQYFEFRSEGAKTFTLMDDTLKVTPYAGVKFRHTLEDGYKEHSAGDFNLSMNSGNETAVDSIVGLKLDYAGKDGWSATATLEGGPNLSYNKSQRTASLQGAAGQSFGMDDGQKGGGVNGLATIGVKYSSNDTALHLDAYQWKEDGISDKGFMLNVKKTFR

SEQ ID NO: 11345 - protein, 725 aa, Salmonella enterica
MRINKILWSLTVLLVGLNSQISVAKYSDDDNDETMVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSLPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 11346 - protein, 377 aa, Salmonella schwarzengrund
MTIKITALAASIGAAVAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGATDTTRRMLYTGFKSAKWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11347 - protein, 650 aa, Salmonella schwarzengrund
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKRGKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLKVKGGWATAFKAPSLLQLSPDWATNSCRGGCRIIGSPDLKPETSESWELGLYYRGEEGILEGVEASVTTFRNDVDNRISISRTADVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYTGRKRADSATAKTPGGYVVWDTGAAWQATKNVKLRAGVLNVGDKDLKRDDYGYTEDGRRYFMAVDYRF

SEQ ID NO: 11348 - protein, 656 aa, Salmonella schwarzengrund
MTQKRTLLKYGILSLALAAPLSACAFDSLTVFGDSLSDTGNNGRWTWDSGQNKLYDEQLAERFGLALSPSNNGGSNYAAGGATATPELNPQDNTADQVRQWLAKTGGKADHNGLYIHWVGGNDLAAAIAQPTMAQQIAGNSATNAAAQVGLLLDAGAGLVVVPNVPDISATPMLLEAVITAGLGAAAPPALKAALDALAEGATPDFASRQQAIRKALLAAAATVSSNPFIQQLLVEQLLAGYETAAEQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRMEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLSDGNQTRYNVGFSARF

SEQ ID NO: 11349 - protein, 751 aa, Salmonella schwarzengrund
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAVRYGNGAAGGVVNIITKKGGSEWHGSWNTYFNAPEHKDEGATKRTNFSLNGPLGGDFSFRLYGNLDKTQADARNINQGHQSERTGSYADTLPAGLEGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFHNDYRNKIEAGTVPLQRINNGKTDVYQWENVPKAVVEGLEGTLNVPVSDTVNWTNNVTYMLQSKNKETGERLSIIPQYTLNSTLRWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 11350 - protein, 186 aa, Salmonella schwarzengrund
MIIRKYFLIIALLVMPWLAIPSVSAADKGWFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 11351 - protein, 378 aa, Salmonella schwarzengrund
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENDGGRSLLNQNGDGYGGSLTYAIGEGFSVGGAITTSKRTADQNNTADARLYGNGDRATVYTGGLKYDANNIYLAAQYSQTYNATRFGTSNGNNKSDSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 11352 - protein, 230 aa, Salmonella schwarzengrund
MKSLNTLVILTSVISTSVFAGAYVENREAYNLASDQMEFMLRVGYNSDMGAGIMLTNTYTLQRDDELKHGYNEIEGWYPLFKPTDKLTIQPGGLINDKSIGSGGAVYLDVNYKFTPWFNLTVRNRYNHNNYSSTDLNGELDNNDSYEIGNYWNFIITDKFSYTFEPHYFYNVNDFNSSNGTKHHWEITNTFRYRINEHWLPYFELRWLDRNVGPYHREQNQIRIGAKYFF

SEQ ID NO: 11353 - protein, 674 aa, Salmonella schwarzengrund
MRKSLFFSVIASCAIAGSMEIEQISVTATGLEEENFKLPLSIESKGEKEIDLDQVVYQKELLNSISGVRIEQTGSVLGHMTGIRMPLNTGPYYLFMQDGIPVQSSGFFNHNGLAYTTFQNANSVEVLKGAGTALYGSDAVAAVINVRSLDFDKKESEIKAEGGSYGYATLRAKTAKEIQGTDFAAKANIMHSDGWRDHTDTNHGELDIGAKWQKDDENFFKLMFHASKTDALQADSFNDYDNITSRSEAASDDPNYFKALSLTDVSRKFDFARISLEWDNYSFKNLEIQNIAYLRYNRNRYTATWEKNLPKNDNKLYTFGLRNKNFYEDSNQKMVFGIDAEVTHSTLDYIQPFTITTTGWGATTYYAGPLYDYDVDYFAIAPFIQYERKLTSALSLHAGLRYDYNRFDYNNNLEDDSYDASGTYFRPADRTDNFSHLSPKLAFSYINGANNFYVRYANGFRIPQASRLYSMKKGYEFVSLDPETSDTYEIGWKRETGNLFTSIALYYMVIDNTITRYEENGVRYYANGNDTIHKGIELTCNYAIDIHNKIHIAYSYSRHNYHNDPKYGDNEMAQAPNHLANFRYTFKYDKLSLMPEMNYVGRYWMDDAHTYSYSGYTLWHLKGSYDMTKNAKLYFKINNVIDKHYAAYARYAYGKTDYTPGDPRMIYVGFSYRW

SEQ ID NO: 11354 - protein, 437 aa, Salmonella schwarzengrund
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQIPSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 11355 - protein, 312 aa, Salmonella schwarzengrund
MKKHAIAVMMIALFSESVYAESTLFIPDVSPDSVTTSLSVGVLNGKSRELVYDTDTGRKLSQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11356 - protein, 253 aa, Salmonella schwarzengrund
MKKILTLTLSSLLIIPTLTHAEFKGGFADIGLHYLDWTSDTTEKTSKKSHKDDFGYLELEGGANFSWGEMYGFFDWENFYNGRHAKPGSEQRYTFKNTNRIYLGDTGLNLYLHAYGTYGSPHRANFHDDMFLYGLGYNFTGNGYWFKPFFAKRYTDQTYYTGDNGYVLGWVAGYSFSLGSEKFSVTNWNEYEFDRDASYAAGNGGKDGINGTVALWWNATPHLTAGVQYRYADNKLGESFLQDGIIYSIKYLF

SEQ ID NO: 11357 - protein, 614 aa, Salmonella schwarzengrund
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAVTDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 11358 - protein, 369 aa, Salmonella schwarzengrund
MLSRWRYSWRILDDNEAQKMKKTAIAIAVALAGFATVAQAAPKDNTWYAGAKLGWSQYHDTGFIHNDGPTHENQLGAGAFGGYQVNPYVGFEMGYDWLGRMPYKGDNINGAYKAQGVQLTAKLGYPITDDLDVYTRLGGMVWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 11359 - protein, 230 aa, Salmonella schwarzengrund
MKINRYLLGMVSFIAFSSYLQAATLDYRHEYADRTRINKDRIAIIEKLPNGIGFYVDASVKSGGVDGEQDKHLSDLVANAIELGVSYNYKVTDHFVLQPGFIFESGPDTSIYKPYLRGQYNFDSGVYMAGRYRYDYARKTANYNDDEKTNRFDTYIGYVFDELKLEYNFTWMDSDQIKFDNKKTNYEHNVALAWKLNKSFTPYVEVGNVAVRNNTDERQTRYRVGLQYHF

SEQ ID NO: 11360 - protein, 724 aa, Salmonella schwarzengrund
MRVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGNTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWNWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11361 - protein, 724 aa, Salmonella schwarzengrund
MSFIQYRRDKHLQSTAAPSLLAMGMAMAFMPAAFAAEDTVIVEGATTADAVNREEQDYSVKTTAAGTKMTMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATNREFKGNVSTEYGSWNKQRYVMDLQSPLTADGNVRGRIVAGYQNNDSWLDRYNSEKAFFSGIVDADLGATTGLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQDNVAQATTIPIPGNNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11362 - protein, 185 aa, Salmonella schwarzengrund
MKNIILSTLVITTGVLVVNVAQADTNAFSVGYAQSKVQDFKNIRGVNVKYRYEDDSPVSFISSLSYLYGDRQASGSVEPEGIHYHDKFEVKYGSFMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 11363 - protein, 745 aa, Salmonella schwarzengrund
MNKMLKLALLAGAAWSAAATTVAAQDTAPAPTSDGFAIEQVVVTARRREESLQDVPVAVSAFSAARLERTGAQDITELTRSAPSLTIQAARGSNSTLISFIRGIGQQDPLWGFEPGVGLYVDDVYIARPQAAVLDIFDISRIEVLRGPQGTLYGRNTIGGAIKYVTDKIGSENEATIKGAYGSYNQRELVASGKARLTDTWAVSGALARYLRDGYGKNLNTGAEHYNKDVWAGRASVEWQPTQDVFFRLAGDITRDDSNPRHGHREIAPIPSSVYDTNAGAGDKNKVEARGVSLLAQWDVDDQLTLKSITAYRAGETDGVIDFDNLPGPLLDIPAAYRDHQFSQELQALYEGDRIHAVGGVYYLSATASGAFDTVVGGANLTTLTQGYVDTESVSAFGDVSYDLTDRLSLSVGGRITRDKKTGNVFRQRYLGIRSPFFGNPAAIAFEAPRTNYTRTATFEKFTPRVSASYKFSPDLTGYASWGKGFKSGGFDMRGDKVAYPATDQPYSPENVETVELGLKGSLMDRRVTFATAVFDTNYKDMQITTQFPTATPGVVASVVDNVGSASIRGWELESSAVISSSFVANLMLSYIDAKFDQFLGYVPTGPANASCPTLPGCVVDLSAVRAFQNTPEWTGSASFTYTHDMGSNGKISFTPTASYRGAYQLFEAPQPILDQGAYWLYDASLVWTSADDRYQIGLHGKNLGDEEYRVGGYDFSSFGALTGNTVIGFYGPPRSVTLSLQAKF

SEQ ID NO: 11364 - protein, 375 aa, Salmonella schwarzengrund
MKRKVLALVIPALLAAGAAHAAEVYNKDGNKLDLYGKVDGLHYFSDDANSDGDQTYMRMGFKGETQVNDMITGYGQWEYQVQANGTEGDKGDSWTRLAFAGIKVGDYGSFDYGRNYGVLYDVEGWTDMLPEFGGDSYTKADNFMTGRANGVATYRNTDFFGLVDGLSFALQYQGANENQVTNEQEGTGNGGDRDVKNSNGDGFGISSTYDLGMGVSFGAAYTTSDRTNQQANHSTAGGDKADAWTAGLKYDANNIYLATMYSETRNMTPYGGKDSWSDSTIANKTQNFEVTAQYQFDFGLRPAVSFLMSKGKDLAGGEDKDLVKYADVGATYYFNKNFSTYVDYKINLLDEDDSFYTRNDMSTDDVVALGMVYQF

SEQ ID NO: 11365 - protein, 706 aa, Salmonella schwarzengrund
MKIISVRQRLYPAFLFPLAFSPVLQAADTPNEQTMIVTATPQTVSELDTPAAVSVVEGEDMRLATPRVNLSESLTSVPGLQVQNRQNYAQDLQISIRGFGSRSAFGVRGIRLYVDGIPATMPDGQGQISNIDINSIQNVEVLRGPFSALYGNASGGVINVTTETGKQPPTLEASSYYSSYGSWRYGLKATGAMGDGTQPGDVDYTVSTTRFTTHGYRAHSGARKNLANAKLGVRLDDASKLSLIFNSVDIKADDPGGLTESEWKADPQQAPRAEQYNTRKTVKQTQAGLRYERQLSAQDDISVMAYAGERETTQYQSIPMAAQLKPAQAGGVITLQRHYQGIDSRWTHRGELGVPVTFTTGLNYENMSENRKGYNNFRFNNGLPEFGHKGDLRRDERNLMWNVDPYLQTQWQLTQKFSLDAGVRYSSVWFDSNDHYVASGNGDDSGDASYHQWLPAGSLKYALTDAWNLYLAAGRGFETPTINEISYRADGQSGFNFDLKPSTNDTVEVGSKTRIGNGLLTAALFQTDTDDEIVVASSMGGRTTYKNAGKTRRQGAELALDQRLAGGWRMKASWTWLDATYRSNVCQGQNCNGNRMPGIARNMGFASLGFVPDEGWYAGTDVRYMGDIMADDKNTAKAPSYTVVGLNTGYKLNYSQLTIDIFGRVDNLFDKEYIGSVIVNESNGRYYEPAPGRNYGVGINLAWRFE

SEQ ID NO: 11366 - protein, 253 aa, Salmonella schwarzengrund
MKNKKYINSLLAACVLFSCFNGQAAELKRVYGKLSFGYGDWNKGFVNVDRGEVWKAVADFGAVFDRGEFASFYEMNVLNHPVEGRNHVTQFLGHYRVVEGSNFTAMMKLYMSMENKFGDELNMMYGVGYLGLTSPSGFIKPYFAVHNLSNDYTSKKYGQATGFNGYVLGWVAAYNFDMFNEKFVISNWNEVEMDRNDAYAEQQGGTTGLNGAVTFTWKFMPRWTASVSYRYFNNKLGYNGYGDRMNYLIGFKF

SEQ ID NO: 11367 - protein, 729 aa, Salmonella schwarzengrund
MARLKTAQPNSSLRKIAVVVATAVSGMSVYAQAAVQPKEETITVTAAPAAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGSGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNEGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 11368 - protein, 1932 aa, Salmonella schwarzengrund
MQKKKLISIAIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSNISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITHGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSAASGQYLDVVGLSVTGDDNDVEIGGGINITHSEYPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGAEVSNSGDIFVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGDIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGTTKAIINNGEINLLCDSGCDIYAPGTTGTQNDHNGTADIAIPDATTAPTEGSIPTPPEDPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNDTQYDMLALRQKLDLTENQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 11369 - protein, 239 aa, Salmonella schwarzengrund
MKNFFAVCIIPLVVAWSATASAKEGIYITGKAGTSVVNVYGINSTFSQDEIVNGHATLPDRTKGVFGGGVAIGYDFYDPFQLPVRLELDTTFRGETDAKGGQDIIAFGDPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKADSNDFMLGITYAF

SEQ ID NO: 11370 - protein, 696 aa, Salmonella schwarzengrund
MFATTRMALLIGGAIGGATFPLFAQEITKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVSLTSRKPAFDAGGEVKLFAGNNNQRGAAFDVTGPLDDNERVAARLSGMTRYADSQFTPLKEERYALMPSLTWRITDRTRLDLMAYLHRDPQGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKFHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11371 - protein, 1004 aa, Salmonella schwarzengrund
MHSWKKKLVVSQLALACTLAITSQANATTNDISGTTYNTFHHYNDATYADDVYYDGYVGWNNYATDSYYNGDIYPVINNARVNGVISTYYLDDGVTTNTNANSLTIKNSTIHGMITSACLEGTDCVNRDTGYVYDRLALTVDNSTIDDNYEHYTYNGTYTDGTADTHVVDVYGMGTAITLDQEVDLSIVNNSHVAGITLTQGYEWEDIDDNTVSTGVNSSEVFNNTINVVDSTVTSGSLSDEGTSGWFGNTNNASDYSGSYTADDIAIAAIAHPYADNAMQTTVNLSNSTLMSDVVFSSNFDENFFPNGADSYRDTDADRDTNGWDGTDRMDVTLNNGSKWVGAAMSVHMTDTGTDADGDGVFEYTVDTNGDGILDATSPDGVYDSYAVGTEATATLIDIAANSLWPLSTVGVDNIYTDYSEYNHIVGNEVYQSGLFNVTLNTGSQWDTTKTSLIDTLSINSGSVVNVADSTLVSDTIGLTGGSALNINEDGHVATDTLSIDNSTVTIADDVSAGWSVNDAALYANTINVTNNGVLDVGNSASNALQVDTLNLTSYTDANGYVNAGVFNIESNRFVLDADLTNDRTNDTTKSNYGYGVIAMNSDGHLTINGNGDTYDTDQTEAGQDEVDNVGDNVAAATGNYKVRIDNATGAGSVADYKGNELIYVNDKNSTATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 11372 - protein, 398 aa, Salmonella schwarzengrund
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNEDPGAGEGTANGSDANSGSRKLARENGDGFGMSTSYDFDFGLSLGAAYSSSDRTDNQVTRGYGDGHHYYANSYAGGETAEAWTVGAKYDAYNVYLAAMYAETRNMTYYGGGDGGNGGIANKTQNFEVVAQYQFDFGLRPSIAYLQSKGKDLGGQDKDSRGNYRYTDKDLVKYVDVGMTYYFNKNMSTYVDYKINLLDEDDDFYANNGIATDDIVGVGLVYQF

SEQ ID NO: 11373 - protein, 955 aa, Salmonella schwarzengrund
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTNIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVVPDPVDPDPVDPVIPDPVIPDPVDPDPVDPEPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQVGGDLAQWSTDGLDRWHIGAMAGYANSQNRTLSSVSDYHSRGQVTGYSVGLYGTWYANNIDRSGAYVDTWMLYNWFDNKVMGQDQAAEKYKSKGITASVEAGYSFRLGESAHQSYWLQPKAQVVWMGVQADDNREANGTLVKDDTAGNLLTRMGVKAYINGHNAIDDNKSREFQPFVEANWIHNTQPASVKMDDVSSDMRGTKNIGELKVGIEGQITPRLNVWGNVAQQIGDQGYSNTQGLLGVKYSF

SEQ ID NO: 11374 - protein, 1013 aa, Hydrogenobaculum sp.
MRKTKLYLALASLMLATPAHSYETITVGNFEAQLLAPGESAYAIGAQTSEGAYTEVGDRRIITGTEAWTEGHRDAISRSLQALEQSFAMGSPKRKMQIAFALKKGKEANLGDSLGTLIYDQYLTKIISTGELLLRDNSPTDKILGSVDDTINIYTSTPLHYGPDAPGHDQYDFQSTVTHEILHAMGIMNGNDTDGSYPNGITRWDSLLEDGKGGHPTPENSPSMTTTGKLGTVFWTGAAAKATYGGPVPIQTFADGYKEGSSLGHPGPAGELMTYQSDYLEFPRAPNKLLLDMFRDMGWKINEAYYNSFGPTYYSNNSRISNTNNFETSHSYTYGMYVNGNYNLIEQSGNLKTTKEYSNTLHIYGDKNIIRVSGKQSAEANYSHALYAFGRYNQIFIEREGALAARGDGSVGILLFGADNTIFHSGTIKARDGATAIRIDNPFAHQAQGGHVLNASLHIQTGSEIVGNIINSASGMADMTFGSNYASDGISSSPDPDFNFSYNDEIRGNWHHTITAGKLNLGASAIIEGNMVNYGTLAGNGTIIGDVDSAGIIAPGNSIGKLTINGNLSQTSSSDLQIEFGDGGYDQLVVSGTAHLDGALSLIPIGYLAPGTHQFINAGALAGNFATVNNFSSSILQTSAASLNPSNFTLTRRSYASVSESQQQSLASAFDRARPTASGDMADTLNLMDLMDLTDIRQAADDFSPYFYNSVTTAILENIRTRSTFLQNKIRGDEADRQSPLWFSGYGGTTQYDKTITSNDFKTKYAGFMLGFDRQFASGFQLGAAGAFTDFSLKEKATTSKARGSVYDGYLYGSWSPQANDAFYLQSTLGIGLTDSKTNRNIPFLDRTATSDHDAIHYSAFLGGGYKQQIGNWSLEPRAGFEYINLDEDGCTEYGAGAASLAVNSKDSDALVSSLGVEISHTFDLNNGLLVPSFRADWFHNFSAEGEDTIATLQSGETFSVDGRTASENALELALGLRVLVSDKLHAYLEYQYTFADHQNGAHLLSTGLSYYF

SEQ ID NO: 11375 - protein, 381 aa, Hydrogenobaculum sp.
MAGLIPSIAPAQSSVTLYGLIDTSITYATNQRTQGAGSPGSGSVALTSGALNASRWGLRGREDLGGGTAAVFALENGFSGTTGKLSQKGVDMFGRQAWIGVSSRTAGMLTFGRQYDPILDFVTPLGASGPGWGGNLAVHPYDNDDSNRNLRINHAVKYTSATYRGLTFGALYGFSNTAGAFSNNAVWSAGFGYANGPLKLGAGYLKISRDRNAPNPDGALSTVDGSATITGGNQQIWAMAGRYAFGLHSVGAAWSHSATDGVSGVLQGGGITPLKGESLVFDNFTVDGRLFVTPAFSLSAAYTYTMGRFDTRTGQTRPKWNHVVTQAGYAFSPRTDAYLEAVYQSVSGGNGNPAFNATVWTMTPSANSNQLVVALGLRHKF

SEQ ID NO: 11376 - protein, 359 aa, Hydrogenobaculum sp.
MKKRLFTAVAVGAFLAAGPAFADEGWYVRGAVGYGGPGDTSVSGSLNGDIQGEGNWREAVALGYEWMDGFRLEGELAHRYNDTGAVGGFENSLSDFQIWSLMANAIFDFNPDGTYHPYVGLGLGLAETSGTLTGWSAGTMPPVPTPADYVVAQDSDNPFAWQVMAGIGWDLTQRLTLDTEYRYFSTGSSDYAPGVSVDGLGGHELWVGLRYSFAAPPPPPPPPPPPPPPPPPPPPPPPPPPPPPPACDDVSFPVYFEWDSSTLTAQARAVIAQASNQRGSCGVTRVTVAGFTDRSGAASYNVGLSERRARVVREELVRLGVPASTISMEAFGETRNAVATADGVREPLNRRTEVVIVLD

SEQ ID NO: 11377 - protein, 347 aa, Hydrogenobaculum sp.
MVKKTLLMVSLLTFGMAAHAQNSVTLYGRVVAGVDFQNNVQNADGSSGSLLRAGDNQWGTSMFGFTGTEDLGGGLKALFKLESGFGSSAGATNGTALFNRRSFVALQSATWGQLKLGNDLAIADQIWALDPTGQQFIGSATLVRGRNWQGDNNMIAYETPNWGGFSGLVLTSLGGKAGSLNSSRKDAISLTYTARTFELRAIYDVARDKNGKYSDLFNASRELTLGGTATFSALKLYAAYENLSAPDSVAGAPTKANHYWLGVNYQLTPFLTLIGAAYRVNVNHNGGNANLFMLGANYSLSKQTLLYVSAGTVRNSPNANFSVEATNNNPAPGGKQAGFYAGISHSF

SEQ ID NO: 11378 - protein, 713 aa, Hydrogenobaculum sp.
MKIRIALLTSVLILPPISVGAQVQDDGSFLLGTIHIQARKRDELAFEIPVAATIREGADLEFGSLDPGVDLARTTPNFNYVDFAVPGNSFGSVRGIGPLGSPLNSLDNTIGFSTNGVPTTSFGFSPTLFDVEQAEVLRGPQGTLFGRNALGGAVNIVTRRADGVPEFIVGTEVGEDGLRTLDLAAGGWVVPDLVAGRVALRFQEFDGDIPNGVAGGKDGDASIAAGRISLAFDPDGPLSADLVLGRDRDRRNNPIYLWAEHPDFPVSGSDMVQVGERVIDHISLSVQREFEGFTFHSVTGFQDIAVTTITDDTDSFLYSRYLSDYGMPMSPGAFSDPDEDWGIVYEGERVFSQEFRLNSPEGAPVEWVAGLSYFRSQYDMDRTQQSNYSPSLNGHYDTTITSQTLAVFGDISAPVSDRLTFSAGLRAARDRQTFDTTYVSNGAPGTVPGHRQSGSFEDDYVTGRVAVDWRWNDEWMSYASISRGYASGGFERYSLNAYMGLDTPPFRPSTSWAYELGTKAELLDGRLSLSGALFYNNVADGQLTAFDAATMSFAFDNQDYRSYGAELEFRAELTPHVALRGGVGWTRTRLVDVPNGVTTGAMNGNRVPNMPELTASLGLDLRYPLGRGEAIASLDVSHVGGRMADIGNSWEIPSYTVADLRVGWERDGMELYAFARNLTDERPIYFSSTFSPNAHSAIVGRGRVLGLGATWRW

SEQ ID NO: 11379 - protein, 1063 aa, Hydrogenobaculum sp.
MLTKKKECMKNRRKSNLFGCLHEFRQFFFITLLSVLSVNLYAQQRGIQGVVVDGNGETIIGANVLSEDGKAGVITDLDGNFKLDVPVGTNIKISYIGYKTKVLKATAGNMRIVLLEDSEMLAEVEVVAYGVQKKVTVTGALSSVKTDDLVRTPVSSVNNVLAGQLSGVTTVQYSGEPGSDAAKIFVRGQGTWADSEPLIQVDGVERSMADIDPEDIESITVLKDASATAVFGVRGANGVVLITTKRGKEGQAKIDINTSFSALTPTSLLEQANSYEYGTFFNQMQRNDFDFSSGETFTPMFSDGVLEKFWDGSDPIRFPSMRWVDYIMKDVTMQSKHNVNISGGTKTMRYFVSAGLMTQGGLFTEFDDFHYDYRYQRFNYRANLDLDVSKTTTLSFNLAGSVDNAQKPRTSQGASGMIMSMLQATPFSSPGIVDGKNIATTTDYSDGLTLPFTGGGAMNYYSSGGTGGYYHYNNNKLQLDLALDQKLDFITKGLAFKLKGSYNNMFNVTKGGTVGRASYFPVIQEDGSILYRKEGENTPVSYSEDTGKARDWYFEAQLNYNRTFGDHSVGALVLYNQSKNYYPSTYSDIPRGYVGLVGRVTYDYKSRYITEFNVGYNGSENFHPDRRFGVFPAGSIGWVVSEESFFKPLKKAIPFLKFRASWGLVGNDKVGGSRFMYLADPFLYSDKMGTRGGYAYNFGVENSVLLPAYYEDVNNKNNPEVTWEKAFKQNYGIDVNLWNDRLRATFDYYKEHRTDILLKDYTAPAIVGFQPPYANLGVVDSWGWEVSLNWNHKVNDNFRYWTTLNLSHNQNEIIEKKESPYTNAYQYEKGHRIGARYMYKFFRFYDEDTPRLYEEKFGQPFPKQLVNLKDGDAVFVDLDGNGVINEDDKTRELGYTDDPQYIAGLNAGFAWKDFEFNMQWTGSWDVSRVISDVFRYPFLDRTTKDRGGLLKYHVENTWNPDRPGQDYEYPRATWSNGANNNYQDCALYEKDAKYLRLKTIMLAYNMKLPFFKKIGLDRAQVALSGYNLLTFTPFIWGDPETRASASPSYPLQRTYTISLKLNF

SEQ ID NO: 11380 - protein, 769 aa, Hydrogenobaculum sp.
MKIFKKSVLSLCVQASIIASVTGFSASALAAEEVDKNKLEVIEVTARKRVENVQEVPVSVSSLQGENLDAYSSGGMDIRFMSARIPSLAVESSYGRSFPRFYIRGLGNTDFDLNASQPVSYVVDDVVQENPILKGFPVFDVERVEVLRGPQGTLFGRNTPAGLVKFDSMKPTQSFDGYAAISYGTRGAIDSSGAIGGGLTDNLSVRVSALHQSKGDYIDNRAVGFEKKDQLGGYDDNAARIQFLYEGSAFSALFNYHFRDLDGSPIVFHPNIATPGTNNIRGDFEADVVYQDAGQFATQDVSTQGSSLKLEWDIDDYTVTSITAWESAEIFSRADVDGGYNGFPPAGDANAVWWGAQTADEIPEHDQYTQELRLASNFAGKLNYQVGLFYFSEELIINTYDYFTRDGTSTPSDPAHGAQNGESTQYQDTTAWAVFGSVDYDFTEDLAITVGLRYSDDQKDFTAELLDHPFIPGADGGNFSESVDVSDSHVSWDISGTYKINKNINWYARVANSFRAPSIQGRVLYDQNVSVADSETITSYETGLKSDVLEGRGRVNASVYYFDMNDQQLTAVGGTSNSNTLLNSNGTIGYGIELDSEWILTDNIIATFNISYNKTEIDDDGLAVAACGSGTCTVTDPTFQVPGDFGPTTMAYIDGNSLPNAPEWISNLTLSYVKEIGDGEFFAHTDLTYRGKVDFFLYRAEEFEGEALIEVGARTGYNWISGDNEYEVSAFVRNLTDEEVIIGGVDFNNNSGMVNEERFVGAAFKVSFF

SEQ ID NO: 11381 - protein, 377 aa, Anaeromyxobacter sp.
MTLTPFLIALSLAQTTPAADPAAAAAQPAPAPVKAAPTLAGALANAPKPTFWGFVNAQYSRTEGLNGADDTSTFELRRARIGARGKVHELVGYSILFDGADSKLKDGYVSLFALPGVEVRMGQWKTPFGYEQYESDTKLLWVNTSYVVGALARGPDARDLGAGLLVQTPKAGPVSAEVLGSFVNGAGPNKKDDLETKNFWGRAGLTLKQGAITLKAGGSYGTGQQLQGTGGNGAFDGVGTPVDDTYFYFHTYGVDATLDTPWLFAAAELIQSERDQSRYATAAAVTTVTRSSRTARGWYAGAYGKTPWNLGPIFRAERFDADRTAPGGRLERYTIGAYVDVIPVNARLILNHELDQGQTGAAGRTGDRTTLFAQVIF

SEQ ID NO: 11382 - protein, 431 aa, Anaeromyxobacter sp.
MNMTHRRSLALLAALLLPAAASALEGDVTLYGTLMPFFDNARVSDPTRPGLSPATGGATQVSDAAYTGVAIPQRFRLTSGTSNIGFKGGFDVLGEDLQVFFQVESAVSPDGDAPNAWASRNSAVGVKGKFGRAFFGNWDTPYKYPVLLVGAVRGLNPFDNTITANPGFGVPGTTTQSGRVNGKADAAFNRRQGNSVQYWTPELYGFSARLAYSANESRTVASATAPSISPTISSGLVSWAYGPLLLRYAYERHQDYFGLSQLGGSPVSLTNRSSTDQGHEAIAQLALPTGTRVSLVGERLSYENEDRAVGAVREYARLAYYALLQQRFGAHQVFGSFGQSDAGECKVVGGGACTVNGLGATQWNAGYSYALTKAADVYVAYYETRNDRSASYGVVGGPGAVAPGGDTRGFGLGLLYTFAATANVGAPKGSP

SEQ ID NO: 11383 - protein, 649 aa, Anaeromyxobacter sp.
MSASARLAARTAIALACATCPALAAGAAPGPDPDDPVVVLEEQVVRLPRATTEARPLASGTVVDRATFEGEAKDVGQLVSTAPGIAVEEHGGLGQLTTISIRGSPPSGVKVLLDGLPLNTAFGGGVDLSTIPRSWVDAVEVVRGPEGARYGSGALGGVLNVVTRRPEAGSWSLETGGGSFDTARVAADVGTSVGPGAVLLGATAETTSGRFPFRLDPGLPGGPTVRATRENAGVRRGGLLAKLIRPQEHGRLDALLEVSGGHRGLPGFAAAPTPWAWQDDARLLAMGRVARFGALGPATLAARGHLRLDRLDARLTGPDDSPIRQRGAAAGLALEATGSHRHGVLSASLETTAELLAADGLGGRRDLYGVAAAVADDLSLAGGGLRIAPAARAERAGQFGGVSGSLGLSVRLAPALRARAGVGRTFRPPGLAELHLQQGLLVPNPDLRPETAVAADAGWVADGRAGLLAVTGHLTRYEDLVVYEPSDAFGRLKPFNSGRASATGLEVEGASAPVGGPLRASARGSYTLLVTELLRGAPAEVGHWIPYRPRQRAFLRVALAPGPLSAHVELHRLGRRYRDRRGVNPIPSSTSWNAGLGVRVARRPGVRIHLEVLNLADDRTLTDGVGDPLPPRTVMVTLRAGSSAQEYAP

SEQ ID NO: 11384 - protein, 994 aa, Anaeromyxobacter sp.
MSRNTDSKYVLLAGASALALSFIGTAYAQEDTTPDDDRRLGTVTVTTQKVEQSIQDVPIAVSAFDEESLNKLQLAGGPDLVKSIPNVSFTKGNFNGYNFKIRGIGVDVVAQSGDAGVGIHQNDVPLTANRLFEAEFYDMERIEVLRGPQGTLYGRNATGGVFNAITAKPVLEEWQGNASVALANYDSRKLKGMVNVPIGDKVAVRLAGSYLERSGYVDNTVTGRDVDGRELYGYRATILAEPTDRIRGWLSYEYFEEEDDRLRVGKQLCKKDPLKTSYAGIPIGFVDQTVTSLGCAEAPLDAMDGRVNSVGTLGGGLGVLAGLLSGDAFTQPANLNLSEIESAFDPQYYADQELITGKLEFDVTDNMLLTYLGSYSTSESLSIEDYNKQSPTIAFNTSGAPLFNPALTPVYEALFPGGVVNDPLLGASNFFRTFDVAGGSSEQTSHELRLQSDFEGPFNFNLGVIQVDVEAIDPSTATDGYTVVSNSLTALTQLNNALGGAIFGGLVPLDDAGTQPAIENLDYSGLGGQYFRSLSPYELSSLAVFGEGYYDISDNLKATLGLRYTKDEKSQDNIPTFLFVPGAAYGPGTGQNGSPLTPKPVTFAGPDGIVGTPDDVLASADEGGDGSFNVAFEEVTGRAGLDWRPDLSFTEDTLLYAFYSRGYKGGGINPPQPADNPGAFDQFFEPEFINSYEIGTKNTLAGGALQMNATGFYYDYKGYQITQIINRTSVNFNIDSTIMGLELESIWNPVSTLVLNTNIGILDTEIDDVYSIDVLDRVNGRSDLVALKNTTNYTNCVVSAQGYATVLGAIQGNPALAGLTRNICNGDLGAVGGRTAFENALGLGGVTVTYTDATGTTRTASALEPIAGDAKNLGGNSMPGAPDTTINVGVEYTWLPGSFGDWGLTGRVDYYNQSESFSRVYNTNRDQLSSWDNLNASLAFYNDTNGVRVELFGKNIADETAITGAYLTDDSSGLFTNIFLTEPRTFGVAVSKTW

SEQ ID NO: 11385 - protein, 208 aa, Anaeromyxobacter sp.
MKRMLLVMALALAMAPVAEAQAPTPESGLMVRLRALYLRPADRSDAIPALGVPENAITVSDKVIPEVDLSWFFNRYLAAELILTYPQQHDVELSGARIGTFSHLPPTLTVQGHLPLGRVKPYLGAGVNFTLVTATDLAVPGVGKLELEDYSFGFAAQAGVDVQLAGPWYANADVKYVTIRSDVKAGGTKVSEVRVDPWLIGGGIGYRF

SEQ ID NO: 11386 - protein, 899 aa, Anaeromyxobacter sp.
MRQLTQRPPLKIATLALAVSMAQSAIAQQDTLLEEVIITGTRLADRSAADSPVPVDVISGSDFRVNGSTDLQDMLRTQVPSFNVNSQPISDAATITRPPNLRGLSPDNVLVLVNGKRRHRGSIISFLGGGISDGAQGVDMAAIPSLAIKQVEVLRDGASSQYGSDAIAGVLNFRLRDAAEGFEMVARTASTFEGDGDNYMVSANLGLPLGDNGFVNITGEMRDVEGTVRSVIRDDVAFAAANGYAPVSDFQTINTYTGDVPQYWGTPDVSDDIKLFINSAYEINDNMEVYAFGNYAEREVEGGFFYRNVVGGANNLTGGSTGQRGGVYAGPTVDPLTGLSSATGVPSVLVGDLDGGSSCIDGIPLGGSGGVIPDPTFLSQVSASENCFSFIETIPGGFVPRFGGTNEDMALAVGVRGDINVGTGLDYDLSVQRGSNRTDFFIRNTINASLGPATPRDFVPGGQEQTETVYNANFVYGIDVGFASDLSIAFGAEFREEEFDLFAGDPASFALGPLASQGFSSSSNGFGGFPNDTSAEQDNTSFYIDLEADITDELTLQAAARHEEFSNFDGTITYKLAGMYRVTDSFRIRGAFSTGFHAPTAGQANITNVTTQNVQGVLVDQGTLPLSSAAGQLGADFVESFGNGRPELDTEEAENYSIGVVFDIGNSTWTVDYYNIDVTDRIALGANVDFLDALNFAGGGSDYGSISEALTGLDADGIINRQDFLGLDDLAEFRFFSNSFDTNTEGVDVVGNTYFDFLSGSSTVTVALNYNKTEVTDRGTVNPISDGRVEALELQLPEFKGNITWSHVQGKFRTLLRANYFGDWRSTSNGYDVGASTLIDAQVAYQFTDSLEVVLGVENLFDEFPDENPGQGSVGQLYPEDSPFGFNGGTWYLQGRFVF

SEQ ID NO: 11387 - protein, 245 aa, Anaeromyxobacter sp.
MNARIHAALAGAAFGCLALAAQAADLPRRAPPPPPPSLPVFTWTGFYAGVNAGYAFPTGSGGFTDPTYGTVTGGGRSGGFAGGGQVGYNYQFTPGSGVVVGVETDIQGTAFAKADAAYLGTAPYYSVRPSLDYFGTVRARLGYAFDRVLVYGTGGFAYGGGARSTYAASYPYTLPSTDRTGYAAGGGIEYAFTEKLSAKVEALYLHLGRGTTAATYYNASVPAFYGAGKQDSGLALVRAGVNYRF

SEQ ID NO: 11388 - protein, 961 aa, Anaeromyxobacter sp.
MDSQKGNISALKEKLNRNRENSTATIPTETISYNGSTVKIGILDSDFTDPVRKAQLSARYPGIEFIPRVNSDTSTSSHGVQVLEVMMDTLEDRTKGKAKFKAIAASIGNGGASETNKSVNPNVKTYEKVFERFNFNQKVKVVNQSFGADITIEEAPYTKNNIRNYVWAGDSKPFATYFEEKVNNDGGLFVWAAGNRKGATETNPGQDMDSVGMEAGLPYLVNDLEKGWIAVVGIQPKETVRVGTAPDGTPIVNIKPNGKLNIHRTGTDRLAYAGDNAKYWSISADDSAIPTAGRAGIGSSYAAPRVSRAAALVAEKFDWMTADQVRQTLFTTTDDTELDASLAGNANAEKRRRVKTSPDYKYGWGMLNQERALKGPGAFMDVTKYGNTNIFNAEIPAGKTSYFENKIFGFGGLVKSGEGTLHLTNDNSYAGGSVVNRGTLEIHKIHSSKVTVNQAGRLVLHPKALIGYNEAFFNVITTVDPTRITTGTNLRNKGIVEVNGTTAIIGGDYIAYKGSTTTFNNGAKLNVLGNIKVEDGTVKVLSDSYVTTQGSSNTVMEGKSVQGNIANVETNGMRNANVEVQDGKVVARLSRQNPVEYIGKNAEASTKNVAENVENVFQDLDKKVMSGTATKEELAMGAIVQNMTTMGFTSATEMMSGEIYASAQALTFSQAQNINRDLSNRLAGLDNFKNSNKDSEVWFSAIGSGGKLKRDGYASADTRVTGGQFGIDTKYKGTTTLGVAMNYSYAKANFNRYAGESKSDMVGVSFYAKQDLPYGFYTAGRLGLSNISSKVERELLTSTGETVTGKIKHHDKMLSAYVEIGKKFGWFTPFIGYSQDYLRRGSFNESEASWGVKADRKNYRATNFLVGARAEYVGDRYKLQAYVTQAINTDKRDLSYEGRFTGSAARQKFYGVKQSKNTTWIGFGAFREISPVFGVYGNVDFRVEDKKWADSVISTGLQYRF

SEQ ID NO: 11389 - protein, 410 aa, Anaeromyxobacter sp.
MTGKRWIVAAALALWASQAGAVNGMRMIGFGPVQSAMGGASVGLPLDSATVITNPAGLSLVDGRVDFGITILDADVRYRAVGAASGQEQTSSRRPTLIPGFGLVVPLGDRLTFGLGGYGIAGLGVDYPQDLLGGRLYTSYSQLRLAPGVSYRVTPELSLGVTANIMYATLEYSAGGGLGLQPRDGAISYGGGFTVGATWRPVGWLTAGVAYESRGWFQDFEYEVPAHTIVVDPATGATANVGPGVEKLELDQPDLLTFGVGLRPVTGLAVAADVQWIRWSQTNGRNQPRLQTDPALTGGMQLDLDWSDQWVLKVGAEYAAASWLKLRAGYDYGKSPLNADRALENLAFPAVLEHHVTAGVGLELGRTSVSVGGTYAPEGKQAGSNLAQGIAAYETTFTAWTLDVGVAHRF

SEQ ID NO: 11390 - protein, 995 aa, Anaeromyxobacter sp.
MNRITPAVSLSLFALFNAQITLANSDYIDASKSIIDQRNQRFDELRNQVIPPYPTPQSQAAQWDKDVSQQVMQLTGKRKKSAEKDKKSTPEYIFNIYREYVFNQKGFNYNDFKEIKAYNRLEHLFHLATFANDPIQNRIRSIDFILKDYYLRGRPNQVLDHKGEYLPNYIGITGSSYPSGHTWNGFKQAAIFATIYPEKGTQFFDRAIGYGESRVIVGAHFPTDTITSRAANYYLLAHLLKEDKTANAMINLAKEVRQDLQNQCTISNKKCKPPVGSLPSFNENLGYYAKQSEQPSPALQVDQVPADAAYLLRSRFAYLNKSQWQQIIAGTAYPTNSLAGWGVKQNQPESHWGLINLPKAYKGPTHLAEDWVVNQRVTQDDVANIGIADTWSNNIEGKGRLIKQGEGTLTLTGTNRFAGLDIQQGRVILTQENHLTGPININGGELNVKHILHVPVDVTNGTLQLSHSIRNTVTLNQGARFIASGSVDDLVVNSGAILTPGDNTKDPTRRITVNNTATFQPGSEFHVDLQTTDTQEFDALQSSDTVVINGGKVKVFFAEKSPPFNERIPNEDEIQNRFRTEYTIISAKKIQGKFDGVEPNYLFIGTTLDYGEDPRSPTTKLVTLNVGRSDLAFDTFAKTPNQTAVAHALENLSLSNTLYERLVLSKTTVGVNDLLRTLSPQIHIDTLASQLNNHRQYHGALLQQTRISENIVKERGDNRSNMWVNIPYHWDRTQSDGNASGFTNSNYGVFLGADKHFFNDDFIFGISSGFTKNSVSGGVGHSHSNNYYLAAYGSLRLAPITLRAGLGHTWHTIKTERTVTSSIYSDHNTADYKGKTNHLFMEAAYPWKSSIINAEPFVNFAFTNAESHGFRENGEKASLVTGRQSLDATTTTLGLRLDNQWEVGNTSSIDVHGELGWQHQYDKREREMAFRFTHRNLLAPPLNYYGVNAPRDGMAIKLGSSLQLTDNTKLSMDYSQFTAKGYLENNLDAKLLVSF

SEQ ID NO: 11391 - protein, 250 aa, Anaeromyxobacter sp.
MIRLLLGGLAAVVMVGSASAADVAAAPYAKAVSAPVYDWSGFYLGGNGGWGSSRKCWDFVDAAGSFLTSEGCHDASGGTAGGQLGYRWQASNLVFGVEAQGNWADFNGSNVSIAFPTVVNATKVDSFGTFTGQIGNAWGNTLVYLKAGGAVTSDRYTGYLTSNGVQISDTVKDNRWGAVVGLGVEYGFGAWSLGVEYNHMFMQDRLIRFTNNGTIAPAGTAYASDRIHQDVDLVTMRLNYRFGGRGVAAY

SEQ ID NO: 11392 - protein, 407 aa, Anaeromyxobacter sp.
MRKTFRIAFLAVLAAPAVALASGFEVININPRDLALSSSGVAAQEDAAATFQNPAALSKLSGLNLSLAGSMLSIRTKWTGTDAYPGKETTKFAPTPPVALYAAYGTKLAGRGLGFGFGVATPGGGQMKWDDQWEGRGRIITVERRMLGFYLNGGYELMPWLRVGGGAIYYEGIQYLKQGIQPFPDAYAELDTKGGGFAYQLSAEVKPLENLTLGFDYKHKGTMHMKGDAHFQVPPSLVGPTTQDQKVEQDLTFPNRIDTGLAWRVVKPVLVTLQYSWSRFVVYQSDVFEGETTTIEVPRDYRNGNVIRGGVEWTALPSLRLRAGLMRDWSGLRTNTLSPTLPDSNTTGYSVGAGWNVGSNLGLNGAFFYGDRDKQTATGTTAFPGSYKTDIWIVALGFTWRTDLGGR

SEQ ID NO: 11393 - protein, 265 aa, Anaeromyxobacter sp.
MTLRSLLRASFLLALVAAAPAARAGGFSTTNVQLLQGWNFDKAIDTSFAGKLKDGTKTTLTLNHFSTWEYGDNFAFFDLSRGRFEADDSQWTDAYVEWHPRLFVNQLLGQKEPLFGVIRNWGFAGEVNQGAGFYAYMGGLGLDFAVPAGWVLGLNTYYRYDNFNRHGWQVSPFWTVPFAVGKVPFLFTGFIDVNGLKDEGGFYTGSDNGVEIWSQPQLLVDALAPFGGKAGKLYVGVEWWLHYYSLGSFEETTSAPQAMVQWTVF

SEQ ID NO: 11394 - protein, 495 aa, Microcoleus chthonoplastes PCC 7420
MDPVNGSSGYYVVRNINTSLYSYEAKQRAYYIEDKWQVTDNLLLSLGLRKDEFTNYTPFGDPYIEVDNAWAPRLGFSWDVNGDSSLKVFGNIGRYYLGLPLSAVSLFTPATTTDTYYTYSGINADGTPVLAQQLGSAVSANSRFGRIADVRTAVVKDIEGENQDEIILGLTKQLDSGWVFGVRGTHRHLNAGIDDQNYDVSNTALIDAAAAQGVTIDFSQVAGASLINPGQTNKWGVIGTDGQFHEISVSREAAGFPKFKRNYSAVEFNLERPFDGKWYAKVNYVWSHSYGTTEGQVRSDLWRTGGALGSYQGQASVSTTQSWDHAALMEHFNGDQSNDHRHQLKLFGFYQFTPQWGASANFSLISGAPHNCLGNYYGTEYSGRDPAGYGGSAITGGPYHYCYNPETGTGSASPPGSQGRLGWIAQLDMGVTYKPAFADGKLALRFDVFNITNEQTATNIYPFSQLPDNTTNPLWDQVVAYQAPRSGRVTLSYDF

SEQ ID NO: 11395 - protein, 1739 aa, Microcoleus chthonoplastes PCC 7420
MNKQRRFLADATGGRARLVVMFVLFAMTLLAPGWAMAQASTYCPTLNATVVQGGSVQIDVTTCDGTGVDDIGVGWNGVQPAHGTIVVPNPSGAQGTQIVTYTHNGDNATSDTFPLEDGRSDIITVNITITPSQPTLSINDVSVNEGNAGTSNATFTVSLSQPAGAGGASFDIATADGSAIAGVDYVASSLTGQTIPAGSSSATFTVLVNGDTLSEPNETFFVNVSNVSGAGVSDAQGQGTIVNDDALPSLSIDDVSVNEGNSGTTTATFTVTLSAASGQTVSVNYASADGTATAGSDYVARSGTLTFAPGTTAQGVAITVNGDTALEPNETFSVGLSGASNASIARATGAGTILNDDVVVTVGPASLPAATAGSAYSQNLSASGGTAPYSFAVTAGALPAGLTLSAAGVLSGTPTATGSFNFTATATDSGGSPTSGNRAYTLTVAGATVTLPATSLPAGTAGQAYSGALNPATGGIPPYTYAVTAGALPAGITLNGSSGALTGTPGSVGSFAFSVTATDSTSGTPSQGTRGYTLNIAAPPIVVAPSTLPAATRGTAYSQTLSASGGTAPYTYALASGALPAGLTLASNGTLSGTATVEGSFNFTVTATDAGSFTANQAYSLTVAGPNLVLPASSLPAGTAGQAYSASITPATGGTAPYSYALTAGALPTGVVVDVATGGLSGTPTVAGTFNFTLTVSDSTPSPAAQASRSYTLTIAAPVIVVAPTALPAATRGTVYSQTLSASGGTAPYTYAVSAGNVPAGLTLASNGTLSGTATVEGSFNFTVTATDANTFTASQADAVTVAGPNLALPASSLPAGTAGQAYAATIAPATGGTAPYSYALSAGVLPNGVVLDTATGGLSGMPTLSGTFNFTLTVTDSTPSPAAQASQSYTLSIAAPVIVVAPTALPAATRGTAYSQVLTASGGTAPYTYEVNAGSAPAGLTLASNGTLSGNPTVEGGFNFTVTATDANNFTASQAYVLTVASPNLALPASNLPAGTAGQAYTAAISPVTGGTAPYSYALTAGALPSGVVLDAATGTLSGTPTVSGTFNFTLTVTDSTPSPAAQANQSYTLSIAGATLVPSQPTLPPAVRGTPYSQVLTATGGVAPYTYSVASGTLPAGLTLASNGVLSGTPTAEGSTSFTIAVADAGNATATQAYTFTVSTAAPVAVADAAATMSDAAVTVPVTANDTGNITAIAIATAPTNGTAAVNGLELVYTPAAGFVGTDVVSYTVTGSGGTSAAATVTIAVNARPIAVSVTAEAVPGAASQVDLTRNATGGPFVAAAVVAVLPASAGTATITQVGGAAAAAARTSGFVPAATAQASSPSFMLTFVANPAFVGQATVQFTLSNAFATSAAASVTFTVAPRRDPSVDAEVRGLIDAQSESTRRFAKAQIDNFQRRLEATHRGGSTLSNAVTFQPTSHCRQADRGISAQPCSPDTQDADNEFRDAPAMASGGNGGAQGQGDLGLWVGGAIRSGSLDRQANTNGVDFQTDGLSVGADYRLAPSLAVGAGLGWGRDDSDVGRNGSHSKATAYTMALYASFHPGKAFFFDTLVGYQLLSYDLRRFVTDDASMAEGSRDGKQWIASLSSGADLQRGNLQITPYARVDVARATLDGYVEDGIAPFALRYDDMDVATTTGNLGLRLEWRRDVAWGRLTPQVRVEYQRDFQGRGDATLGYADIIGGPVYRTGQNAFDRNRLMVGIGAALLTEQGLSTRLEYRGITDGDSGNDQTWMINLEKKY

SEQ ID NO: 11396 - protein, 926 aa, Microcoleus chthonoplastes PCC 7420
MIGPNTSIRDQGGGRPYTGEIFGAHCAKLLGEIRMTLRHLLLITTTAMVAAPVAAQAQSVSSNEADGIVVTGIRASLRDAIEIKRKASSIVDVISAEDVGKFPDANVADSLARLPGVTVDRQFGEGEQLSIAGVEPALNRLTIDGHSVASADWGGNPSDRSSRSFNYSLLSPSIISQAVVYKTPEARLQEGAIGASVDVVTRKPLDLDSNTFRFNGGYEYNDRADRGSIRGNALYSWKNADETIGILAAANYDKEQLSRAGVAVYWYRTGQALLDNAPSTATVNGKAITDLTEDERSEFASSRFASFLAREFFKQERERIGFNGAIQVRPSDNLKLTGTALIIRGNYDNVSNSMYTYGYEGSRLISAQFSGGLVTQATFSGIADGQTGSTGQLDTLYRRTRVKNDTYSLAYEWEPDGWHVTGNVGYTRASGGKDPEYLLDFRTQQGFTSGANGRNTTVDWDSPATDPTKWLSNYTANGGENITASDGRTFFGRQIGGIPTKSGFTLDKEWFTEANAVHDLNAGPFTQLLFGARFTSHENSNTTYSNAIFTDQDFTLADLDYNVLPSGLYDGLGTSGNGAPYVGMDKDGIIAALAKYGNFTDDRGLAKGEYWLVKEKIAAGYAQANFETGKLRGNVGVRFVSTKTESNFYAQSGSTVQLVQYNKTDNRFLPSINVIYDAGDTVVLRAAAAKVMSRPRYSDLAGYLSLTDSTLSGSGGNPDLKPYLATNFGFSAEWYFAPGSFLSGEVFYRDISNYVGNETLETELTNPITGNTLTYAVSRPVNGGKASVTGFSISGNTNLAWGFGIQASYTFADAETSKAEGLPFLSRNTIQISPYYENGPFQARVSYNRRSKYFYRFGRQQSQDYTDAYRQLDAQVSYAINENLSVTATASNLLDETYYQYSSTKNAPTSIYKNGRVYSASMTAKF

SEQ ID NO: 11397 - protein, 781 aa, Microcoleus chthonoplastes PCC 7420
MKNRTRVSSAALLLFALAAHVHAATDEGSVTGAVTDTAGQPVNNATVIVQDASGAAVGEAKTNAEGRFVIAHVTPGTYAVVVTATGFASGNNITTTGTGTQSAVSVSLAKSGTLDVQVNAKRLDRARNGLSPETGSSVYRFSQADIDALPAGQDTPLNQVLLQAPGVASDSYGQLHVRGDHANLQYRINGIIIPEPISGFGQALDTRIIDQVNLLTGALPAQYGYRTAGVVDIRTKTGEAGNGGSIDVFGGSHQTLKTSADVFGTQGPFSYYFSGSLGVNNLGIENPTASANAVHDHTRQGDAFGYMSYIINPLTRVSLMFGTTSNQFEIPNTPGLQTNFTLNGNSTFDSSQLNETQSELNNFAVVALQGTNGGALDYQVALFTRYTRTQFNPDPVGDLLFNGVASQDFHSNSANGAQVDTTWRLNDKHTIRAGLFFQQEHAVFDDSVNVFATDADGNQLSDQPFNIHDSSSKTGYLYSAYVQDEWKITSKLTLNYGLRYDKMDEYVSASQLSPRIGLVYALTPTTTVHAGYARYFTPPAFELLSGSTISRFNGTTNQSPSSQNDPVQPERSHYFDLGVTQRLGSNVTIGVDAYYKKSTNLLDEGQFGSALIFTPFNYQYGRVYGLEFTANYKQDNVSAYLNLAYSRAQGKQIDSAQFNFDPDELAYINSHWVYLDHDQRVTASFGGTYDLGRTTFTFDGLVGSGLRSGFANTDRLPVYAQINLGVIQHFNQPLVGKFDARLLVVNAFNRVYELRDGSGIGVGAPQYGPHFAVYAGITKHF

SEQ ID NO: 11398 - protein, 266 aa, Microcoleus chthonoplastes PCC 7420
MNPTRATLLAAGSLLLATQAQADGPLLWQNNSLSYLYGKNFKVEPAIQQTLTFEHASGWSWGDVFFFVDQKFFNGAQNGAGDSRSFYGELSPRLSFGKLLGKDLSFGPIKDVLLAATYEFGEDETEAYLLGPGFDLAIPGFNFFKLNFYYRQPDGNRADRDGDGKPDGSGVWQVTPSWSYTLPAGKSDILIDGYIDWVVDNDASYHSNYHINPQIKYDLGKAMDWGDKQFYVGVEYSYWKDKYGIQDSAAFSTNQNTASLLLKVHF

SEQ ID NO: 11399 - protein, 694 aa, Microcoleus chthonoplastes PCC 7420
MSPTAVIVCARRVGAMACAVVHPFRLFEVLLHRGWGHARFAQMFALSGLLMASAVHADTDLTALPLEQLMQVQVTSVSKYAQPASEAPSSVSVITAADIKAYGWRTLADILRSLPGLYTTYDRSYAELGARGFLRAGDYDTRFLLLIDGYRTNDSVFDEAAIGTDFLLDVDLIDRVEYVPGAGSAVYGSNALFGVINVITKRGRDIGGVQASGSTGSAQAGEGRVTWGNRSEGGAEWLLSATVSDAPGRDLYFPEFDRPETNHGIASGLDFDRRKQVFAKGSVGEFGLTFAHADRTKGVPTAPYDQLFNASQSRAIDARDILSATWQHAVDEASDVSARVYWGRYTSRGDYVIDYPPVTLNRDLFDSAWYGTELKFVTRRIERHTLVFGTELQRDYRDSMRNFDVSPYLSYLDDHRNNSRVGIYAQDQFALHPGWLLDMAVRYDRSTFVPGIFSPRVGLIWHAAPETTLKALYGMAYRSPNVYELYYQTSAPGGQETNPGLSAERIRTYEAVAEQRVGAMGKATLSVYENNVSNLISQMQDPNTGLLVFENVARTRTRGAELGYEQSWPGGTRLRASYSLQRSTDLDSGQVLLNSPRHLAKFNVTTPLWRDDVRLGLEAQYVSCRLAQLGQAGGFWLANATLLVARLAPDLEMSASVYNLFDRRYADPAGPELTQAVIRQDGRTFRLKFTYTLR

SEQ ID NO: 11400 - protein, 451 aa, Microcoleus chthonoplastes PCC 7420
MIMQKRLLTLAVTAALLSSTTQLHAAGFQLAEYSSTGLGRAFAGEAAMADNASAQGRNPAMLTYLEGRQLSAGGIYVMPNVDVKGDVSLSSPLLGPDPVKMQGGDALDVADSALVPNFYYSNQLNDQWTWGLAVNSNYGLATELPATHAAAIFGNKTSVTTVEFNPNVAYRINDAVSVGGGVRIVYGEGEIGASLPGWVDGIKPSLPAQVAAMLPPSGTELKSMKGDDIGYGWQLGASWQITPAHRLGLAYHSGVKLDLDGHASGVIYTGGQDVSIEGYLPLELPAFAEIASHHQLTDNWAMHASVNWTDWSVFDQLVAYFPGEVKPKGDLESDLVKEEHFEDNWRFALGTTYQVNNAWLVRAGVALDKTAATDEWRTTTIPDSDRLWFSVGAGYQASKNLNVDFAVTYIKATGDTPINEQQNLLNLATVNFNGEASGNVWLAGIQMSYKM

SEQ ID NO: 11401 - protein, 354 aa, Microcoleus chthonoplastes PCC 7420
MKSTLVSAAWAATVAAGAAHAGGIERRGDPSQILFEEGNQYLEFSVVHVSPNVSGTNTTPFPVGPTGNITENYQNWAFGYKHELNDKITLAFVLDEPVGADVTYDTAGAFFAGSSASVDSIAATALMKYQFSDRISAYGGLKLQGLSGSITVQSVAGTAPNPYTLNVDKDYQLGYLVGAAYEVPEIAMRVALTYESEIEHEFRDNTGAPFKVKTPQSVTLHAQSGIAANTLLFGSIRWREWTEFAVSPSDFVPAPIASGTSDVWTYTLGVGRKFSDKWSGAFSLGYEKDNGDVVGNLSGTDGYWSYGVAAIYQGEGYKITTGVRYIDIGSANTSVASFSDNDAVAVGMKVGWTF

SEQ ID NO: 11402 - protein, 382 aa, Microcoleus chthonoplastes PCC 7420
MTTYGHLNKDRHSLPFRLRHMKILPRTLLIAGCGVSLVSLAHAQSSALTLWGQVDSGITYISNKRGGASWGTASGIGSPTRWGLRGNEELGGGYRAVFALESGFNVNTGALIKTNTLFDRQAYVGLDGPLGTLTLGRQSDLMDDVAIRYSNAFWNRSLYSFHAGNLDSLTNGYQIENAVKYRSPDWYGVRVGALYGFAGSDASGHSAGAYATYDRGPLSAGVTYMTTKRRVLDLYNYFGWTRFLGQTLSAQQTFQSNAVDNLGIGLTYRIVQPWTINLLYTRTDIKGARSATHMQNIDAGTLYQFTAAEAVTLDYTYSRMEGMHWNTLEAGNLYSLSKRTQVQATLTWQLASGNGATAATYPNGPSSGRSQLLAHVGITHSF

SEQ ID NO: 11403 - protein, 41 aa, Microcoleus chthonoplastes PCC 7420
RKSRIRTKISDFGSFIGFKGSEDLGEGLKAVWQLEQDVSVA

SEQ ID NO: 11404 - protein, 237 aa, Microcoleus chthonoplastes PCC 7420 [sequence omitted]

SEQ ID NO: 11405 - protein, 984 aa, Microcoleus chthonoplastes PCC 7420
MAKTWATKCCSGTYKNNYQLCCGIKVLNVAKGRILVFSYVGYTTQEIAVNQPSLTVSLKEDTQTLNEVVVVGYGVQKKSSVTGSISQVKAEDMENRSVTTVQSALQGKTSGVQVISSSAAPGEAPTIRVRGFSSNVASDPLYVVDGVRLSDISGIDPNDIASIEVLKDAASAAIYGAEAGNGVILISTKKGKTGQGKVVYDFQYSIQSLGKMPKLMNAEEYATYMVEGGVFEQSKINNNWDGVTDTNWADVVFGNGQMQKHNVSFSNGNEKGNYYLSLSYLDNNGIVRGDADFYKRLTGSVNADYQIKDWLKVGTTNQIEKYNYRKLSGNNAYGSFFQAVMELDPLTPSTYSPDNLPANMQAALDNGKTLLTDENGNYYAVSNFVESENYHPMIMRDNTVPKNSGFNVNGSVYGELKPFDGFVFTSRFGYRLSGTRSSTVNLPFYGNSVQNNDYMSISGTSSTSIYWQWENFANYIKTFNKHTINAMLGMSYQESTYDYITSGFSANGADAITNRDPSFWYLNYGDPSASKSIQGEKTRTAKYSYFGRVGYDFAGKYMLQASLRADAADLSYLPLEKRWGYFPAVSAGWTISEENFFTPLRDVVSSLKLRASWGQNGSLAALASNLYGYGTTMVTAGYYPFVPGNNYTTGIRPNSLGNDELKWETSEQINVGLDARLFNDRLTLSMDWFNKKTKDLLITGTTPSLIIGGTTSPINAGNVSNKGFEFEIGWRDNIGDFNYSIKGNLATLKNKVTYLDPSLTRANGTTFHTNTITYFEEGYPVYYFRGYRCEGINPEDGEPIFADLDNNGIINEDDKTYIGDAIPDFTYGLTLTAAWKGLDLTIFGSGSYGNDVFSCINRPDHASANKLSEVFYKDRWTPEHTNATAPRANALSLDKYTVSDAMVFDGSYFKIKQIQLGYSLPKQWINKVFINNLRLYVSLEDFFTFTSYPGFDPEASANATSGMGIDMGTYPSAKKVMLGFNVEF

SEQ ID NO: 11406 - protein, 1353 aa, Brevundimonas sp. BAL3
MKTISAHCILPRLSARLRLSTALCAATLLVALPHVASAATFTVTEATDDGSGTVAGSLSWAIASAGASGDVIEIDPAVSTITVSGTLPAFAQDVTVRASAPVEISGSPFAASGTSLVLSGESSTNALTTALSGTLAGETGANGVSGSGGTNGTAGEAGAIALSGSGFSLTLSGSTTGGNGGAGGSGGLEHNPPGNGGGGGNGAAAFSGSDFKLENQGAITGGSGGNGGRGGHATIVDGGRGGNGGEGGAGIAGTGLVIENSGTITGGAGGHRGGGGGSAFGITGPAGSEGVGAAGITGSDLTIVNKGTISGGLSGGGVRANAIEFTSGTNSLELWAGSTITGNVVAGGSADTLILGGGAGASFDLTDLGSQYTGFEALSKSGTSTWALHGTSGAAASKLDVDSGTLVMDGAELDGTALTVGSGTLNLANGSTLTSSSANISGTGGLEGFVTLVDTGTTWNNGATLSVGTTGDGRLQIANAAKATAGETYIGRGSKGTLAIYGPVSSHTTTGDFHAGFNAGSTGTVFVSTGGMLKTQDAYLGYKGGSSGSVTVTHGSTWDGAGGAIWIGVNGEGSLLVADGGQVNTALFSSSSQATGVSTVKVTGAGSHLRASTSFRFGSRGKATLTVADGGAVTIGSGLGTMFLSDLATGKTTLNIGATAGDTAATPGTINAASVTSGDGTATIVFNHTGGAYSFAPNLSGNASLEVYSGTTTLAGNNSSFSGTTTVNGGILKSGSANGFARNTAYTVNGGVLDLSGFDLVMSSLKGSGGEVALGAADLTVNSSGDSTFAGVLSGTGDVIKQGAAGLTLTGDSSGFAGTTKVSAGRLTVNGSLGGMIEVTGGSIGGSGTLSALGLGSGGTVSPGNSIGTLTVSGNVSFAAGSIYDVEVDSAGNSDKIAAGGTATIAGGTVRVGPESGSGDSFTYNPLTSYTILTAKGGVSGTFDSVTDSFAFLNSELSYGATSVTLDLIRNDTSFADVARTANQRAVAGSLSGLASTSDLYRAVAGLNETQARRAYGSLSGEIHASLPSLFLNDSARLRDTVTSRIHDAFAGFSQMPEIAFNGPVGPRGPGLGTGSGFSLTTWGSAYGAYGKLDGDGNAATLSRSTGGALVGLEATAWPQARFGVLAGLGQSQASVSARASSADANSYTLGAYGGVRLSDLGLTFGAAYSWHDVTSERAVAVGSLKDTLSADYWSRTAQVFGEASYALETPWLLVSPFAGLALLHQQTDAFQEQGSAALALTGDGSSQLLGSSTLGLRMSKTLATTDGVSVALTGAFGWRHAIGDLTPDQRMALSGLDPFTVQGVPLDRDTALVEAGLALTITDRTTLGLSYQGAFGENARDQGANARINIRF

SEQ ID NO: 11407 - protein, 741 aa, Brevundimonas sp. BAL3
MTAAALLCAPAAGAEPSPPAYAPVLATRADLTLDPVIVTATRSRTALSRTPASVSVITDTDLEEQQADNIKEALRYEPGVTVRRSAFRPTSAASSGSAGGFGGNQGINIRGLDGNRILLMEDGIRLPAAFAYGPLNAGRGDYADMALLRSIEILRGPASSLYGSDGLTGAVNFLTKDPQDLLDVFGKASYFGLRSGYDSTDRSFGTTVSTALGGERFQGMLIADGRRGHAVDNQGSNGSAGAARTTPNPQDTDNTALLGKLVFKATARDTLKLTGESVRQRIDSDALSAVTPTLRSLRSADRLESQRVSLDYDHADAGNRWFQNAHALVYFRRAEIGQAQDEISVASQRSRNNHYRDHTFGLSSQLESNFRTGSLSHKLVYGADASFSRIDSDRSGTGPAASDNFVNKVFPDTGYALLGAFVQDEIRRGSLSVIPALRYDTYRLKPRNPGDPLYTGVQAGSSDGALSPKLALMYAFAPAATAYVQYARGFRTPTPDQVNNGFTSTAGSRVYYRSIGNPRLKPETSDTVEVGLRGKLDTTRGRIAYSVAAFAGRYRNFIDQVTVGGSITSPTNPLTYQYVNVSRAFIRGVEARGEWRLPAGVKLRAAAAYTRGTAEDAGGATTPLNSINPLQAVFGVRYEPGERWFAQTDMTWQMAKSPSTIRPPGTGATADFATPSSLVVDVAGGYRLNKHASLYLAVRNLLDRKVWNWSDVAGLGLAGSTALDAYTAPGRTFAATVKIEF

SEQ ID NO: 11408 - protein, 180 aa, Brevundimonas sp. BAL3
MKRSIIAAAVFSSFFMSAGVFAADVDTGTLTIKGNIAESPCKFEAGGDSVSINMPTVPTSVFEGKAKYSTYDDAVGVTSSMLKISCPKEVAGVKLSLITNDKITGNDKAIASSNDTVGYYLYLGDNSDVLDVSAPFNIESYKTAEGQYAIPFKAKYLKLTDNSVQSGDVLSSLVMRVAQD

SEQ ID NO: 11409 - protein, 826 aa, Brevundimonas sp. BAL3
MRTADAQSAAGPVPRPQPAVLRAGLHPAVAGETAAGRAPPRRRASARAPRLPRLTGFPATFIVRSRRIARRQRFVRSPGPICARADDPVRLSEIRRRGNPMNRDKFRRAARPHLPKTFSRLLPHWRRAPAHAALLGLLASGSLPAAEPEDDSDSLQMSPLVITGVALDAPLTVVTDPRIPRQPVPASDGADYLKTIPGFSAIRSGGVNGDPVFRGMFGSRLKLLTNGGEMIGACPARMDSPSSYIAPETFDELTVIKGPQSVLHGPGASAATVLFERNPERFDAPGGRVDMSFLAGSNGRFDRRIDAAAGAEQGYFRLLANRSDADDYEDGDGDTVPSRWDKWTSEFVAGWTPTADSLLELTYGIGDGESRYAGRGMDGTRFDRESLGLRFELENIGEVFQKVEARLYYNYADHVMDNFRLRSPDADSSMPMPMASNVDRRTLGGRLTGTWRWEHYQLVAGLDYQTSEHRERSSTYTSASHGMSMGHHVMTSASFVDADDYPWNKDADFHNFGLFGELTRHLGDASRLVLGARLDRSYAEDHRDTLSGSMGMSSWNNPTAGKERGDTLPSGFVRYEHGLAGIPATAYVGLGHTQRFPDYWELFSSTNSMGRTSAFDSIHPEKTTQLDFGIQYARGPLEAWASGYLGWVRDFILFDYASGMSGMGSSSARNIDARIFGGEAGLSYRLSQHWKTDASLAYAWGKNSSDGRALPQIPPLEGRFSLTYEQGDWSASGLWRLVARQTRVAEGQGNVVGQDFGKSAGFGVLSFNGAHRFNRHLKLSAGVDNLLDKRYSEHLNLAGNAGFDYPGDTRINEPGRTLWARVDLSF

SEQ ID NO: 11410 - protein, 575 aa, Brevundimonas sp. BAL3
MLLFSTNAQEKKRDTLAVVEVVNILTKYNPKIATVKKIEKNPTNTLLEKNNKVKLKYAIFSAPVASTFIPQTGALKALEIGIKEKVYTNYLATGYGNYKSPYAELYISKNTRFSNVFGLHATYNAANKNISKTILNSTFSDFSARSYYTQKEGFFDWKIQADLQSKHYNWYGLPQDRNFTETVVNGIEEAQNYQYLALTGNFNFYDSYVKTGNVSVRYLTDTYKSSEVLLHFNIDSSFPIPFFRNTTDEISINGGLEFLKGSFENNYQTAKAVNYQQNTLHIHPQYETDYHDISIKAGLQTFLSVDSENKLTNFFMFPEVLLQTDLYKKYIRGKIGFTGNLQTNTYQQFSEENPFVSPTLFITQTAETSNLYLAFNGSISRELSYNFKVSIKQEEDKPLFLRNKSKSDGTASAVNDNLKGYEYGNSFAIYYDDIKTSSIFAEIEYQYTQPLRLSVQIKYDHYATTNALENWNLPSVKGTFLANYTTQKWDTNITAFYVSERRDALYNSPSNSFPPAIARLNSFIDLNMYTGYHISNQFSAFLKLNNLLNTKYQRFANFDTQGFQISGGITYKFDL

SEQ ID NO: 11411 - protein, 992 aa, Brevundimonas sp. BAL3
MRHHHPHSARPARKLLSCALASCLLLGAAPAFAQSTAATIRGQVTVDAAPAAQAQVTATNLATGLTRTVQVSNGGYSVGGLPPGSYRIDVTANGQTSSQNVTVQVGQTATLNLGVGGEPATAAGGNATTLDAVQVKAPPVLVETRTSENATYISNVQIQNLPRATRNFLELADTVPNVQFTRDANGTTKVRTGATSAEGTNVYIDGVSQKNYVLTGGVSGQDSSRGNPFPQSAIGEYKVITSNYKAEFDQVSGAAIVASSKSGTNDFHGSFFWDTSNDSWREESPLEKKAGVRDDFEETQYGATFSGPILKDKAHFFIAYEAKEYTTPNVVIPGSIYSDRVDQLPAQLQPLVVTSSTPFKEDLYFGKIDWTIGENNLFELTGKYRKEDELNDVGRTSTYEHGSINGQEEKRANLRWQYSGANFLNEANLSYESAFWNQAPINNGNGYILSYAPVRGNETDILAAGAGSSFQRKGQKGWTFQDDLTLNSLEWHGAHTVKMGVKFKSIDLDSTQFNPANPQYYYNILTDVQTPYRVRFGAPLVEGGGSVVSKNKQYGIYLQDDWEVNEHWTLNLGVRYDYEQTPAFLDFVTPSDVASALQNWPNLRNANYNINDFISTGNNRKAFKNAWQPRLGASYDLFGDQAHVIYGGAGRAYDRNIFDYLALEQLNNSFKSYSYYFTSANNPACLGDPCTAWNPAYNSQDGLNTLTANSTGGGGREVYLIDNNLKTPYSDQFSIGMRNMVPLWGQDWFTDVTLSRIESHDGFAFVRGNRLPDGSFFQPGTTSGVPTDGPNGYSAIVLGTNGVETRNNQLALQVEKPFDEESGWGLTVAYTYSDAKENRQFGEHYALDRERIQDYGWREAGGIPKNRLVVTGIYELPYEIKLSGKLSLASQTARYGQNCLAGNDQCEIIQFKPDGTLGYKEFSIAANKEWDTGGGVKFNVRADILNVFNWVNYATFNGDTGTLQDLNTAYGTPTGVLASPMRTFRLAFGLNW

SEQ ID NO: 11412 - protein, 95 aa, Brevundimonas sp. BAL3
MTPAFYAGAAYTYTQARADSTAGAFHPKWRPLSTKLDYDLSKRSSGFAEGVYQHAQHAMNARTGTDFDHAYIPGAANIASGPNQYVVRPALLHPF

SEQ ID NO: 11413 - protein, 2191 aa, Brevundimonas sp. BAL3
MASWFSFIPSLSLPSFSLGNPFSTRTDTGFVTATEGVTSREMVSSTGGESRADNSGGAASIQIQAKIIPVLNQIRPISACHSRKDNVFVPGMIRNVSDSSVRVASGVGAAPRVVSSANSVPGVPGGVPGGVPGGVPGGVPGGVPGGVGVGGVPGAVPGGVPGGVGVGGVPGAVPAAVPGVPGTGSLPNMELSDTLDTMQDISGSQHTRQARSVDEGGGSARGAVGKAVAGKAGVPSGLGGELVSVLDVPETVSSRRLFNIPRKNSLNGEGQPYFAVREDVLSVQKAQKVSTDATDAVAGMSGISSAVLDSLLPDSSGSLVAGVSVSMPIDDGVGAIGFIDSSKAGEKLVDLLNGDQSVYGAVSCNEGGVYSLQGGTIIAEPSEIAVDVEGNGYSQGGQEEKIIVNLDEISIQSVKNEQDLSESLFKVEMKNIVNLSMNSVGAENPLYIGVRVNGDSNSGSAEANLKDSNIQGFFVGLQAEAAGKITMRGGGIRGAYVGALAADSGMIFLENVDVNINRIGLMSLGPSIIGMTSGKITVKEGGVGVLSVEGGTVHLDGVTIKVVEKQKAKKEDTPEMSIGLLSRGGVISFKNGKFEASNAIAFWVSDNFDSNTFRVPNEIEVQDVNPNEGVQVSDVNAVAGEVVSIGSEDGVVFNNIGSAYIEALTSIESFLESDTSSGSADAPSEVVDGDSVDRQSSDSRIVSLVVSDIQNSAIKVKGKSYGIFFEGDIHQSVEKRNDQDGLQNLVDDGRKGNEDIWHAVLLKNTALRVPDGVVIYGDSFGGYVVVKDESTLSGDLLLKAEEGSDLSVFVEDSVIMGGAYVDKKSHARIFLSGGSEWYLTKNLHNSLGNSDMVCVDSCLSSLKLVDSNVRFFTSLKDEESSQGGNVEYRTLRIGDGKGIVYTASDTPSAIIYFNANLMPSNTDNSQISDRLLIHGNVSGKTFVVVNDTSNGVQQNHDTPHSISIIQVFGKAEKDSFKLKGDYITREGLPYKYVLRAYGPTIPPKMQYFDNTLLINSTDVWDFRLENEYFIPLVSAYTATADFQPIFKAKPRSIVSSTETEIDADTGAGELNNESITLSVSGESASVIPARGDSLLRSESSDGFYEDDEEESLEESDTSEVITSSLVTPPSSGDPGSLVPPRVSSLGSLDTGSRGIISADETFVTPGYIVPRRPAPIKSAAVMKSSAPVVSNTSVVSSNGVSSPAASEMSVVSSNGVSSPAASEMSVVSSNGASSPVASETSVTSSNRAVGRIFMIGRSDNGGVSTKGTASSTCGDTAGENGARGSQTSYLCSDGQSRIITDLTLKVSDKIQRPIHVRNQNTVIKLERTTISGVDFSESENNVGFTERQAVSAVLAEDKAEVVLDNKSAITSSVIGLEAQRSGKITMNGGTVNAHYVGAFAGSRSSINLNDTTINVTGKFAAAGLASEAGEITMNTGAITLAKGVAVRSEAGGSVRLDKVDITLKKEAGKLDSAENLERAAFLLSDNASINFRNGSITTDANALWFINDDSVVEAGSTRRRRSPEVRSAMNHANIESSTVRVEGEGTYGIYFDGLIQKEESEQSQSKDLATERANVVKRNAVSKQEKTPVSITGTVSLKKTDFEVAKGIAIYGNNSGGHVSLENKTTLAGDLLLKAENDSHILVSVNNSIVTGGVRVNKDSYAKLDLANGSEWILKRSVQKDLGASVLGCVDSCVSSVRLINSAINFASSESAGKYQTLHIGNGNGTVYEAQGDAVIHLNARLNPHDSSGQQVTDRLIIHGDVSGKTKIHVRGDAGNGGNGQANAKIAHSVSVIQVYGQAKKDSFQLDGNYVALTNSPYKYTLRAYGPEMTSKQEHVQQKFVKDGGEFWNFRLENQYVKSAGSAGLPEQFVRSVVPQVPTYLVLPNSVFHTGLMDISNQNKQLETLRMTSTGMLEARENPALYLRGYGGSYRYASDLSALEYGYGGELDYRGVEAGVLLQTIENTDSVLSFGVMGTYGRLSLQPLDVEQSQKSAFDKWTATVYGSMQHNIGFYVDGLLSYGLFNGDVLTTARGKTATLKGNPLSVSLSGGQTIATGYKGFVFDPQVQVVYQHLQFNKARDIDNFDIEMGNLDQWVARVGGRLTKTPTGSEGVDAVAFYGKLYLAHGFGGKQTVHFNDAFKLGAFGSALEAGLGFNAKLLPQFSLHADILYQHKLNKAGFSGASFSGGVRYQF

SEQ ID NO: 11414 - protein, 384 aa, Brevundimonas sp. BAL3
MKLKLLASVAAAGLFAAGAASAEPDGWYGAIDAGYHIIDDINTEASTNGHNWNWEVNDGWAAFARLGYRFNPNWRVELEGGYRSGDIGTVRAVSGPNGLCNLTPATGPCHSPEGDITSTTLMANVLYDFGSPEWTIRPFVGLGVGVNRVNVDTVGRLRQTPAVNFEADDRSYKFAAQALAGLAWSISDRANVDLTYRYLTGDAEFDTSVSGAGAVPFGSMSGDYDQSHTVTLGLRYAFGAEPAAPPPPPPPPPPPPPPPPPPPPPPPPPPAKPAARQFVVYFDFDRSDLTAEARSVVTQAANYAKSGAPTRVLVVGHTDTSGNAAYNQGLSNRRARTVADALVAQGVNGGVISLDGKGETQPAKATGDGVREPLNRRATVDINF

SEQ ID NO: 11415 - protein, 851 aa, Brevundimonas sp. BAL3
MINRKIRLLLVCSVAAIFAPGVAAQNAEADAVGGGSGLDEIVVTAQKRAENVQDVPIAIAAFGGEAIQQRGISDVSQLSSITPSVVLDAGTPFAGSGAALGATIRGIGQNDFAVNVDPGVGVYLDGIYLARTVGANVALPDVERVEVLKGPQGTLFGRNTIGGAINIVTHEPGDEFRFKGSVTTGRFERLDVAGTADIPLSETLKSSITFASNHRDGFVKRVPYTQAGPYVQEPNTLYREVGYDSSSREGGVGDWSLRGKLKWEASSSLKVTVTGDYYKQNTSGLPNIVLDVLDDYPGDFAGPGAPLVPGSALTPGTGYNFAGLYNFCINSTPAQIMGRNAQSICGPRGNELNPSTILPALGSANVDADPSNNRLPYDDRWVSTNWNRSYATGNSFARSKTWGFSGALDWSLSPDITLRSITGYREMEWASGFDGDNSPINFLHVSNSAKQHQFSQEFQLVGDTDKLGGKLNYVLGAYYFSEKGSEDGFVTIGTGLLQIEGPIDVKNRNVSFFGQLDWRVSDLLGFTLGGRYTSEKKAFDARQTDYAGFSYDLFNCPVTVAICPGILGFPDPNDPLRVYPPNTPDRKFHNFSPKFGVQLHPDDDVMVYGSYTMGYKVGGWSTRLQNPTATAPTFDDEKAKTLELGLKSTLLDRRLRFNAAVFRTIYDNIQLLFQRGTNPLIENAGKATIKGAEADLTASINDYLSLTMSAGYLDAKLTEVIGPTGPDSVQLGTSVGARLPKVPKFTFNLSPRVTLPVGAGDAKLVFQGDYTHTSSMWNDAQRTFLLKRPTTDVFNASLTFRSGRNWSVTLGGTNLSNERYVVNGVAQKAGGLVYGSPNRPREWYARLGVEF

SEQ ID NO: 11416 - protein, 737 aa, Brevundimonas sp. BAL3
MLAVSVSSWAQNVTPTPSATPAASSTQAEGKTLAPVVIKEKAEAEEGKDSVRATRSTIGKGNQELRDIPQSVTVVTEKLIDDRNLDTVKEALKNTAGITFLAAEGGEEDIRLRGFALQSTGDVFVDGIRDPAFYERDTFNLDRLELLRGSASMLFGRGSTGGAVNQVSKLPRLINENEISTTLGSHNYKRVTGDFNIKTGEDAALRINAMATKADNNGAGSSIDKKGLAVSYRLGIGTADEFLASLYYLDNNNGINYGLPWIRPNASSPARDTTILPVDPKNYYGAASDYNAGSATMATLGHIHRFSSDSELKTQLRVGKFERDQRASTIRLGAAALQPGGVAATLASFGPNTVLTRGTQLKIQNLDTVNLQSDFSTKFAALGVQHELLTGVDFSQEKKSVYAARTAAQGGVNLTKPNTLAGTPDDGASILESRRVLRTSSDFSSDGVGVYAQDLIQIAPHWKLLAGLRYDHMKGNYNTFSIPAAAAGPVTTTSYSQSIGEWSKRAGVLYQPNPLHSYHVSYGTSFNTSGDTYSYSAATVNTPPESSRNFEIGAKLDTADKRFTTRLAVFHSTKLHERNTDPLLNIAVLSGKRHAAGAEIDITGRLTPQWEIYGSYMWMPSARIDIGAEGAEGQGSRPSLTPRHSGTVWTTYQVTPKVRVGGGLNFRGKQTPNRNPGWEVPSFVTADLMAEYALSDQITVKANLSNVSNKLYADALYSGHYISGAGRIFQVTGTVKF

SEQ ID NO: 11417 - protein, 426 aa, Brevundimonas sp. BAL3
MASRRFSKGVTSLVLLSSLASPSFAGGLERGGYNIDQLFDTSPFSFQSGVTYVTPQRKLKDVRDTDTSTSPGGGNLNSRPNTADDSSNYTIPYIGFKAGFGDAIDCLVDYSEPFGGHTDPGLNWAGANNNIETEIKTRNYGGTCSYRFDVGPGQLRFIGGAFYQEVEGFKERLVSTVPLLVGTGNGVGRLDLEDSGWGWRAGLAYEIPEYAMRASLVYNSRVKYDNLTGTVDLTQVTAPFAPLNGAPYGRVTDVFGSAEAPDSLELKLQSGIAPDWLAFGSVKWTNWSVLQSVPFCPKSTKGLVACTSGGATELTSLDLLYQDGWTITGGVGHKFNEQWAGAVSLTWDRGTSQGYGAQTDSWTLGLGAAFTPTEHIEWRVAGAVGVLTSGSSGVVTQNGVTFGDDVSYSFDNDMVAALSTSLKIKF

SEQ ID NO: 11418 - protein, 824 aa, Brevundimonas sp. BAL3
MIERIEVITGGASAIYGSDAVSGVINVILRDDYEGLEFRFDGTTDLEGVGNRTNNFSALYGHTTDDGRGNITFFAEKNNINQVMEPDLQQAAAWGTIVNPADTGENDGIADRLRVPFVGSEMINQFGVINPFGGGPRITFMPDGTPMDQVSRLETNSFAFGSFDQRYDTVFFGEDYVNYIPDQETVTLASTFRYDITDNVRFYGDVKHVDKKIEQQFQPSFRFGGVFVDVEDNAFLDDSTRSRLLDGGQSVVEMSRFFTDIGNRTASNDRELFRFIGGFEGYFSLSDTEFDYDVYYTRGEVSNVRRTLNDLIPTNFLAALDSVIDPETGQAACRSQVPELQGDDYEDPALVNPENCAPFNPFGFGQASAASADFIAGDVQREDEITQEMIGGTLAFDSAEWFELPGGPLGIALGYEYREEEVETTTDELTQQGVFTNAATPNSFGGYDVSEFFVELRLPLLSDVMLAKELSLDAAYRTADYSHAGSADAWQVGFMWAPIEDVRIRGTVGEAVRAPNVDEAFSPQSPGFANINDPCDADNINDDPDRAANCLALGIPAGFEANDNVSIETVSGGNPDLFSESSESKTVGVVWTPEFLENFSVTLDFYDIEIEDAITEVGAQDILDNCVDATGGPDAGFCSQIDRDENNDVEVVRSGFINASALKTSGVEFQVRYTTELGDLGLPGELRLNLQGNKVNELEEYAFQDRPDEINVEVGEVGDPEYQLRTIVDYRLDEWNFNYTSRFIDRSALFDVSPGADSPEDVSPAFVGSIWTHDFSIEYTYNENVDVYVGLRNAFNKVPPGYTFNPLYDLLGRRLNAGITVRFE

SEQ ID NO: 11419 - protein, 219 aa, Brevundimonas sp. BAL3
MSESAFKDCFLTDVSADTRLFHFLARDYIVQEGQQPSWLFYLTRGRARLYATLANGRVSLIDFFAAPCFIGEIELIDKDHEPRAVQAIEECWCLALPMKHYRPLLLNDTLFLRKLCVTLSHKNYRNIVSLTQNQSFPLVNRLAAFILLSQEGDLYHEKHTQAAEYLGVSYRHLLYVLAQFIHDGLLIKSKKGYLIKNRKQLSGLALEMDPENKFSGMMQ

SEQ ID NO: 11420 - protein, 337 aa, Brevundimonas sp. BAL3
MSEGWNIAVLGATGAVGEALLETLAERQFPVGEIYALARNESAGEQLRFGGKTITVQDAAEFDWTQAQLAFFVAGKEATAAWVEEATNSGCLVIDSSGLFALEPDVPLVVPEVNPFVLTDYRNRNVIAVPDSLTSQLLAALKPLIDQGGLSRISVTSLISASAQGKKAVDALAGQSAKLLNGIPIDEEDFFGRQLAFNMLPLLPDSEGSVREERRIVDEVRKILQDEGLMISASVVQAPVFYGHAQMVNFEALRPLAAEEARDAFVQGEDIVLSEENEFPTQVGDASGTPHLSVGCVRNDYGMPEQVQFWSVADNVRFGGALMAVKIAEKLVQEYLY

SEQ ID NO: 11421 - protein, 1537 aa, Brevundimonas sp. BAL3
MVAKKVSRFPKSTFSHSVVLAILVSTGMTANNHRLYGYETVSEAFLSDSSLKTQLETTSAGVFRKVKSTDTQEVQKENKEENTPVETSFIENASSCSVAILGSECGQRQHLVNASTLFEISDSLSWKSIDGELSKSSKKSATAEDAERKYLVDDSSQGLAFCYKNPSDCVVDETTPGFLGVALVGVGSTSGLSFSNLKSLSAGSAVYSDEDVVFEHLKEKLFFEGCESQAGGGAVSGRSIAINGCHDVSAVSCKTDLDLASSEVVDFSKGGGAFNAHKVHGEAHKSRFFTGEIIFTANSGNVLLDGNHADKANGGVVACGAFVCSVNRGDIRYTSNRALSGGAVSAFKSIDFVGNVGLIEFVDNQALISPESSLFLGGGALASGERISFLNNGGIHCCKNTSKSSGGALLSRDVRIVENIGNSLFKENSAQVVGGAISSQNQVEVGQNFGNITFEGNTSKMGGGAIHCLSAQQPYTSSEEALEGSGDIKIVDNSGAVNFASNENLLESQETHSHIGGGALYGSNVLVSGNIGEVTFSKNTAGQCESDSTCIGGGAVFANEAVRIVDNSGAITFSYNKGTILPFPKVAASSEGESAPEAPKESSPVDLGVRGGGAIFAKRIEIADNSGVLSFSDNFMKIRDNKAQKENPLGGGALFGIDEVGLKNNKELAFTNNHVSGENSSGGAVLSKVVTIADNGKVQFFRNYSNFLGGAVCSLGDALNIKNNESSVSFIGNRTVTAGGALASAAGDVSISKNLGKVEFKDNLVFGDSRVDNLEEGQLNTTGHHSGGGAIFAKASVVIRENKDQVLFSGNSSGCFGGAILTGSLTPEDQERFASKVVNDNTKVVITENIGDVVFSGNSTTASKHPEHNLFGGGAIYTQDLIINKNAGSVAFYNNYAPTGGAVRISEKGTVILEALGGDIVFQGNRNSEDISNGLYFAGKESKLVEVSASGEKTVNFSDAIIFEDLTLRQGLEGREDILNDPTLVLNSKAKDDSEVSHSGNIRFAYATSKIPQVAVLESGTLILSDNAELWLCGLKQEKGSEILLSAGTVLRIFDPNAKPEEKPESPSARSYYSAYDSARNPEEKTLADISVIGVDLASFVASEDEAAPLPPQIIVPKGTTIGSGSLDLNLVDSAGVGYENHALLNKETDITLLSFRSASAVSDVPDLDHALEELRINVSVPKITDDTYGHMGKWSDPQVVNGKLTINWKPTSYKLNPEKGGSIVLNTLWGQCGDLRALKQQHLSHNITAQRMELDFSTNIWGSGMGTFSNCATIAGVDGFTHRAGGYALGLDTQLIEDFLIGGSFAQFFGYTDSQSFSSRSDQSGYLGTGYVGIFAGSWLFKGMFIYSDIQNDLNTTYPTPNIGRSKGSWNSRGILADAHVDYRYIVNSRRFISSIVSAVVPFVEAEYVYIDLPTFAEVGSEVRTFAEGHLQNIAIPFGITLEHNYSRGQRSEVNSLSFSYALDVYRKAPTVLINLPAASYSWEGVGSDLSRKFMKAQFSNDTEWSSYFSTFLGFTYEWREHTVSYDVNGGIRLIF

SEQ ID NO: 11422 - protein, 709 aa, Brevundimonas sp. BAL3
MLALLALIPVQEAPPASPSPAQLEEVEVVGRRGAARVAPEQELGPEEIDNLGAYDIGEVIARLSERLGFQQPPVVIVNGRPVVDARNFTGFPPDALVRVEALPPQAGALYGGDPGRRVVNIVLEPEFRSRDALAKASRPTAGGTTTLSLDARQSEIQGSSTFQMGLQGARTTPLWADERPGYGRDHPGGGGNTLRPQAQTGSVNLSATGTLSDWSTSFSANLQTRQDRFVSSSVAAADRAETRQETDALTMAGGLAGRALGWSVRWGLDGLVSEGRQRGATDVTARTVSAVAKLSADRTLIDLPAGPAQMTVDTQYLRSRSDIRAAGVTATPSSRALELRSGLTLPVTSSQSDRGGPRRLLGDLALNLGGRLRLLDEADAQGTGLNAGVAWSPSGRVRLGAQFAQATDAPTREQRFDPIRYGPPRTFYDFRRGEAVEIQPILGGAPDLQAQETQTLSLSGSTGPFGAWGLQASVDLQNTRATNAIGALPALTPATETAFPDRILRDASGRLTGIDQRPINLKAISSQTLSSGLTANIPLGSGAPEASRRGSVQVAFNHTWRLEDRITINEALPRLDQLAGDGGGLSRHQLALRLDGRYARWGLNLAATWRSGARLRRDLGQDGPDDLLLSPLTLIGFTLSTVLSSPRSEASDTGPRRRTQGLRLELGVENLFDARPTATLGDGRPAPAYGRDDQDPLGRVIRLSLSRRF

SEQ ID NO: 11423 - protein, 731 aa, Brevundimonas sp. BAL3
MIIDIICFYIYAYIITIALRYKKTNINLLEAYKMSNKTIAFALVVASSAPVIAADNDNIMVVTASGYEQKIREAAASISVISQNELRQRNYNDLAQALSDVEGVDVNSSTGKTGGLDISIRGMPSAYTLILVDGIRQNGTSDVTPNGFGAMNTSFMPPLSAIERIEVIRGPMSTLYGSDAIGGVVNIITKKITKAWASSATLEHTFQENTAFGDSSKFSFYSSGPAVEDQLGLSLRGTIFRRDASRVESSNTGVELSRRGPNPVKADNYNLGGKLFWQLNTQSTLWLDGDIANQKYDNSANQLGTIGARGGYEDTLRYQRRKITLGNDNRLDFGTWNSSLSYNQTENIGRLITNASVPQGSGLAGEKRLLKNTNIILDSKLVAPLGDNHMVTLGGQYWNAIMKDGIVLANNGDEFAQDAWSLFSEDEWRLLDSLALTYGARYEYQTTFGGHISPRAYLVWDAQDNWTVKGGVSTGYKTPTLAQLHNGISGVTGQGTITTIGNPKLEPESSVNTEVGVYYENETGFGANVTLFHNRFRNKINSVSIDNTTSTYTNVGKAITQGIEVASTIPLWSDDWMLGINYTFTDSEQKDGNNKGARLTNTPKNMVNARLNWNINEQLSTWLKAEYRSKTARFTQNYANLSAANKVVYNNLGSEFKPFSVLNLGVAYKVTKDVTLNGAVNNLLDKDFTRTHIFAVGNGTTTAGDYFTSSQSTAGYVVPGRNYWVSVNVNF

SEQ ID NO: 11424 - protein, 818 aa, Brevundimonas sp. BAL3
MNRYRILAGIFCLLATGNVLAEEADTLKVVDVEEITVIAAPKENRKLREQPAAVTLLSQQDMQNAQVNSIKNLTSVVPNMFIPDYGSRLTSAVYIRGIGSRINTPSVGLYVDNIPYIDKSAFDFSYADVERIDVLRGPQGTLYGRNAMGGLIKVHTKSPFSYQGTDFRMGAGTYNAYNTSLTHYHRLSERFAFSTGGFYDYQGGFFRNTVRDEKADKGQSAGGRIRAIYLPSDNWKVDLNINYEYSDQGGYPYFYQGSLAPEAQSEPLKPYIGKISNNARSNYYRNLLNTGLNLEYQAQHFTLSMVTGYQFLKDCMDIDQDFTANDIYTLQQKQRSHALSEEIILKSKSGSRWQWTTGAFGFYQWLNTEAPVTFREAGMGMLNQMLGSVIPSQIQVEMGPSMSMNILPSLGISSRTMPIGGSFDTPLLNGALFHQSTFRDLFGLKGVSFTAGLRLDYERMKMDYNSGTSLDYKVGIKGEMKRGDVVIREIEMMPETALTVESRYQGNIDKDYLQLLPKFALQYDFARNRGNVYATVSKGYRSGGYNVQMFSDLLQSSLKNDMMRQSKEAIMPNVPDAYKELVGKYFPDAGENPDAKSATVYKPEQTWNYEIGTHLNLLDGRLHADAAIFWLETRDQQISRFAPSGLGRETANAGKSRSQGAEVALTAAVATDFTLNASYGYTYATFKDYITNEKVNGELQEISYNGKYVPFVPKHTMNVGGQYIFRIRPGHWLDCIQLNANYTGAGRIYWTEKNTVSQAFYGTLNGRISFQKGHGQIDFWVRNALDKEYASFYFESMGNGFMQKGRPVQAGIELRCRF

SEQ ID NO: 11425 - protein, 713 aa, Brevundimonas sp. BAL3
MEDNKMAANSAYLSHPFKTSVISSSLAIAMGLSLAPQAMADDSELANIERLEVHGQQTENRNTLGSAENLLKGQGVDFSEAGGVSALPILNGMMGDRIKVLVDGADITASCANQMNPPLSYISANQVTTAEVIAGVSPVSAGGDNIAGVIKVSSLNPKFGESDSIKWNSGDISTGYRSVSDTLLLGTNATVASNNISLSYQGAYEDANSYKDGNGDKVIDTLYRAQNHALTAAWRDETQQVAIKLTHQNIPFQGFANQYMDMTDNKSYGALARYQLKLDDDGEFSAQFNWHGVKHEMGFFTPEKTGKMPMNTEGDDYSYQLHWRLPMGDDSTLLVGQEFYSYQLDDVWPAVPGTMMAPNDYININDGERRRAAVYGEWQQDLSSSWWLSAGVRFEYVTTNTGEVQAYSNMPMMGMPNMDAAAAQAFNAMDRERNDDLIDATLLARYQLSANQQLEFGLARKNRAPNLYERYSWGRGTMATTMIGWYGDGNGYVGNPDLKPETAHTLSAAYKYNGDSWQVSTTAWYTAVTDYIDAEVIGSFNRTSSADGKRNILQFTNLDANLYGARFNALYQFAETSTGKWQVLGKVNLTRGERDEGNEPLYQIKPLQTELALQHQLGNWENSLSWQWVATKDRVDDRRLENETDSYSLLNLNSSMKWQDLTVTFAVNNLLDSYYELPLGGVSVAEFKADNTNGFNQIAGAGRSFELSASYAF

SEQ ID NO: 11426 - protein, 671 aa, Brevundimonas sp. BAL3
MAWRGCLLFVACSMPWTAWGGGSEAPATEVASSEASTAEAPPDAQVAQADAGPEPALDAEALPEARTVVTASRSPERLEDSAVATEVITRSDILASGARDASELLAAHPGLQVVQTFAGATVQLQGLSPEYVLVLVDGERVAGRVAGSVDLSRLSTEDIEQVEVVKGPSSVLYGSDAVAGVVNLITRRARRPLGAELRASYGSMQRLELDATGEAKGENWGLRLSGGLARRDAYLLDPTSIGTTGSSLDGIDASAGGDLRISEGTALQANATYARRVQRGVDVGVTGAIFDRASRDDSLSVRLSPQWRLSNNASLRVDGAYAWFNRRYLRDQRRSNALDTIEDTREQQGRLGAQLDAKLGDTHAFVVGAELLGEWLQADRLGEDGTGQRARASIYVQDNWTLVPRLKLTLVPGARVDTDTQFGTAVTPRLAARMDPTSWLTLRGSYGWAFRAPGFQEMLLDFENPSVGYRVHGNPDLRPERSRSFNLSVEVKPAESSLLWVSAFQHNLQDMIGVSTEVVGPQQLFTYVNIARARVRGGEMGVRQQLPGRISAELGYTLTDGRSEETGLALEGQARHRLTAQATWRHRTSGLEAWVRGALVGPRPFYPDTDGDGVANPYDAKTYVTVDARLGWRMREELQFFVLGTNLANAGNPTDLPIPPRAIQAGISARL

SEQ ID NO: 11427 - protein, 709 aa, Brevundimonas sp. BAL3
MSLLRLDRLHYCILMSMGCISSPLVWAEDLNSDVAQLPTLHVEATRTDTGYLQTPASVFRIEAPQVDSSSQVNLTEVVKGIPSLQIRNRENYAQDLQLSMRGFGARSTFGVRGIRLYVDGIPATMPDGQGQTSNIDLSSLDHVEVLTGPFSSLYGNSSGGTILTSTKEGQGKDSIELSYSGGSHDKSRAGLVLQGGAKGANEPSYIISSSYFDTDGYREHSGAEKVLNNAKLSWNLDDGSKINWVTNYVKIHADDPQGLTHDQWNANPKQQVPFLKQFNVRKDIEQTQTGVTWSKPINDKNELYAMAYLGNRQVTQYQSIPKSTQDASINHAGGVIDFERNYYGADFRWTGKELLPNTTLSVGVALDAMDEDRKGFENFNLVNGQPSYGVKGNLRRDEDNTLWNIDPYLQASWQFLPTWRLDTGVRYSNVHYKSEDNYLSNGDDSGKTDYDKVLPSVALSWQILPELMAYVSYAKGFETPTFTEMAYRPDGQSGFNFDLTASTSDTYETGLKSQNQLGDFTLAVFQTKTKDDIVSAGNSNGRSTFRNADKTLREGVEFAWNKKLWRDLIATASYSYLDATFDADIPALGNIAQISSGNAIPGIAKNQAYASLAWQPSHGLYGGVDVQYMDKVYVNDTNSDAAPSYSVTSANVGYAWVMGDWKVNSFARVDNLFDKKYVGSVIVNDGNSRYFEPADGRNWSAGLRVIKQF

SEQ ID NO: 11428 - protein, 1612 aa, Brevundimonas sp. BAL3
MGAAIQQNRTTNNGVATTVDGVGFDQTAGLVNVAVAPNAVITANANNGINLNTPAGSFNGLFLNNANNLAVTVSEDTTLGFINNANNANHFNLTLGADKTLTITGQGITNVQAAATHNAQNIVAQFNGGAAIANNDLSGLGTIDFGAAASTLVFDLANPTTQKAPLILADNALIVNGANGTLNVTNGFIQVSDKSFATVKAINIGDGQGFMFNTNATNANTLNLQAGTTINFNGTDGTGRLVLLSKNGAATDFNVTGSLGGNLKGIIELNTVATNGQLIANAGPANAVIGTNNGAGRAAGFVVSVDNGKAATINGQVYAKDMVIQSANANGPVNFRHIVDVGIDGTTAFKTAASKVAITQNSNFGTTDFGNLAAQITVPDTMTLTGNFTGDANNPGNTAGVITFDANGTLASASADANVAVTNNITAIEASGVGVVQLSGTHTAELRLGNAGSVFKLADGTVINGKVNQTPLVGGVLAAGAITLDGSATITGDIGNGGGGAALQGITLANDATKTLTLGGANIIGANGGTINFQANGGTIKLTSTQNNIVVDCDLAIATDQTGVVDASSLTNAQTLTISGTIGTIGANNKTLEQFNIGSSKTVLNGGNVAINELVIGNNGSVQFAHNSYLITRTTNAAGQGKIIFNPVVNNNTTLAAGTNLGSAANPLAEINFGSKGVHADTVLNVGEGVNLYATNITTTDANVGSFVFNAGGKNIVSGTVGGQQGNKFNTVALDNGTTVKFLGNATFNGNTTIAANSTLQISGNYTADVIASADGTGIVEFVNTGPINVTLNKQAVPVNALKQITVSGPGNVVVNEIGNAGNYHGAMTDTIAFENSSLGAVLFLPSGIPFNDAGNIIPLTIKSTVGNETAKGFNVPSVIVSGVDSVIADGQVIGDQNNIVGLGLGSDNGIIVNATTLYAGIGTINNNQGTVTLSGGIPNTPGTVYGLGTGIRASQFKQVTFTTDYNNLGNIIATNTTINDGVTVTTGGIAGTDFDGKITLGSVNGNANVIFADGIFSNSTSMIVTTKANNGTVTYLGNAFVGNIGDSDTPVASVRFTGSNNGAGLQGNIYSQVIEFGTYNLGIVNSNVILGGSTTAINGKIDLLTNTLTFAGGTSTWGNNTSIETTLTLANGNIGHIVIAEGAQVNATTTGTTTINVQDNANANFSGTETYTLIQGGARFNGTLGGPNFTVTGSNRFVNYGLIRVANQDYVITRTNNAENVVTNDIANSPFGGAPGIGQNVTTFVNATNTAAYNNLLLAKNSADSANFVGTIVTDTSAAITNAQLDVAKDIQAQLGNRLGALRYLGTPEMVGSEAGAIPAAVAAGDEAVDNVAYGIWAKPFYTDAHQSKKGGLAGYKAKTTGIVIGLDTLANNNLMIGAAIGITKTDIKHQDYKKGDKTDVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDFAVYPEVHAFVVHKVTGRLSKTQSVLDGQVTPCISQPDRTAKTSYNLGLSASIRSDAKMEYGIGYDAQIASKYTAHQGTL

SEQ ID NO: 11429 - protein, 376 aa, Brevundimonas sp. BAL3
MRRNALALGVALSLASAGQQAMAIEDIRINGFLTAAATQTDADSPYNIDLASDALRFDGRDNRLGLQIAADINERMSFTMQLLARAVPDNFNAEADWAFVGYNVSDDLQVRAGKVKLPTFLTSDYIEVGYAYPWIRPPQEVYSLSPITSLSGVDVLWTVPVGNNRLLVQPYYGNSSGTGFVTGMQAESGPPFPEVGTEVNFEAKQLAGINLALSTDIGTFRVGYLTTKVSSAFEVNGNRLIDDDKATFMSVGMNIDWNNFVGYAEWAARDQDGGAEFGFPDQKAWYVTAGYRIGPWLPSITYAQLEAGSPDNESVKAYTQEQSSVTLGVRYELAAGAALKFEATRVEPKNDNIGLFDGPLGSSNANVYGLALDVVF

SEQ ID NO: 11430 - protein, 838 aa, Brevundimonas sp. BAL3
MRLLNLHSFLLILLSFSSYGYAQNSIREQSLDEFLRTIENRFEVKFSYADDQIENLIVTPNSSLNSLVDYLNFLEISSPFIYEQHSDKNILIIPNDNEFELCVIVKDELSQNQLTEAFLKVGNYLYKPNASGQFKIPVNAKEIDLKIRAKGYAPELKRVMPSETKYCIEVIVSPFSVVLDEIILTNYLTGGIQKYRSGILKLDYESFGLLPGLVEPDVLQSIQALPGITSRQESVSYLNVRGGTHDQNLFLWDGIKMYHTSHFFGMISAFNPYMTKSVKLIKNGTSSRYGDGVSSVIDMRTKDSIVKSFKAEIGVNLINADVYIEAPLTSTSSIEFSFRESINDIWESPTYNQYFDKIFQNTEVTNETNPASQQNNEFIFYDATLNYKHKLTEKDYIKGNFFYTHDEFSLNRFEILGNRINTRSSELEQTNVAGGIYYNRNWSEATKTEVQFYTSKYNQNSINTNLLNEQSLKQINEVREIGVRVNLKTNLSSKLSLESGYQFNETGILNSESINNPGFFRETQNSILTNSLYSQLNYLSTNKDLSVEFGGRLNHFSKFDRVLIEPRFNLSYKIVDHVYLEVLAEQKSQVTSQVIDLQTDFLGVENRRWVLSNPNNRPIIQSQQISTGLNYVKPSWFINADVYYKHVEGITTQGQGFQNQFQFSQVHGSYEVKGIDFLINKNFDPISGWASYSISDNFYRFDALDTSRFQNNLDIQHVISFGLSYEKKGLKLSTGFNWHSGAPITLPQENQGVNPQQILFQGPNAERLPDYFRLDFSTTYNFAIFKNINALAGLSFWNVFGNSNIYDQFNRLDDDQNIQTFKQRGLNFTPNLVFRLKF

SEQ ID NO: 11431 - protein, 741 aa, Brevundimonas sp. BAL3
METVKVITDSPVGDSGVEEYKLPSHVQTVDAKELDQAESVTLPDYMNRFFGSVNVNDAQNNPFQPDVQYRGFVASPLLGLPQGLSIYVNGIRFNEPFGDTVNWDLIPEGAIDRMSLESGSNPVFGQNTLGGAISVRTKTGFTAPGYRAELFGGSWGRNSEEVETGWNNGEFGAYFHFRNFHEDGWREYSPTGVMQWFSTLSWKNDDRSNLNLNFAATDDNMVGNGAVPVQLYDQQPNAVFTYPDQTKTNLFLASLDGNHWLTDDIELSGNAFFRQNLISTFNGDGSDYEPCENDPTYMCNDGGEGEEVLDIEGRPVVSTPKVEGATNNFTQTNQRNYGGSLQTAFNQTLGGYGNRLLVGGVYNQGQVDYGADTELAALLSSRGTLGSGVILEEPRVRLHTSVYNYGVYLSDSFSLTDELTFTVSGRYNLTQIELTDQIGTELNGKHSYDRINPSAGLTYNWRPELNFFGNFSQSNRAPTPLELSCADPAQPCKLPNAFLSDPPLKQVVATTGEIGARGMFEDIDFGGGLEGDVNWNATLFQTENSNDILFIAASGVYNNQGYFDNVGQTLRQGFEFGINAEFERFRLGLNYTLLDATFQTPFVENSPNNPYARDGLIYVQKGDHIPGIPQNMLKFNASVTILEGLTAGTEIIYNSGQYLRGDEANLTAPLQDYTLVMLHGEYRYDEHFSMFFRVNNLFDAQYQTFGMYGNPQEVLGPAYTNNRFVGPGSPRAAWAGVKLAF

SEQ ID NO: 11432 - protein, 172 aa, Brevundimonas sp. BAL3
MLQEELCSVVEASGASLEKGRHDQLLTALRALLLSRKNPFGDIKLDGTVQKALENLGLGEAAKRNVGTGANQIPDMGSFMLSASVPGYQKLPSGLIIQWGPIDVPLTSQDTVTYFPIAFPNRCLRVFATQDYTPGSANVGYIACAGYNQDPVKFISRAGVPGIGASFFALGC

SEQ ID NO: 11433 - protein, 1108 aa, Brevundimonas sp. BAL3
MSKLYTLFLNSASYLALAISVVSPLTVAPLIGGVSIAYADDLPGSAGGTGDTLDSSSLPDSYSAAGGKGNGYGGGGGGLDAINRFGGAASVDGVGGDGATSIMSGVITAGGKGGDVGATTVGSDPVNLQGGKGGDGVKNRGSGGGGGGAGLFLKNNDSYSLLSGSTVTGGAGGLGGVGAYQKAAGGGGGGGAGVVLRGAALRISTGATVSGGAGGAGGSSPAAYKAGGGGGGDGVVVQSSSLINGGSITGGAGGNASNDSSDVNPGAHGGAGGSGVYVAGGNFINRGQVTGGHGGLGYQHGVKGASGSGVRIDSDAHVVNEGVISAGGADANAIDILGSNNTFEIHDGSSITGNVVVAGGTQGNTFVLGGSDDGSFDVSLIGTQYQGFQSNRKDGSGTWTLTGTGNFTQGFTIADGVLSVSSDASLGAAAAGLTLDGGTLQVTGTSFTSTTRSLNLGEHGGGLDIADAGNTFTVSQALSGNGYLRKQGDGTLVLSGNNSFTGGLTIEKGTVQAGTADHAFGSGLLTVNEGAKVDLANFNTTTGGLAGAGDVAMGSGNLNLDQSFDTLFSGVVDGSGALTKTGSGTLTLAGVNSYTGQTVVSGGTLKQGAQGAFNASSSGYEVASNGTLDLGGYSTSLASLGNTGNVNFGGTGGTVLNVAGNYTGNGGMMTVNTVLGGDDSKTDMLKVDGDTSGSTKLYVNNAGGSGAQTVNGIKVVDVSGSSNGSFSLANSYKTKDGQQAVVGGAYAYTLQQGSKRTPTDGDWYLVSHVDGPNSGSNPRPRYSAGVPVYEGYVQNMLALNKLPTLQQRVGSRYWTGENGNGSDNGATVNEYGVWARVEGGHNRLEPDTSTSQMKQDINTVIMQAGVDGQFYEGENGKLIGGITGQYGHARGDVSSFHGDGDISTDAWSLGATATWYGNNGFYVDGQGQVTWFDNDLNSWTANTGLADGRKATGYALSIEAGQRIPMQGSWALTPQAQLMWSSIDADEFSDTWGSRVSLHDGDSLLGRLGLAADYRSDWKGNDGLMVNTSVYGIANVYQAFLGGTTVNVSGIDFETDNDRTWAGIGAGGTYAWADNKYAVYGEGSINTSLNHFANSYAVKGSVGFKVKW

SEQ ID NO: 11434 - protein, 698 aa, Brevundimonas sp. BAL3
MDDHRRIAPPFARRLHPLSLLLAASLAHGETGTPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 11435 - protein, 356 aa, Brevundimonas sp. BAL3
MLALKTRLVLVTLGLLVAAQSHAAGFAAPTSVVGLSEAGATVADGGPVSSFADNPADMVFFPGTRVGLDILATRPAYKVDNGSSSIDASSNLQILPDLFVTHRFNDLPLAVGLGITSPYSINATWPAGTFPGQSSLKNDLRIIDVNPGVAYLLLPNLSVGVGLDYYQALSATFGPNSGTGGGVGGNVGLFYTTERFNAGLSYRSAASVSSGGGSIDLPSRVQAGVRYRFTPRFASELDVDWNDWSNARLPGYGSLGWKSALAYRLGLSYHLNQNLELRGGLAHEGSPGNSSSFDAAVPGTSSNLASFGLGIGLGAWHYDIGASYALSGNTTSYYPGFAGTYKASIFNFGAAISRDF

SEQ ID NO: 11436 - protein, 1147 aa, Brevundimonas sp. BAL3
MKTKSILCGVVFVTAAWCQSYLGGVRGNVFDASGKSIGEAKVTLIDEAAGTQRATISAGEGGFNFSQVVPATYTVVAEAPGFKKFERKHVMVATQEFVSLDLKMEIGSVNESVQVTEEIPLIESTTASQGQVLDRQQLIDLPNLGRNPFMMSKLAQNVTPVGDPHYNRMEDQSGSSQISIAGGPVRGNNYLLDGIPITDAANRAIIIPTLEAVEQVKVQSNTYDAEMARTGGGMFNTYLKSGTNDWHGSLFGSLRETSWAANNFFNNAAGIALPDQPNKTFGASFGGPIRIPKIYNGKNRTFFWLAWEGYQDTQSNTSQFSTPTALERIGDFSQSKTASGALNVIYDPLSTVCAGSTCTRQPFAGNVIPNGQLNPVGLAIAATYVKPQTASAYYGAPNLTQAATLAAKASQKTAKLDHQFTNWWRSSLSYLRYYSLEPGNNWFPTVSSPDQWLLLRRVDTTQFNNILTISPTTVLTVRYGFNRFPNYGYQQSQGFNLTSLGFNPAYVAQVPSPTFPNVTMTSQYSLGTNNNFYYVHHSKNFSAGLAKYQGRHNLKGGFDYRRIHDDGNDFANSAGAFTFNGVFSRSTPLTAVAGTGADMADMLLGTASAGTGYIPTKLYEYADYYGAYFQDDIRLTKTLTVNVGVRWEREYGLQEKNNSMVVGFDTKSVNPLAANVTGILPKGVIQFAGVNGNSIHVSNPNMNKMAPRIGLAWQLDSKTTVRGGYGLYWAPQFAIGTPYNPPGFTATTSYIASNDGNATPATYVNNPFPAGLAKPTGATLGDMTGIGQSLSIIDPNSRSPRVQQYSIDIQRELPFGVAVELGYVGSHSTHLTQATANININALNPALLSQGAALTQTVANPFFGKGGAGVIGSATVSQVQLLLPYPTFSTINYQYNDGSYARYDSLVAKAQKRMSMGLTFLSTLTWSRNHDASTGGAGNFLNAGNAGPQNPYDLKSEYSLANVDTPLRWSTGFTYDLPFGKSKKFLSGSKALDYAVGGWSMNAISVYQSGFPIQITQSTNNNSVFGYASQRPSATGISPVTSGSLESRLGNYINVAAFATSARGAFGNIARTLDMRGPGQANWDASLFKSFSITEKFKGQFRAEALNAMNTPMFAAPNASFGSSSFGRITSQVNFSRMMQLGLRFFF

SEQ ID NO: 11437 - protein, 348 aa, Brevundimonas sp. BAL3
MTSLQSGGLAVAAAFISACSLAQAQTAGPATSQVTLYGVVDMAAESVSTGAGRTLRAESGVLAGSRWGVRGTEDLGGGLRALYVMEAGLNADTGERGQGGLAFGRQIFVGMGGDWGQLTVGRHYTTFHTSLASYALTGLIWGNAANYFRDGTVLRADNSLRFQSASMAGLVVRGMYSFGENAGTNVGRQFGGSLDYTRGPWSLGASLWERRTTAQNTDRYHLLGGSYDFKVARAALLLSTRGDDLLDAASNRGRFFEVSMTIPVSTAGQVLLSYGQFQGRARANSDARALSVRYDHALSKRTKLYAGVSAIRNEADAAFTINSASNAGPSVPKGSRPRSLLVGISHSF

SEQ ID NO: 11438 - protein, 983 aa, Brevundimonas sp. BAL3
MRRYRIGLALLALGSLVVATSAAAQQGGSAIRGRITDQQQGILPGVSIVVTHTENGTTRETVTGADGTYLVPGLVPGPYKVAAQLQGFSRLTQENLVLRIGSTLQVDLILRVGAIEENVTVTAESPQVDLTSAQVGGNVSAGEIENLPSGSRNFTGLVSLLPGVVYNQAADSSSDSVTINGQHGSGVVYLMDGGSNNDDLRGGSSGAQARPPLEAIQEFQVVTNQFDAEYGAATAGVVNALTKQGTNRWHGSAIGYFTDSSMTDKDFFVAQQNLDKPDTSKVQWGGTLGGPIVRDKMHFFASFERQDKNEGRSIIYPTRPDKSFTVAQETNSFNYMGRLDHHMNASNNYSVRFLWDHQPNYNQVLTNGGGVGLGGTKDTLSIEKDNDWALVGTYNRIIGGKKLNILRLSAVHEKPKRGQPLYQDVGDWTQAPPTLQYLNFIDQADDNYADYRNMNVYGLDDTFSWYIEGAGGSHDVKFGTQYQLGEHYREDQRVTNGRFIAPTDRTFNPADPFTYPERLNVRVPQMVQLLSRTHSLGLYLQDKWQLRQHLTLSLGLRYDMHNSPVNESWNPYFSSPDDHPIDRNNFQPRIGFAYSAGPSAVLRGGYGLFYEKQWIDRFENYMLNPVFTNSFIAQYPVSQVDPGPSAGRFPTDPLLVNGPTLNRDLINQLVPPGTLARNTAAVWLDTPNRILPYQHQASIGYERQLGRQLAFAADYVHMINKDLPLRYNKNPGIKANTGRTSPIARVDLDGLAGQLGLTPFSNDVWIVEYIGETTYDGLNLQFEKRYSNNWGARFSYGLGHGHGNTNGTPTATNDFQVLDDRNLELNEGPTNLDRRHTATISGRFELPWLKGVTGGAVARMMTGQPFTIHNSNVDANRNGVLVDPLPAGTYSGVGQNAITVENDGGRNGAYGPGSLQIDLRAGYRMRPQAGRTLDLFFEAFNITNEPNFANPTGDMRSANFLIVNTLAGGGFPRQFQIGARLGF

SEQ ID NO: 11439 - protein, 658 aa, Brevundimonas sp. BAL3
MGLGHGSASLAQETPAQEGFLGTLTLGESKRTVQTETATPSTVIDEDEIRDRQAGSVAELLVTVPSVALLNGDTAQGSGISIRGFGSNATFGTDQKVLIQVDGATRGSEELYRIGTQLFTDPFLFKEVEVIRGTVGSFQYGSGVVGGVVRLETIDPEDVTGGETGFGLRQTLEFQTNGNGVTSSSIGAWQPTEDFGVLFNYVSRRLGFPEDGNGAVINPLRERIDDPSWLVKAKYRFGEDKAHSIEASYQDTQSSQFDVPYDSFGNLTFFGNVDREVESQTSILKYNFNPLNDLVDLTLQYSHVDEAILQDAVSCPGSPPAPITICSALLNADHDYETTTLTLKNTSLFDTGALRHDLTAGIEHINRTRVDAFAAPGGEDNRWALFAVDEIDIGRAWTLTPAIRYETSKVEGDTAPNDGRFSEDALMGGLSVRYAFNNGLAVFGSAAYTEVLPIIDDLEFPSRMTQSEKSRTYEVGFSYDRRGLLRENDALALKVTYFDSELWDVNSFVDTTPAQNPLDEIQTQGLEFEASYAMENGFYVDLNATVAEGEEVDVLGGVRDWRNLAANNLRASVGKVFDDTYDLSWEVVSAESITVNGVRDDGYTVHNLRATIAPKRGVWDGTEFRVGIENLFDAQFTPNLATRPSPGRNFKLTLAKTF

SEQ ID NO: 11440 - protein, 713 aa, Brevundimonas sp. BAL3
MLAALLCAGLHGPEARAQESVTLEELAVEGESRGVGNGASDGRTSAAGTVGLIGPTPGYRADRAVSSTKTDTPQRDVPQIVTVAPREVITDLAATRVDRVFNYTPGVAQQNNFGGLSVFSYAIRGVTTSEIYKNGFPLNRGTPPPPDAQNVERVEVLKGPGGGLFGRSDPGGLVNIITKQPTVERFVEMGGLWDSFGQFRGTVDSGGALNEEGTLAYRFNLAAGRQGSFRDFVDSDRLLVAPVLSWQITPDTRITVETEFLRNRIVFDRGVIALNGRLGLLPISRFLGEPGQSTYQTNNTMQVRVDHRFNADWQMRLATHFNTGTLEGESAEIRAIAADNRTVSRDRNIRDYRWDVAIGQAEVVGRFDTAGIGHTMLLGFERESTDSRVVYNRSNFRTSPYAIDIYDPRYGQPLPPITIPRNNLERITNTALYAQDQIVLTPEWKALLGVRFDFFEQSFRERIPRSQVDQTYFAATPRAGLVYQPLPELSLYANVGTSFRPNIGPDAAAASASGPFAPETGIGYEVGAKLDLYGGALALTGTAFRIDRENVLTPEANGSGFSVAVGGVRSQGFELTAAGQITPEIKLLAGYVYAEAVVTEDPTLPAGTPLINVPRHSGSLLAVHEVQAGPWKGLGLGGGVRGVGERAADAVNSFSLPAYIAADALAYYRFENFRFGLNIENVFDTEYYESSLNRFRVYPGAPRRFTGTMMVRF

SEQ ID NO: 11441 - protein, 708 aa, Brevundimonas sp. BAL3
MASDFSHARRLGAAVSLLALTGSAALAQTAIPAEADADDVIVVRSAPLQLRSEEMVGSVGVVSARQIERDLNGNIADTLDRLPGVNSTYFGPAAGRPIVRGLGADRVRVLINGLGALDASSASPDHAVSAEALGARQIEVLRGPAAIAYGGGAVGGVVNVLDGRIPSERNENLIDGFAYLGATSVDEGAQAAGRVTADFNGLMIQLEGLKREGDDFDIPGFAETEALREDHHHEDEDHDDGEDHHDEEEPAHGSVPDSDYTFETYSGAVSLVRDWGFIGLSVKETDAEYGLPGHDHAHEEEHDHEEGEDDHDEDHDDHAHEGEEAPRLVLDQTRIDLRGELNRDALFNRVRWSFAHAHYTHAELEEGEIGTLFRKNGFEGRIEVGHDHGGDRQGAWGIQALTQDFSAEGDESYIEPVTTQDWGAFVTERWDNGDWGLEGGLRVESRELSGQRATRSFDTVSGSGSVFVRPREDWFLAATLSRTERAPTDAEVFADGPHAATRAYERGSLDLDTEVAWSGELTARYSGARVSAEGNVFYADYDGFIGLFPTGEEEEGFDVFEYRQADTALYGFEAQLTAALGAVRGWAFSGEASLDYVRGTVDDGGDLPRIPPLSSNIALIAERGVWSVRGEAHLVADQDETAAFETETDGYAMFNADLEVTPFADRDVRVILGVRNITDEEGRVHTSFLKDQVPLPGRNVRIAVRTSF

SEQ ID NO: 11442 - protein, 556 aa, Brevundimonas sp. BAL3
MQVKYPKLCPLTAAIVISGFSSFANAQLGQNLAVDIRSLSMGNAVTADPPGISAIHFNPAALAKIDGLQTDVQGILANFDIQREFSAPPGYNVFGYSDDPIVCNDGPEVSVGICTDFKGPVRGDVEYASLYVPILKKMVDLGAGYPLVAPTAGIAYKPPGSKVTYATAMYAPLVAGFGAENGNPGNYMGQQVAVERITYLSPSFGYQVNDHLSIGASFGMSYNAIALNTDLRFPNEMVGVLRMIDDVVCRPFKNNKEFFTDLILLGICNTQEGMNPFNKMGALQVSLEQSLSPSYNLGLLWEPTDNFSFGMVYQSSAKMRLKGKYLINNAKAPQQLIAGLNSSTTGSVASGVLQLPGYIPNVESGLVAMDLEYPAHFQAGIKYKLLPDLQVNFDVGWTDYSAWNKFKFEFDRQISLLQVARLLSNDVTPASLALPLKFTSPWSWGIGLEYSATDRLKLRAGYEPRASSIPDDKRNTMVPINNAQLFGLGVGYRFDTDTDLDLSVGFLRSRDNIPACTSTLSNKCGVDNILLNPYAGLDVKTNTKVTVLGLSYRTKW

SEQ ID NO: 11443 - protein, 792 aa, Brevundimonas sp. BAL3
MKATILKISGLFIFLLAVISASAQDRAMISGKIISTEKETVDFATVYLKGTTYGGTTNEQGIYHLKAPAGDYTLVVSAIGYKTVEKPVKLTGGERARQNITITPQSTELDEVVVVSNGISRLKRSAFNAVALDTKELQNSNKSLSEALAKAPGMKVRESGGVGSDMQLTLDGFSGKHVKIFIDGVPQEGVGSSFGLNNIPVNFAERIEIYKGVVPVGFGTDAIGGVINIITKKKRDRWFLDASYSYGSFNTHKSYVNFGQTFKNGFTYEINAFQNYSDNDYYVNAPVENFETGSIDRSKKERVKRFNDTYHNEAVIGKLGIVDKKWADRLLLGFTYSNMYQDIQTGVRQEIVYGQKHRKGHSLMPSLEYGKRDLFTKGLDIVLTANYNKNLTTNVDTSSYEYNWRGEKHLMNSAGEQSRQHSRADNNNWNGTLTLNYRVGKMHTFTFNHVLNTFHRSNTSLLAAEEMKSAIAKETRKNISGLSYRLMPSEHWNFSAFGKYYNQFVAGPMATSSTQDEYVRKTRSVNSFGYGAAGTYFILTGLQAKLSYEKAYRLPTIEEMFGDEDLEMGELSIRPENSDNINLNLSYNKTFGKHTLYVEGGVVYRNTKDYIQRNITDLSGGKQAATYINYGKVETKGFNLSIRYNFANWVSVGGNFTQMDVRDKMKTSITSSAENLAYGERMPNLPYRFADSDISFYWRNLWKKGNVLTVTYDNQYLHSFTYYSSAIGSKNNDYVVPNQFSHNLTLSYSLQNGRYNVSLECRNFTNENLYDNFSLQKAGRAFYGKVRVYFGN

SEQ ID NO: 11444 - protein, 728 aa, Brevundimonas sp. BAL3
MSDRIDRDVINALIAGHFADPFSVLGMHKTTAGLEVRALLPDATDVWVIEPKTGRKLAKLECLDSRGFFSGVIPRRKNFFRYQLAVVWHGQQNLIDDPYRFGPLIQEMDAWLLSEGTHLRPYETLGAHADTMDGVTGTRFSVWAPNARRVSVVGQFNYWDGRRHPMRLRKESGIWELFIPGAHNGQLYKYEMIDANGNLRLKSDPYAFEAQMRPETASLICGLPEKVVQTEERKKANQFDAPISIYEVHLGSWRRHTDNNFWLSYRELADQLVPYAKWMGFTHLELLPLNEHPFDGSWGYQPTGLYAPTRRFGTRDDFRYFIDAAHAAGLNVILDWVPGHFPTDDFALAEFDGTNLYEHSDPREGYHQDWNTLIYNYGRREVSNFLVGNALYWIERFGIDALRVDAVASMIYRDYSRKEGEWIPNEFGGRENLEAIEFLRNTNRILGEQVSGAVTMAEESTDFPGVSRPQDMGGLGFWYKWNLGWMHDTLDYMKLDPIYRQYHHDKLTFGMLYNYTENFVLPLSHDEVVHGKKSILDRMPGDAWQKFANLRAYYGWMWAFPGKKLLFMGNEFAQGREWNHDASLDWHLLEGGDNWHHGVQRLVRDLNLTYRHHKAMHELDFDPYGFEWLVVDDKERSVLIFVRRDKEGNEIIVASNFTPVPRHDYRFGINQPGKWREILNTDSMHYHGSNAGNGGTVHSDEIASHGRQHSLSLTLPPLATIWLVREAE

SEQ ID NO: 11445 - protein, 672 aa, Brevundimonas sp. BAL3
MTANATPSATGVIPASAGYVGGVTGIGGALPRVDSASAGVITGAQVNNRPVTRPGEVLEAVPGLIVTQHSGEGKANQFFLRGFNLDHGSDIAITVDGMPVNMRTNAHAQGYADINFLIPELVGAVEFHKGPYFVRDGDFASAGSVRIDYLDSVEKNLALTSIGSFGYRRALTIGSAPLGAGHLLVAGEAQVYDGPWAEPDRLAKLNGVLRYSQGTATDGFALTGMAYWARWNATNQIPERAVSGGLIGRFDTLNPTDGGGTGRFSLSGRWSGTDETGITRANAYVIRYGMNLWNDFTYFLNDPVNGDQFRQHDNRVLGGGEVSHTFQGTLFGLPMENEIGVQTRTDSIRVGLFNTTNRLYRSTVLDDRVLQASAAFYYENRMRWTDWLRTSVGVRADGYYADVVSDTPANSGRARDGIVNPKLGLVLGPWFDTELYVNYGGGFHSNDVRGVVATVDPASPLFNIARSPFLVPSTGSEIGLRNRSLPGLETSLALFQLDFASENLFQGDTGTTEPSRPTRRFGIEWTNRYALAPWLTLEGDLSVTNARFSDRDPAGNRVPDAPTTIASAGITFGEGTGWFCSMRFRYFGPRPLIEDNSVRSKPTALMNGRIGYNFENGVSLSLDVLNLTNAKADQITYFYTSRLPGEPTEGVADRHFHPVEPTAVRLTLAGRF

SEQ ID NO: 11446 - protein, 153 aa, Brevundimonas sp. BAL3
MLAGVFQQSRDVTTSFFGLSIPASRQNVWSAGGTYQLGKSMLYFGFTSSALDVADYRNRAVYIGAKVPLTPALTFITTLTGDRVKHQGDSGNRFTGAAALDYSFSKRTDVYASIDYTSVRGAWATLASLPNFATPFFGYSSRLGVMAGLRHKF

SEQ ID NO: 11447 - protein, 692 aa, Brevundimonas sp. BAL3
MVGGERRNDALEDVDLLRLLDVEVSTATKTLETLDDAPAIMTAITAEEIQRWGYTSVGEVLEHVVGFYLIDDHILPNAGVQGMTGGLGAESGGIKVMINGRSAAFRTTSGNWLGTELIPLSAIKQIEIVRGPASALYGADAFLGVVNIITLDPEDIPFVDGTVQVGVTKDHPRGRFDIVGGMFTDRFEMMLTAAGELDDRSGLEMPNQSPAPLIPPYNAGRLDAQNLERMSGVVGARLGYRHPERGHHLVLSAYWSGLRRGGDFAQWAQLTGGTDDEGNRAGTVISLQQRRVAVDGLYQLNRELAFAVQGMYFQGGVLPDDRIDVAGGWYYIERRMAYRGVDASVEARWMPWDRFNLILNLESVYDKEDMPSFRRVTKETKQSFGSPEREQQSAELVDVGALLSANLKVLDPWLKVTGGLRYDHHSKYGNQLTGRFGATSHLGKTVVAKLLYGSAFKAPSPYLLFAEPLVPGDVIGNARLSPQLIHTVDAELTWRPAVWASASTGVSYSLLNDKAEFVPRGINQTALNIASQKSLIWATRAELRHGDAFGGYGSFETVHSTRDSGQVGYQADLVGSSMVAYPSWIARAGAYVKLPSPSSVPLELSTQGILVGPRQSAEASTLEAGGAFELPTYLKWNASLVARNLWIIPGHETTLAVRAKNILGTFGPDPGFSGFEYPLAPREIFFELRHRY

SEQ ID NO: 11448 - protein, 721 aa, Brevundimonas sp. BAL3
MSAARRRFVTPKKPPYYLASVLFFSLSGTVQASADCNKTGNSPRCEDNVTVEASTQPQSPYGGLNAVTQTASRLGLTRQETPRSVDVISKQAIEQRGDRTLAEVVEHAPGMSGVASPTLSNDFSLRGFRPVSWLYNGVETPGSTLQLADPSHYDGVEVLRGPGSVLNGLSAAGGSVNLISRQPTFSRQPVELDYGLSSYNSQRLHFGSGGTLLDDVAAYRLDVSGSDSGTNVQYERDKQKRVSGALLLKLTENALLTLSLDRMLNRTTNPYYGTPLVEGQIARELRDINYNNLTDSRIQSNATSFQASLDWFTTPEIELHNQFYYYSGFREWRNVERFRASAATQPGYVNRDSFGALAHDDDLIGNRSFLVFDRPLGGFDNRLVVGVDVSKRRFQYYSNGFPGSEEVPLLAPVREDFSQGTDRQRTPVRHVTQNQYAGFLEDRFSLTDRLTLLGQLRYNHMQMDWHFQSPQEETHEHTYVFSVWSLGPSYALTDNLNIYANYTTGQEPGNDLFFLSPAQTSLPLTRVRQWEIGAKGQFWDNKGEATLALYELRKDNLFVPNAQQPDTLNAVGRQTSRGVELSLMLRPSWQWELAANAAYTHARYDEYRGGSPVGSYNGNRPAYIPDWTANLTARYKPTQQLGLTSSLRYVGSSYNDDANQRKMPAYTTLDLAADYQLTPVVDVGVRIRNATNQLYAYQRTYPDQVLIAPSRTYESFISVRF

SEQ ID NO: 11449 - protein, 357 aa, Brevundimonas sp. BAL3
MRNLLFVVLLSSFVWSSIGYVSNFKGSADIVRSMNTLKVKNGTKIKVKDKIITQEKSRVKVILEDNTVVTIGANSTFVFDRYKFGTRDNSVADMHIERGFFRSVSGKIGKLAPEHFKVKTIMSTIGIRGTDFSAALADTFELYKCYKGKISVLHNGKTYIVAEGEQLRLEKESFSSVAPFKFYVGAGTIYNRTYSVDSGWFDDGIATQDETGGISLIAGYQFNDYLALETRITTTFYERNYADLTAYSMFLKPQYPVTDTFSVYGLLGFGKVKVEGSKGDSFPGAHTDMIGKTILDDTQFQWGIGVSYNVTDNFSIFADYTSLANDADIDSTLYSYDPAVYHKLSVDGVTVGLLYSF

SEQ ID NO: 11450 - protein, 208 aa, Brevundimonas sp. BAL3
MSLKTSLLAASLALGCVAAPSLADTYSGDLFDDIGGSASSENDFSIYVFGAGGWVSGGDLDYGGTDYDRSEGAAGEAGIGIRFTKNIRLDAAFQYNNFVIDEAAVEKFSAYTSLYTLYYDFTNDSSWTPYIGYGFGSAEMITDSSSDREDEDVTVNQFKVGVTYETASNLDLFGEFVWQGYSDSNMNNTDIDEFDQWKAQAGLRYSFF

SEQ ID NO: 11451 - protein, 422 aa, Brevundimonas sp. BAL3
MSRYLPITIASLSTLLIASDAFAGAFAVREQSAWFQGLSFAGNATVSKSLSSMYWNPATMTGHDGIQVETSQTVVFPRATIDLETATIDAIPTPVTGVPYSSGDIGVDAWVPAGYGTWKVDERLTLGVSSNAPYGFETKPQIEWAGQVYARSSRVLSVNVTPMAAYELTEKFSIGVGWQLQYLQVRLKSATGVPPIAANSPTAELRGEDYNLGFGATVGALFKPWEGTQLGIGYRSPIEHNLKGRLVVGGNTPTPIRANIIMPETVTVSFQQVLNERWRGMGTFEWTHWSRFGTFPVFNLQDQVVSELPFQYNDGYFISLGTEYDFTENFTGRFGLAYEWSPIDEANRTPRLPDANRFWISAGLSYFYEDWLEVDIGYSHLFPESESININPDHPFYEGITIQGPVNDTNVDIVSLGARLKF

SEQ ID NO: 11452 - protein, 493 aa, Brevundimonas sp. BAL3
MGGHTVTSITGYAAYDYRDICDCDFAAVPLLQVDATEDYEQFSQEIRLTSPGGEKFDYIVGLYYHQSDLDYRSVEGFGTSLAAPLLGAPESITPNLTRDYSMQQDQDMWAVFGSGTYSFTDATRLKVGVRYFDESKEASHTLDTSFTGGWDYSAAIGLPAGTASYGSTAAEYDRFLSEFAGTPFTAISEGILNGLLGTFEHNIQNRKRSETDVNWEVTLQQDLNQDAMVYGTISTGSKGGGFDARFLRTNDSPFFEYEEESATNYEVGIKSSLLDGMMTFNATAFFTTVEDYQVSIFDGATAFFVQNAAEVESKGVEVDLKWAPTDGLIVSFAGTYLQAEYSDFKNAPCWTPSASDPDRGDCQNAGTPNASRDATGSANTYSPEWAYNLNVDYRRPVTDMLEARGIVNINYSDDFFIAADLDPIYGFQPAYTTIDLRLSLGAQDGMWDVAFVGKNLTDELISGNNDDQPLVNGQGFAQTNRLRSYALQATYRF

SEQ ID NO: 11453 - protein, 382 aa, Brevundimonas sp. BAL3
MLRQAEERDMKKIAGALGGLALSAGAASAGDIERSTQSVGILFEEGRYVELTYGFVKPDVSGNIPNTPFQSGNMAGNFSTWSLAYKQALGSNMDIALVLDQPIGADVDYPGGIYPLAGTTAELRSNAVTALLRYKFDNDVSLYGGLRAQSVKGKANILFDIYQEGSYVATTDYNLETNTDYAFGYVVGVAWEKPEIAARVALTYNSAIDHTLEADETGTNAVFGDRAGVSEFDTTVPQSVNLEFQTGIAPDTLLFGSVRWVDWTEFLIDPEIYQYYFPGIPLVAYESDRWTYTLGLGRRFTEKWSGAVTVSYEPKTGDDTGNLGPNDGFRSIGIGATYTHENMKITGGIRYVELGSANTRGVGAKFDDNEALAAGIRVGFTF

SEQ ID NO: 11454 - protein, 707 aa, Brevundimonas sp. BAL3
MKNLPLNLITLTILTTTNAFAEGSKNSDVEKIEVQGTYIEGYGAHEVSGASRLDLSIIEIPQSVSVITSAQMRDFQLSDINAALDSATGINVERIETDRTYYTARGFDVTNFQIDGVGLPLTSGNNHADEDTAIYERIEVIRGANGLMTGVGNPSATINFIRKRPTEETEVSVRGTVGSWDKTRLEVDASTPLTDKVSARVVLVKQDNESYLDRYEQDKSVAYAFIGAELTDSTYLSISHSYNQSDAIGNNWGANPLYYTDGSATDYDASTNTSANWSNWQVVKNNTVVELAHYFNSQWSLRATYSHKTTDEDTELFYVYGTPDKNTELGLLGYASEYDLDDKHNLFDAYINGEFSLFGREHQIVAGINYAKMSYVDKSLYDYTTGNGFPVMPPLPEWDGNTPKPIFTDGLTGSDVTNEQKAAYFTARFEVLDNLHVIAGGRYNDWNVEGNSYNVVQDASDKEFIPYLGAVYQITPELVAYTSYTETFVSQTKLDINDKILAPITGESKEIGIKSEFFDGLLIGSIAYFDVQQTNVAKLDVRTTDLPINLQRYIGAEGISSNGFELEVAGQIYDNLQLSFGFTDFDISGDDVVADYTPSTLIKLAATYTVPAIEGLSIGVNMNWQDDISRKQGVVGDGFANAGEEIVTKQGAYAVVNVMMAYAITDNVSLSLNANNITDEKYINSLYWAQGYYGAPANYSATLSWSL

SEQ ID NO: 11455 - protein, 1113 aa, Brevundimonas sp. BAL3
MGAWSGAGAGGGGGAGVATSANFTNNSTVIGGAGGDGANTSRGQNSGGGGGGAGVYVVGNSTLVTITNNGTITGGAGGLNSAWPVYYGATGGAGEGGAAGSIRTGGSQGTSSQGGAGIIGANIAVINNGTITGGIGGTGGLNAGVQNDAVTFQSGTNSLTLTTKSVISGVVSANGNDDTLTLQNTLSKIDGGQSDGANISATQYKGFEHLVVNGGRWTVGGSAIVSGETTLNGGALVVTGPAALGVQAITAQGGAIEASGDQVLNQSFVLKNNPYGASTSGLVVQGADNLVLSGVLSDVGRLTKNGSGTLTLTADNTYTGGTVFAGGVVSVDKEVRLGGGDLTFNGGTLQVMGTSWTSTNRAVSLQAGGGTFDIEDAANNFAVTQGVAGAGGLTKSGSGTLTLSGANSYTGATTVSAGTLVVANDNTGGGTTTVDVGAGLQIGTGGVSGSLAGDIVNNGTLVVDRSNAFDLANVISGTGSLTKNGAGTLTLSGVNSYTGGTTVSAGILTLTGDNTGGGTTTVDAGAVLQIGTGGTSGNLAGDIANNGALVVNRSDALNLANAISGAGSLMKSGAGTLTLSGANSYTGATTVSAGTLTQGAAGGFSTASSRYDVDTDGTLDLGGFDTMLAALYNAGTINMNVGAAGSTLMVNGDYVGHDGTIVFNTVLGDDNSKTDKLMVGGDTAGNTNVQVVNRDGLGAQTVKGIEIITVGGQSNGVFSLVSDYRTKDGRKAVVGGAYAYTLHQGPARGANDGNWYLISQLEDIKPDNPATRRVSDTPDAPDTPAPRYSANVPVYEGYVQTMQALNKPSTLQERVGKRYMTGENGDGRTSGGMVDAHGIWARIQGAHDRLEPTTLTGMKQEINTFILQAGVDGQFYEDENGKLIAGITGQYGTARSNIVARDGDGRISTNAWSLGATATWIGNDGFYVDTQGQVTWFESDLNSDTADVGLASGRKATGYALSVETGKRIALNGNWALTPQAQLIWSSINADDFEDVWQANISVARGNSFAARFGLAASYDSSWQGSDGRVVNTSVYGITNLYQEFLGGTRVNISGVDFSTDNDRTWAGIGAGGTYAWAGGKYLIFGQGTINTSLDHFADSYAIKGDVGFKVKW

SEQ ID NO: 11456 - protein, 365 aa, Brevundimonas sp. BAL3
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 11457 - protein, 452 aa, Brevundimonas sp. BAL3
MGPITAGVLAITSQPALAVTDVFRFVGFGQVSGAMGGAATAFDVGAAGMMTNPATLSLMPEGSQFYFGMDVTFGDLAIRNLDTGEVADSEDHSKNRGPYAVPQMAYTYYSGSLTLGAGIFPQGGVGTEYGNSSFLSRATGGLDTGLENSSRLMTLNIPFAASYEVNDKLTVGASLDAMWQGLSLDLLLGADQVGSLIGSGRASGSLVPVLGGLPDLRGAHLSFTRNHPVASGADAWGIGGRIGLTYKVSKDTALGVAYSMESHIADMKGDATLTAVDALAGQVPLRGRISVRDFQTPAQLNLGISHQVNAQWMIVADVSRIFWKHAMKDVDVGFGADTGDNIDILLPLNFKDQTALSLGAAYQTGKWTLRGGTRFVTQALRSETLLSVMPAITTRFVSAGFSYQFSPTSKVDVAWNHSFKKKMDNSSLPNTSAPIRAEHAQDTVGLGYTHSF

SEQ ID NO: 11458 - protein, 708 aa, Brevundimonas sp. BAL3
MKNRHIIRYVLFICLLITTLSLSSAFADATTDSIRLDDMVVTATRSENSAFATPVTISVVDQQEIQEQNATTFTDLLDGVAGVTLSGAGPWETTPTIRGMGTNRVLVLFDGDRETNLWAGRAPLTPFIDSSDIDRIEVVKGPSSVLYGSDALGGVINVITKEVALADGDTWQAQHHIGTRYSSVDDGVVGNYTVNAGGHGLGIRLNVAAEDHDDYEVGDGDELPHSQFENKSLDLKTLYNINDHHTVKAELRINDINDMGVAQKDPSAPESHFTLYNTRSYKLGYVGTDLGAVQRLETRVFHVDQKRRFVGDFPNTAKQVHNLKQNTIDTTATGGSLQATFAPGRNQQWVTGLEIVHETTDSNESQQIFSTTNESLKKLLTFQPLPDGERDHLGLFAQDEIMISEDWSLTLGGRYDYFAADADDVTMSQTSYGSNGAATIASVNKFSRETDQAVTFSLGSLYALSNTLHLTANLATAFRAPDLFERYSTRGGGSQVIIGNPDLDAEYTYNADLGLKYLSSRASGYVSVFYNRIDDYIDLVKQDSSFLGSIPTYGYVNVEDAELYGIDAEATISLTSRLDVETAIAWVEGKDRDTNDHLSAIAPLNGRIGLRYAAPLSNGMRYTLRAQATLYDRQRNVSDSEKETPGYTTVDLHAGLNLGAWAMFDAIDLNVSLKNLLDRGYRSHLRSSQATWIYEPGRNIVVGLQCTF

SEQ ID NO: 11459 - protein, 226 aa, Brevundimonas sp. BAL3
MLVSFVIELHMSLIKRKIFSVGVSMLMACGASAADLADHSVPSAPSYDAPGTFSWAGAYAGLHGGVAASKFNPFNNGRAPAVGAQVGYNFQAGSGVFGAELEGSYLNNEVRVPVGNVESRFRGAAKAKAGLGFDRTFVYGTAGVTTTEFEGHRLVSGSDKWKSGPDSWKHGYLFGGGVEHAFSGGVSAKIEYNYVINNAVPTTSGGISSRSDLNDNVIEAGLNFRF

SEQ ID NO: 11460 - protein, 131 aa, Brevundimonas sp. BAL3
MATVPTRSGSPRQLTTKQTGDAWEAQARRWLEGKGLRFIAANVNERGGEIDLIMREGRTTIFVEVRYRRSALYGGAAASVTRSKQHKLLQTARLWLARHNGSFDTVDCRFDVVAFTGNEVEWIKDAFNDHS

SEQ ID NO: 11461 - protein, 1050 aa, Brevundimonas sp. BAL3
MAGKGISYRVDENVVYLSKASTSPSASSTSLKAAQQQTKTVTGRIIDAKGEPLIGVTVIEKGTTNGAITDFDGNYSLSVPDAAVLQYSYVGYQTVEMSVAGKNVIDITMKEDTEVLEEVVVTALGIKRSEKALSYNVQQVNAEDITTNKDVNFVNSLSGKVAGVNINASSSGIGGVSKVVMRGTKSIMQSSNALYVIDGVPIFSGRSNKGGTEFNSQGATEPIADINPEDIESMSVLTGAAAAALYGSDAANGAIVITTKKGKEGKMSITVNSNTEFSSPFVMPEFQNRYGTGIGGVLSDSGILSWGGKLTEANAFNYSPKDDYFQTGITGTESISFSTGTEKNQTYASAAAVNSKGIVPNNKYNRYNFTVRNTTSFLNDKMKLDVSASYILQNDRNMTNQGTYNNPLVGAYLIPRGYDWEDIKMYERYDPARKIYTQYWPVGDAAIAMQNPYWINYRNLRENKKDRYMLNAGLSYQIFDWLNIAGRVRLDNTSTNYTEKFYATTNTQLTEKSSRGLYGQSKSEDKQLYADFLININKTFGEDWSLQANLGASFSDLRYDLMKVRGPIADGSDSFTGEPVGLTNWFVIQNLSAKNTERLNEGWREQTQSIFASAEIGYKSTYYLTVTGRNDWPSQLAGPKSVSKSFFYPSIGASVVLSELMPNLNKDYLSYMKIRGSWASVGNPFARYLANPRYEWNPVGGSGQWSNTTQYPAYNLKPERTNSFEVGLTMKFLKSFDLDITYYNAKTMNQTFNPELPVNGYSAIYLQTGAVRNQGLELSLGYKNTWNNFTWETGLTYSMNRNKILELADNAINPATGEPISISTLDMGGLGEAKFLLREGGTMGDLYSLIDLQRDANGKIYVDANGQIATETISNPNNYIKLGSVLPKGNLSWRNNFNWKNFNVGFLVTARLGGIVFSRTQAMLDYFGVSEATATARDQGYVIINDNDHINPETWYNVIGGGTSVPQYYTYSATNVRLQEVSIGYTFPRKWLRDICDIRVSLVGRNLWMIYNKAPFDPESIASTDNFYQGIDYFMMPALRNIGFNLNFKF

SEQ ID NO: 11462 - protein, 938 aa, Brevundimonas sp. BAL3
MKSGRYFFILFLILLIMPAYAQKGVDITGTVIEEGTNEPIEQATVRLLSVKDSSMIGGIATSRNGSFMLKNIKNGSYLLHVSFVGFDPLYQPLRVTGKTNPVKLGKLALTDGAIQLGEAVVIGKAPEVTVRNDTMEYNADSYKTTEGSMLEDLLKKMPGVEVDSEGKITVNGKEIKKVLIDGKEFFSDDPKVASKNLPSKMIDKVQVLDKLSDMAKMTGFDDGEEETVINLTVKPGMKQGWFGNAFAGYGSEDRYEGNFMVNRFINNNQLTLMGGINNTNNMGFSDLASSMFSGMGGPRGRRGGGAGNGITTSGNIGLNFSKEFNPKLTVGGNLRYSHSDNDAISKSNRQNILPGDSTSFYNENNSSNTRSDNVAADLRMEWKPDSLTQIIFRPSFSYSNSHSREGSTFNTLSGNRDTVNIGESDYLSDGSGYNLNARLEFSRKLNSEGRVFSGSLSGGLSDSYNKGLNYSNTEYLMMADGMDNELVDQRFRYDNKGFNYRAYLSWVEPIGHNNFIQATYSIRQNKQESLKNSYTREKGSEDYNVLDTAYSKSYRNNFINQQVSLAFKAVQEKYDYTVGLTVDPSHSTSENFVGDTVLSKLSRNVVNLSPMVRFNYKFDKRTNLRINYRGRTSQPSMTQLQPVADISDPLNTTMGNPDLKPTYTNDLFIRFQKFVPDKQTALMVMLNFDYVINDIVNKSVYVGNTGKKMTTYDNVNGNYNGNIRVLFNTPLKNRKFSINSMTMASYANNNGFINEEKNTNKNLILMERAGIDFRSDYLDLGLNGNIRYNGTQNTLQGQSELNAFNYGVGGTTTIYLPLDFKVESDINWSTNSGYSDGFKQNEVLWNASASKSFLKGNQATLRFKIYDILKQRSNISRSVTASYTQDSEYNTLGSYFMVHFIYRFSIFKGGASMNDVSGPGGRGPRHGGPMGPPPGGRF

SEQ ID NO: 11463 - protein, 974 aa, Brevundimonas sp. BAL3
MDLRETAIRRGLMAGAAIGVLITAMPAAAQQGQVEEIVITGSRIASSNLNSPSPLQVVGGEDIDIAASATLQDVLLKNPTFGAPSISRTNSNFQTASAGAATINLRNLGVDRTLVLVNGRRFVSGIPGSAAVDLNTIPTQFIDRVEVLTGGASAVYGSDAVAGVVNIIYKQDFEGIEADARYGISEEGDGIEKDVSLMMGGNFDDNRGNIVGFLGYSNQGAVFSRNRDFAAVDQSSLGALDGDPSHAFTVSRPYYSSYAPQGRFTAGGRNFTYDKNNNLISGFSTNGTETRAADGFNRSDYRTIAIPTERYLFATQGDYEVNDNLRFFMEGTYAGTQTKTEMEPFGLASDDIFPATVWNIQNADGSRNPLVPTALYDAATDTNGDGLKDLVFTRRLREVGNRGNTADRDTYRFLVGADGDIPMVEGWRYETYLGYGKTSESQVSNGQVNVQSVRQALDAVVDVNDINSNGNRTELICRDADARAQGCHPINLFGFGSISPEAAKYIAAPGMLSTFTQQTIAGLNVTGDVVDLPAGALGVALGTEYRAERSRSEFDALQQSGLNAGNAIPATRGDFDVFEGYAETNVPILADLPFAKQLNLRGAVRFSDYSTIGTTTSWNIGGEWQPIDDIRFRVIRAQSVRAPNISELYSPPSQNYPTGLIDPCVGIGATGGGVIGENCRRDPGVLSNIAANGKVTLTQSDVQGVSGFDLGNPNLSEEKGKSWTIGAVITPTIEALSAFSMTVDYFNVKIEDAISAIPRQFILDQCYRTNDQEYCKLIRRYQAFGVNSAGAIDEVDQPMANAGSLATSGLDITLNHRLDLEDLGLAGQLNSRLSYTHVFKGYEIPLEGAAKDSFNGEIGTPRDKAALNLIYGLDNLSVAWTSTWIGNSYLDNQFLASMEWPGNVGVGNWFYHDVQVRYAATENFELYAGADNVFDKKPAPILSNLPGNETGTETASGTYDAIGRFFYAGVKVTF

SEQ ID NO: 11464 - protein, 97 aa, Brevundimonas sp. BAL3
MHRILAEKSVNITELRKNPAKYFIDQPVAVLSNNRPAGYLLSASAFEALMDMLAEQEEKKPIKARFRPSAARLEEITRRAEQYLNDMTDDDFNDFKE

SEQ ID NO: 11465 - protein, 210 aa, Brevundimonas sp. BAL3
MFVVFIEGFGLAISLCAAVGAQSLFIVERGMARNYVFLICALCFMCDIVLMSMGVFGVGAYFAKNLYLSLSLNLFGALFTGFYAFLALKTLFQTFKKKQVQTPKKLSLKKTLLFTLGVTLLNPQVYLEMVFLIGASALSFNLAQKFVFLAGTLSAALSWLLLLCTLSLRYGSKLLNNQKIFMGVNLFVTAIMGTLSVTLFRDFLALLSKT

SEQ ID NO: 11466 - protein, 415 aa, Brevundimonas sp. BAL3
MARRAGRGREGAWGAIILLACAPALAQERAPRATLDETGLTVRGPDDAVRFELGGRLHADFGAGGSRALTNEFPVAADLRRLWIEPKLTFGRNLILNLQYDPASAATPINNLLLSYKGAPVAAGMPSWTLTVGNFKEPFSLEQLISNNDTTFMERSLADTFAPGRDTGLALGTHGRNWTLAAGVYGGNVNADVGRGGVAGTLRATAAPILAQDRVLHLGIAGSYRGLDRGGPALSFGTTPESVLFRESLVDTDVIAQARAVGRLGLEAAWAQGPLRVQAEVIATRVERTAGRDVAFRGGYVYAAWVVNGKAPRYVVEADTATEIGLFKRVAPEGGQRVSRGGPGVVELAVRVAAVDLTDRDIRGGRQRDVTVGVNWYPEPFLRVMANYVHAWADPAATGRPAEAEIGQVRLQIAF

SEQ ID NO: 11467 - protein, 909 aa, Brevundimonas sp. BAL3
MKLNRLAQYVSLACGGLAAIAVPTFAADNSDETVERIEVTGSRIKRIDMEGASPITTITADELAKSGFSTVGDALRSSNLNAFGSWGGGSNNGWGSQATVQLKGASAFHTLTLLDGKRMAKSPVMDGGAANINTIPMAAVERIEILTDGASAIYGTDAIAGVVNIILKKDFEGIQFDARMDRPTQEGGDSSNMSFTGGLDSEKGHLVFTVEHYESQKIMQKDRWYTRPFVKEGGNPEDYQDWVNISPTGRVLTQGDAGGWVYSTPFSNSDKSCADVYGEAFIGSLIDSDYPGDTLCAYDYTQAAATSVGQTRNNTLIHYSYELTDSIELTARAYWASNETKDISAPVPASISIPEGLPAYTTPEGLELVELVADPSAGMNYRFDTAGDRVAEHHDNIYDFLIGLDGSAENFDWDVAVNYNKYDNYTWGTGYQLKGATTDLVGHWDEDTNSFVGWDPRDPNSALPPGATANYDKRMSASYLDVNGGLSFNLFELPAGDVGMYIGASYREETLDSKVDALAEAGQIVGGNGGSGGAGERDVKAAYFEVVLPIIDSLELNLAGRYDDYSDFGGTFNPQVSIRYNVIDSLLLRGSWGTGFRAPTLSDLYQGTSEGFGYIKNYLNCYKEGEDIDTCDRWDYGATRTGGNEALKPEESESYNIGVVWEVTDEINLSVDYWSLETTNLISELDASEIVRTQAKLWELADANGEPRPDVSSVYPGTSISQIGNGKIDYVVSQKLNVGLSEREGIDVKLGAGFGSDYGDFKFGLGWSYFLKYKSSYSQAGAQILSDDYAGREDTPAHRINLTADYSFGDHALSYFGNYIGSQKSWDIVEGSWDAEAGETADDGQLYEVDSVFYHNLTYTYTLPWNNSISLGVTNLTDEDPKFKYDGTYNGNLYDIRGRTYWAGFRQSF

SEQ ID NO: 11468 - protein, 1550 aa, Brevundimonas sp. BAL3
MTGVLRHKSMLLMTTAALGFYVTTARGAGVDLDTAGGSYDISAAGGNQTIESLSGVSGTSVLLGPNTLTFGNATSQTFAGTINGTGGIVKQGSGTQILTGTNIYTGGTTINAGKLALGAGGALAAAGSVNLGASGAGFDISGAGSNQTIGALSGVAGTSVTLGPNTLSFGDATNQIFAGTISGTGGIVKQGIGTQILTGANDFSGGTNFAAGGIVVGNDSAFGRGGITVNGNAQLDNSASVSLANSINVTGGATLSVNGSNGLTLGGVISGGGGLTKNGAATLMLGGSNTYTGGTTINSGTLMITSGGALASTGAMNLAGAGAALDISAAVSSQSIGELTGAAGTSIAMGANSLTLGGAANATFGGTIGGMGGITKTGWGRQTLTGTNTYTGGTTINAGTLALGAGGALATGGFVNLGAAGADFDISAAGSQTIGALSGVAGTRVTLGPGTLSFGDATSRTFAGAISGAGSIVKQGSGRQVFNGISIHAGLTSVMAGSLIIGDTRGTSASIAGNVTVGAGATIGGHGRIGGDLTLASGSHLSPGASIGTLTVDGNLTVGQGSQLDFEFGAPGINFATFGQSDSVSVRGDLTVNASVLNVINGGGMGPGLYNLFSYGGALSFNGGGFFPPAGSAIQILTGTKQINLVNMTPGVELNFWNANGLAGPSQMGGGSGTWSVANANWTDSQGSFTGPMTPQPGFAIFGGASGTVTVDDNAGTVGALGMQFASDGYRLDGDILILQSQNATMPEIRVGDGSAASANWTATIDTVIAGINGIAKTGAGTLVLNASNAYSGGTRISAGTLSVSNDSNMSFINGGLILDGGTLRITGTGFSQTARSVTMTGNGGGFDIADAEARFTVSQALSGSGALVKSGDGTLVLSGANSYSGGTLVNGGTLQGDTESLQGNIINNARLVFDQQSDGAFAGDLSGTGTFVKSGGGKLVLSGANSYSGGTLVSGGTLLGDTASLQGNITNNAQLVFDQQSDGIFTGSLSGSGSLVKQGSGMLVFNGNGAGFAGSTVVENGMLKVGDADPSAAVLGGDVTIGTGGTLRGHGVILGSVTNQGILRPGGSVGTLTINGNLVQTANSVLQIDTTPAGEAGKLVVGGSAQLAGGLSIIGENGSWSPQTNYTILTSAGGISGTFANIDSNLAFLTPSLTYGATTIDLRLNRNDTSFASVGETRNQKAVAGAADRLGRGEVYNALVSLSAAEARAGFDALSGEIHASVKGALIDESRFARDAIGDRLRAAFDANCKAGNPVWTGKGSAGAYGQACANTAETAFWLQGYGAWGSNDGDGNAAKLSGSTGGVFIGTDIPVGSWRTGLMAGYGNSSFDADDRFSSADVDSYTLGAYAGTVIEKVGAGDIGLRFGATHSWYNIDTGRSISFAGFKAVEETSYDAQALQLFGEAGYKMQAGRASFEPFANLAYVRLHTDGYDGDGVAGLHSDSDNSDVTYTTLGLRAATDLTLGGLASTLHATLGWQHAAGDITPVARHAFAGSEPFSVAGVPVAEDAALIEAGLNFQFSEDASLAAGYKGQFGDGAVRNGFNASFNVKF

SEQ ID NO: 11469 - protein, 1139 aa, Synechococcus sp. PCC 7335
MKNLISQYIMNLSDTFQQLIRNICIYKAQTFNTILHTVYDKKIHKIFRIPKHIKLTKTLLQQTIAILLLPFFCLFCGSSELLAMNNGNGKSPKPLCLKLGPDGGTHHSGGSSGGSSPITSQPQSSGFGSSSPSVSSGSSSVEVTRGLSSPQECCPPCDKNSLDACLKGACIGAGLGIGAGMIPFGAMTSCACPATGSVGAGTCLGGSVAGAALGTACSLCKTHGCQQDSPYVTCDKDMVKVTGLGISAGGLLGAGVGLVTSAATGAPCPDMAAACGIGAGIGAAIGGPLSSCLYATSAMCCQSSSRITSNISEHQSSRLAQHHLTSSTSHLPITTQPQSFSGQATDPHMTNEDIDRGTCPSPCCTMTDYTVRVCTYPDPCDHFAGWATFGSCLGTLFGSLGAYLLGADVSTTASFVSSGSLCTCGLLGMGYYCKKYGNQHLREDGHTTREINDTEECKTCCKSICEKMALGAAVGTGAGCIAGTCAGGIMSHWDLSKMIESAAAGAGSGCCTGSLCGFLWWFLGELERDGFLDCCLKKHGIKSKKEGQPITEQPQRQPQVSSEFSTEDKQCIKEVCCGATSSGLCNCCIGGASSAMAHGCGSSAAVTAITSGATGCATGAACALLTHCLKKHHPKKWAKIQQAMHSLVTCVAAPVTSQPQPREENDNDDERPGPSSGGHGLGFGPEDYPLLSANQQNNSDTDSDDDNDDKRQQNSGSSSQHDGGSNDGPSDDEQSKKSKGKGKGKGKGKGQKNGEQQQQPTALTRGPLGGMGGRHGYKCYDTFIPGYNRAGQISSLQSMQSILLGSSEQVLYSLRLLALKAYTNTSYEDDSLQLMTRFTSKRHILSGPHQKNTQNTLTSAFKSYAMFGFIDNYTANLERKCRGGRIGIITNLMPNVRLGLAYNRNKEVAKEHIGMRFGTASGSVKAQTTTDSLSAVISWNTDKFGFTGHLASCYGWGKVKTNRYFTHGDSEVGAKGKPDISLGGGLFQLGYNLPITKRFSFTPYIEYMISTVSWSSYSEKTGPLPCKISQNKEYVMEQSIGLRNQWKVTTNSQLQSWVSAISGKRTLEGIHSKPLIAQIDRYKASIPTYKKRYVRTELGLSYEANIIDTINIGINTSVRLEKTKRFEGQQINTYIQYTY

SEQ ID NO: 11470 - protein, 959 aa, Synechococcus sp. PCC 7335
MTATNDKGALLMIKTLGLRIGACALLATTALVSIVPATAQAQAAAQVTFDIPAGDTATALNAFSRQAGVQLMFPYDVAARHRTAGLKGAYGREEALRRLIDGGELEIASATAQVITLREKSAGPLAAAPADMVGEIIVTSRAGSDVRTRLETSYAVTTMSAESLRLRSPMGVADALKAVPGFWVEASGGEASANIRARGIPQEGYSAIALQEDGAPIQHDGGLGYLNADQSFRLDETIDRIEVVRGGPSSIFASYAPGGTVNFITRKATDTPEGLAKVQVSDYGTKRVDLFYGGPVGGGWHASVGGFWREEDGIRDPGFTANKGYQWRVEAGRAFERGSIEFNLKHLDDNVILFAGVPVKFNAAGEPSAAPGFDPLTGTLAGPETAHLTLRGPTGPFNWDLTRGTEVELTQATAVFKYEPFDGWHFQDTLRYRTSESKRIGLFPNTPVLGTKRIDQVTTDFLKANNNAASLGNAASLGQVIPGAVGLQLRYSTTGEVFNTAGAGQNGNGLVLDGSLRYVSVPLDELINDARVLHKFEMGDQTHDVAFGVYTAHVEEAFNRYSANTLLDVQSNARRLDLVAVDASGKALYSFTENGVSRYGAEFANGDGKSNTLALYLTDEWSITPKLRVDAGVRWEKIEFEGRSERSATKNLGQSPTPADDTVLSGTGVYDHLDRKFQHAGWTLGVDYKITGQMGMFGRFTSAFRLPSLGDYITNATNSTGTVQTMDLSELGFKWVTPKIELYATAFQTTYDNLGFGSLVFNPTTGAYVNQTSVTDTKTLGLELEGTVRPVSWFDLRLSATFQNPEFGDYKFEENCTVAATDPTCQVKPPAATASRTRDFTGNQLIRVPKTSFRLTPGLNLLDSKLRLEASVERYDDRYSDAANTSKLPAYTLVGATVRYQITDGLTVYAYGANLFNELGLTEGNPRAGQIVSGEAGSLYGIGRPEFGRSFRAALMYRF

SEQ ID NO: 11471 - protein, 258 aa, Synechococcus sp. PCC 7335
MTMPTARGPTEENWNGIQMKKNLLLAAVSLVALSAAAPAVAADLAARPYTKAPAMVAAIYDWSGFYIGINGGGGSAHSTWDLVGGGREGSHDATGGTVGGQIGYRWQSGQWVFGVEGQGNWADFSGDNVSALFATRNRSKIDSFGLITGQVGYAWNNVLIYVKGGAAVAGTKYEVFSTASGALLSSNDQTRWGGTVGAGLEYGFAPNWSVGVEYNHIFLQDKDVTFAGLAGTDRIRQDVDMGLVRLNYKFGGPIIGRY

SEQ ID NO: 11472 - protein, 823 aa, Synechococcus sp. PCC 7335
MLCHRPLVLALSLACASAIPLLPASAQAQAASRHYDLPAQPLAAALDAYSRLSGVDLVIGAALPAGHAAPALRGDFDDAQALSRLLAGSGLRPRFIDARRATLEPAPAEPGDGSRRTGPLRVQGDTAHGHAPGTGASQYVPATRDGFAPTVGSERVAMAERQEGNSLLRSMPGTHSFHSRSQPGLQVNIRGMTGAGRVNTMIDGVTQTFRNNAGHGSGGPFAYVDPFLLAGVDVQRGAVAGGDGAGTLAGSANFRTLDIDDLLGEGRDWGLRAGYRHGNNGYGSGRTFAGAWRHSEEGGDRQFGLLAAASSSRSSEYATARGQKNSADPGSQQPSSWLLKARLQPSDQHRLDLSHMRYENDFYHNYPWQISARNQRASYHYTPYSPWIDLRATFASNKTRLFYPPVEDSSYIGRRTHSSLSSWTVDNTSRFDIGALQARWNTGIKHQSDIYVADTPILRGANPQGRSQLDSVFSTLELQYDIYALTAGLRQDRFGIRGHIPACSDVPGQCAEINGGDIDVRRTERALSPSLAVSLQATDWLQLFAEVSRTSRPPRVQEMFFEKIPLEDASVADGIGANPFLRRERSRNLQFGANLSTNSLLVDGDLAQLRVTRFDNRIRDYIKPQYLLIVHPPEVEPFVVPIDSDPQLNAWTDVLDADDFSATTRWMNHPGVVRMRGIELEAHYASEHYHATLSWTRSRTSAPAIEFVNLEDITALPDRYWTLDVGGRWWQQRVQAGLRAEYSGPTEEGYDFFQTRKTGGTGVLLDFYASFKPQANTTLWLNIENLQNKAYDNNASIDSIFSPILDRGNGRGRTVSMGVNVAF

SEQ ID NO: 11473 - protein, 1382 aa, Synechococcus sp. PCC 7335
MTTTSYSENYTITQETKKESKEILKHEKEDSSRLGKFAVSGNAIIFQRDGSLINNGLLRGSIKADGEDTKNEKSKKGEIIVTAQGNGVSSVGYSPYSNKNDIDKKIDSVSNKGYISGEANLTGGNAERFGSIEEVYSSANGISGLALSDFGDTATGGSGDSGIVDGPGGATRSGRSKSASLLSTKALASKTTEKISENKIGEIKKTDPKDFYGKNNKFTLGDITNSETISGKAILKTKEGYIRKDSKAFGGNLAISHQWRTINATSTGNGISNLAYISTVDRYTYSEDKVNGSYIKSIKNSGIISGNVEATTGSGATQTTIRASVTGNGISSAAYSNNFVKSLTEATIDKIENNGTISGRLKAQVGNNTARGFHEYSNAIITGSANGVSVYSRSSNGQMKNSRAVIGELTNSGSISGNLYAKAGSGYGEVKSDVKSSGNGVAIYTESSTKKETKIGSIDNKGMITGKAVIYGGKDKKAMENKTLRDKIFHVPLTNKIAEYSLPDEDVEADKKAVAEMKKYEEEMANELENKIEKYKKQIVDKEKDILAKTPKKPEISEADKKDRDNTFEKYLKAEIRFQQDLILSGYNEKVVAEARKRKAELEKLKGSATDDEKIKFLGEYKAELEKRINGLQAWQKKEINEKLAKINNILEKNKGKDIPDTPEILALKKEKAELEKELAKVIDEKKKSDHLAANVHTETGVVASGNGISINDGKEDGVVLGSLKNSGVISGETEIHHGNSQRKYSRIAHKNSGAGIAVGGNVEGKIENTGIISGTEFALLAKGERSDAYGIDKKSVTYKSGFKGGVDNYGILAGRIIIGGYQSAHTGSHGKWGKIEEEYGYFETIYKDKKHYNNKGIFLVLDRNGEVRKVIGEDKETIHNGRTVKNVLDINGTYEGDTTNKIINGVGKDGVVVAKENQNKNIENSIVNGFKNAIKVKKNGLVKISNSTINANGFGKSYAILGDEGANEVEITNKSIINGKIDLGAGDDRLTLSGNYRLNREVDLGAGNNTLAFGKKENTTRRTLSYSTFGTSSANTSVFNGTVNNANKVEVNENTAFSSNSRINGVNELNLANGKTLDYYFVDKENQAFAELAKSNRNLKVNGSGKVNLVPIGSKVQIGYEKDLLGFSFGNNLLKPNSNGGTTPPNNGRVTSPNNNPGNNTPGNRGGFFIDPRLTPFDRYSKGAFDAYIADYKSTGIDFLKDYKSTQEVFKNYLYNLTNNNPVGYLKDSAIDTVLAYHKTNTNSNFAKKGQITVSGETFNIRNKYYENNKVVSNGASAEISYGTSDNTNIGLNIGGGQSKVKTSNENIKSEVLVLGVNAEYKVKNFSWKNEVSYGRIKPKKYSALDTYSLYSQLGYNIPLSETWTLTPKVSVSFQKLNKKK

SEQ ID NO: 11474 - protein, 1012 aa, Synechococcus sp. PCC 7335
MNQRAHYRPRQTAMTLAVAALAAMTQMQTAEAATVSSPFGGIYVWSIGDLSVTSTISGGGIGVAAFALGTLGTLSNSGVISGGYGFYTSGAVAALHNASGGTISGTGNDGVFNTSNSTIGTLTNDGAISGAHYGVLNYYAATINTLTNSGAITGGVVSGSGSWAGIDNAGSIGTLTNTSSGTISATSNASGVYNTYMIDTLSNSGLITADSRGILNNGTITTLINNSGGTISHSGTAFGDGIDNNGGTIGTLTNSGVISAAGSTGYGNGIDNSGTITTLTNNSGGTIAGNYTGLYNSGTIGTLTNHGAIIGGYSAGVANDGTIGTLTNSGVITGSNSYSGNDGFGVKNSGTITSLTNASGGTISGTVSGSGAAYGVFNGGTIGSLANSGLITGSTYALFNDTGGTLGPVTNAGVIAGNIGNLSSNNLSISGGTGTTFGTLTGYGGGSTLGTIDNPNSSVVFASGNLLLNDNINLGSGTINAVNNTGSAVVQVNRPVTITGNYNQGSGATLQIGVAGGATTQGTLATDAGYGRLVVTGNTTIAQGSSITLQSNGYAFAAGQRYVVVDTAGTAAYNAGSLRYAINGYTSTVTGAAVANGSNSDLVLTVVSATSLSSPATPSPTTSTTTTTTTTQNPASIATVPNAVASLNGLLSYTGISSPNLLNLYNAALGSLSEGSTASANQIGKQLGATQTGWAPAAPTFDALNVVGAHVNTLRLAQAAGTTGVATGDSPASWGVWGQAFGGHAQQNERDQIDGYSANYGGLLIGADREINDRWRAGGVFSYSNTAIDNTGDTSGNSARVNGYGLIGYASYTGNPWYVNLSGAAVQQRYDTSRLVSMQGLSGTASGHFSGQQYVARTEAGYPLSVGSVTLTPLASLTYSYLTQDSYTENGGNGAALSVGSTHVGSVKSGLGAKLEKGFATRYGQIVLEARAQWIHEYDHARQVTSASFAADATGQTAFTTVGMTPVSDLADISLGATLLRANNLSLSARYELQAGRGFVSQTGSVRLRQLF

SEQ ID NO: 11475 - protein, 227 aa, Alcanivorax sp. DG881
MKLRGPGKNVLLLSTMLVTAPAMAHQSGDFIVRMGGIKVDPDVSSDSFNPALPAVGGVGVDVDDDTQLGLTFSYMVTDNIGVELVGATPFTHDIILDTGGSGVSIGETSHLPPTLLAQFYAPQLGPVRGYLGAGVNYTLFFDDSIDDAVVSPLVGGADVDVKLSNSIGFAWEVGADVIIDENWLFNVSIWNIDIDTEARLYVNDVRVDKIDVEIDPWVYMVGVGYRF

SEQ ID NO: 11476 - protein, 421 aa, Alcanivorax sp. DG881
MKKTGALLIGSAFAALSTQAIATGFAVSEQSVSAQGTAFAGAAVLSENASNQWYNPATLAGLKKTEITAAVQQVIIDTSFKAEGGSGPGDFEDFSPVVGSAFLAIPLSDKMTFGLGINAPFGSKIDYEDNWGSVATDPLAPLSPTTGDRYATMSDLKAYNINPALGVQVTDRLRLGVGVSYQRLEADLESSFTRLEGDDDAYGWNVGLVFDADDNNHFGLAYRSAVEYDLDGDITFSPLPLVASGQPLPVATALAGKYSGSTSVDLPASAQFSYAGDLSERTQILFGVEWMEWSSLDELVVDHSGAPIPSPAVQEFGWGDTTRFSAGVRHVLAKGTVLRGGVYKENSTQSSENRSPASPDSDKIGVSIGAGFNPTDNMTIDVVYSHIFIDDAETNLTERGLLKGDFELDADIIGAQLSYRF

SEQ ID NO: 11477 - protein, 745 aa, Alcanivorax sp. DG881
MGNRTESGLIRGLKWGRNPLALAIAVAMAASPVWAEEQQDADELQTIKVNAEQSDDVYGGDDFGYVGQRSLTATKTDTPVKEAPRAVSIVTREQMDDRASVSIADALQYTPSIQANFYGEDNKQDWFVIRGFKQANNGLYRDGTRVYSYGFYSWQLDPFAQERVEIMRGPASVLYGQTPPGGVINVISKRPQDYSFGSVTAEYGSYDRKQISVDVGGAPSEDVSWRVIALGRENGTQVDDLEAERTMLAPSLKLGLGDRTELTLLASYQKDDSDPYLQFLPSSGTISPNPNGKIDDDVAIGNLDYEKFERTQVSFGYQLDHAFNDSTSFQQSARYQHIDVDLKQMYTLGYMPGSGDSQAIRGLTDEDGDAYGVNLDNRLIHTWSINNVEHTLLAGLDYQSLHIDGKSFGDPLMGYEAAPGVFAPATLNPFDPQYRDASELTPVSCNFSTLVCTEVTERQRTTIDAYQVGGYLQDQMKFDNQLVLTVGARFDRASSEIENKSTGVEQKIDNDKWTANTGLAWLINDNVTAYTSYSQFFQPILQLDQNGEAAKPQEGDQIEVGIKFQPEGMDGYFNAAAFKITQENLASGAAGTPAFKQIGEVESEGIELEAVTNITPSLSLLANATWMNPEIVSDSTPAEEGNRPVNIADTLYSAWAKYTFLDGPLNGFAIGSGVRYVSDTYGDNLETLKVPSYTLWDATVSYRYKDFKFQVAAKNLEDKEYVATCDYYCWYGDRRSVIGSVTYAW

SEQ ID NO: 11478 - protein, 719 aa, Alcanivorax sp. DG881
MSTQQRAAGNACPTAAFSFDPARLAQRRRWAGAFAALCGLALSPSAVLAEEHSQHQDRAVELAPSVVTGVAQSSPLTIVTNPKEPRQPVPASDGADYLKTIPGFAVIRNGGSNGDPVLRGMFGSRLNILTNGGMMLGACPNRMDAPTSYISPETYDKLTVIKGPQTVLWGPGASAGTILFEREPERFGELGSRVNASLLAGSNGRFDKVLDAAAGNRLGYLRFTGNHAQADDYEDGAGNTVPSRWKKWNGDVAVGWTPDEDTLIELTAGKGDGEARYAGRGMDGSQFKRESLGLRFVKSNISDVLEKVEAQVYYNYADHIMDNFRLRTPDPSGMMPMPMASQVDRRTLGGRLAATWRWDDFKLVGGVDAMRNEHRARGSSYDMMTDYYTDTDQFPWSKDAVFHNYGAFGELTWFAAERDRLIGGLRLDRASVKDYRQTLKSGHMGHAMANPTAGDTRADTLPSGFVRYEHDLADSPTTLYAGLGHAERFPDYWELFSPKRGPNGSVNAFDKIKPEKTTQLDFGLQYNGDKLQAWASGYVGVVQDFILFSYREGMMGSSTQATNVDARIMGGELGASYQLTGNWKTDASLAYAWGKNSSDGRALPQIPPLEARFGLTYEEGDWSAGSLWRVVAPQNRIARDQGNVVGKDFDKSAGFGVFSLNGAYRVTRNVKLSAGVDNLFDKDYTEHLNKAGDAGFGFSANETVPEPGRTFWTKVDFSF

SEQ ID NO: 11479 - protein, 782 aa, Alcanivorax sp. DG881
MTLRKALLLSASLSASFSASLLGPSLALAASPEKAKPLAGKSEASHHASAHHPAAKPVARKAAPQSIQARDTETIAVTARRTDFAFAAAQHSPDADTRLTADRLTQRGVVTLRDLERVAPNLTIQSINGTASTNFYLRGVGFNDFTQNNIPTVMTYFDDVPFAFSTMASGLMFDLADATVTPGPVGTTHGQSDTGGEVRFRTADPTSTLHYGASQDIASYARSRSEAYISGPIAKGLDFRLAGQIRQGGGWQTDPQNGAHLGDADSYALRGKLRWHSDDNRTTILLSGHFVQDNSQVVTSQAVHRLIGTTGLPQLGQTQAEWSVRPQFANLIGRPESLKPSEHNQFWGWDLHMDHDFGFAKLTSVSAFETERQGEYTDQDGTSRSEADTYRTISANAFTQELRLGSSNPDSRLQWVVGAFYQRSRMKQRFFFDYTDYAARGYMMATSFTMNQESTSEFGHISYRLPHNVTLFAGLLHEIDDRSLPGLTSEIFGGKTTAFHGESTASAQFAGQVGVSWQATKSTLVYYKMSKGFKPGGFSANNTQIQAQLDPFGPETVLTYELGVKSDPIPNVLRLNGAAFYNDFHNQQVVGTVLIPNYGPLSEITNVPKSESWGFEGTIELHPVRHVFVTQNIGWQRGNYQDFLNVNRAATNAAYAKTGVWQAVNSNFAGVDNGQPKLTLNGQAEWRQALTPGLGFDIGPDWSYRGSQAIAVGGTGFYRLPPYFLLGAHATLRPSSGKWEATVYASNLLNRSFFESGGMATTTYFYIPGPPRFIGGRVSYGF

SEQ ID NO: 11480 - protein, 415 aa, Alcanivorax sp. DG881
MIFRPTVSHAWRGIFILACLTIAPDARAGGFGIRAQSAEGFGAAIAGVAAGNALSFSYWNPAVLANVDRFQVEGVSNVIFPAISLDPAASNTVDIGKGALVPAMYMAMPLNSRMTLGMSITSPYGLATQAPTNWAGQIYGRKSEIFSINANPMLSYRVNDVLSVGVGLQVQYFKTKLTQAVDVVPFAPDAMLKADGVGVGFNLGMQLKPWAGGTIGLGYRSAISHDLDGHLTTPLGRASAAAGLTTPALVSLGVRQELNERYRVMGTVEWTNWSRLGTVPVYDRVSGGVLTTLPLRYRDGWLFSVGGEYDFSQKVTARAGVGYEIAPMNDMTRDVRLPEPNQVILSAGLSYRYSERTTLDLAITQSLGLGNGAVTIASGDPRYLGLPFSATSDLNVTIVSAGLKMKFDSLPFGIR

SEQ ID NO: 11481 - protein, 615 aa, Alcanivorax sp. DG881
MKQQLFALTPLLLCVSMASQASDMALDITGTNVFQLMNLKITSLSKKQQSLNKAPAAVYVLSHDEIERLGVSRIADALRYVPGVEVARIDASRWAISMRGFNGRAANKLLVMIDGRSVYSPLFSGVLWEEKDILLADVERIEVIRGPGGAIWGANAVNGVINIITKTAKETQGTLVDVSTGLKQRQVTQIRHGWKLNDDAYLRVYGKHRQHQQTNDEYNNDDNQQNQLGFRLDYNFSTDNLLTLQGDIYSGEVGELDGQLKPAGQEHSGGNFLANWQITDSHQGKHTVIGYYDNTHLQVPGLEDDRELLNLDYQFEQQWQLHAFVTGFGIRFLSDDVYTAPLEYIQPRYRDDQVVNAFFQDDIAFLEDDLHLIIGTKYERNDYSGDEWQPSVRFSYQLAQSLLWGAWSKAVRVPTRWEADIRFGAFSGERLKPENANVYELGWRKQWTETGSLDITVYQSDYDDLLSIEANGYGNQISGTVKGIELSSSIQVQQDWSLRLNLSHAAMALTAQQGSLSVARAQLTEGQMPKNMAQIISMWDINSQWQFNTALRYVDELKSNKVDAYWSVDASVNWQASKQFSVKLVARNLGDGPHQEWDPYVPIEADVVINLRWEI

SEQ ID NO: 11482 - protein, 431 aa, Alcanivorax sp. DG881
MALAEDDGFYMGVGYQIGGAQQNIDNKGSTLRNNVINNFRQVGVGMAGGNGLLALATNTTMDALLGIGNQIVNTNTTVSNNNAELTQFKKILPQIEQRFETNKNAYSVQALQVYLSNVLYNLVNNSNNGSNNGVVPEYVGIIKVLYGSQNEFSLLATESVVLLNALTRVNLDSNSVFLKGLLAQMQLFNDTSSAKLGQIAENLKNGGAGSMLQKDVKTISDRIATYQENLKQLGGMLKNYDEPYLPQFGPGTSSQHGVINGFGIQVGYKQFFGNKRNIGLRYYAFFDYGFTQLGSLSSAVKANIFTYGAGTDFLWNIFRRVFSDQSLNVGVFGGIQIAGNTWDSSLRGQIENSFKEYPTPTNFQFLFNLGLRAHFASTMHRRFLSASQSIQHGMEFGVKIPAINQRYLRANGADVDYRRLYAFYINYTIGF

SEQ ID NO: 11483 - protein, 212 aa, Alcanivorax sp. DG881
MFKRSITAAALGAAVMASAGSAFAADMMGGTDYTYNDPVAAGPHDWSGNYVGAQVGGSSSKFPSPFASRTGALGGIVVGKNMQNGNIVFGAELEGNFAEAEHRIGHGGTLQQSWNGNAKGKVGYAFDKTLVYGTAGYGVTRFKAKDNTTSAPGWEGGVLIGAGVEQALSGPLSVKAEYDFQRFNDVKSQVNGIEQRNNLKNHSIKAGLNYKF

SEQ ID NO: 11484 - protein, 652 aa, Alcanivorax sp. DG881
MNAYSRTLNLTSYSITMFLTRSATAIPLYPLFIFPFAFLASPASALPQAGTLEEVRVVGRRDVLLPSLGAGTTDLIAFDEQVSMNRTVGDWLEQLPGVSLNGQGGLFQAYSIRGFSRWRVRTELNGVPIITDRRAGNSASFVPPDLIAQVAVNKSASSTLYGSGAMGGVVNLDSRIEEGRSLRAEGASNGGQFALTALSGNPGGLSAGLSVRKAEDSDAPDGRKLNTAFEQVAATVTGSSELGSLSLDYRWLGSVSRDVGKSNALFPERRISSYPSDDHSVTQLELRADGDWFIRAYHHLQDWEADVERVGERRNLTSYRAHTVGGLFQANTRLLSGEGSVGAEWVGRRGVAIDDEEFTPDGTLLIEQALVRGEEDTVALFADQQWRLGAMEISGGMRYDHMDQSSRSQSNADGQWSASAAVDYGLGDSWTLRGELASGFRFPGLSERYFNGTTPRGEVLGNPDLEAETRRSGELALQFAPLVSTLKAGAAVYYSDLEDYIERYPVGPELVSYRNLDGASIQGLELDVGFQTGVVHHRLSYQWQEGEDDEGNTLADLNPPSLRYFFSWEQEQRGFYSDLSYRESREEFGADELPLASAVIWNARFTQRVARRWQAELFLSNILDEEYRSTADDVAPLQPGRTFGIRLEWRES

SEQ ID NO: 11485 - protein, 89 aa, Alcanivorax sp. DG881
MSLSTEATAKIVSEFGRDANDTGSTEVQVALLTAQINHLQGHFAEHKKDHHSRRGLLRMVSQRRKLLDYLKRKDVARYTQLIERLGLRR

SEQ ID NO: 11486 - protein, 357 aa, Alcanivorax sp. DG881
MKKTRQVVVRVAARRVVGTVGVTAIFSAGLVLHSVGAYADSGSQVQLYGLLGTYVGSIKRSDTPQAAVQMGSGGLTTSFWGIRGKEDLGGGVGAIFVLESFFQPANGALGRSAADPFWSRNAYVGFQGDFGQVTFGRQRNPAYTAESLVNPFGSSTVFSPLVLQTFVTNYGGTIIGDTVWNNTVKYTTPDFKGFAATVIYGLGGVAGSPGVGNLGVHLNYRGHGLTAVLSGQRVRYTAAGPVGAQYAYLAGAAYDFKLVTLYGAWAMTSDASTPTGSHTYEAGLSIPLSPADFLLAEWARTKRSGATRAASGLRNTASVGYNHLLSKRTDLYAIYAYDKLSAHPIGNSFAVGIRHTF

SEQ ID NO: 11487 - protein, 1116 aa, Alcanivorax sp. DG881
MERSIMKSIVTRWLLPVLVFCLLPVADSAGQGTTASITGTVVDENEDVLPGVNVVAVHQPTGTRYGTATNTNGRFNIQGMRVGGPYTISASFVGYQTIRREGIRLQLDESRELNFALEPKTAQMEEVEVVGRQSGAVIDKDRTGAATNVSTEQIEELPAIGRSLTNFTRLVPQAQGDGSIGGANSRYNNIQIDGATLDDVFGLGDAVPGSQAGAEPISLDAIEEFNINIAPYDVRSSGFTGGQINAITKSGSNEFEGSFRFQGGTEDFTGDLEGVGTGEFNQAFYVGTLGGPIIEDELFFFISGELKRESSPLDTRVGEDLEGTNVFRESRDTFTELRSIFQDTYGYNPGGISPLTQRQDDEKLLVKLDWNVNDNHRLTLRNNYVNATDDQGIDRSEGSFSFANRQYVFQSRQNSLTAQLNSSFDNDIFNEARFVYTRIRDERDVQDAAFPEIALDLGGGDEIGAGIGRFSQANRLDQDLFEFTNNLSYTVGDHTLTVGTSNKFYQFSNLFIQDFFGSYTFEEFVADGDTISATEALRRGQPSEYRFSYATEAAGTDRPEADFSAFQFGGYVQDEWQALENLQLTLGLRVDVPVLPDDPTFNPTAFEAFGRSTSNVASGNPLWSPRLGFNYDRAFLGSDLSTQIRGGIGIFSGDPPYVFISNQYSNTGADVNRIDATFDQESDFYGENAPENGRRFVPTNIGDNPTGQPLPRNAPFCQETPDSERCSELLAPVQTTEINLASDDFKYPQTFRLNLAVDQELPLGVVGTVEGLYSNTINDVTFRNINLEAPEPGGTSDGRYPIQGSKYGRPFYGTPGGDVNRVSERFTNAILLENTNDGYQYSLTGELQRNVRTGIGGSVAYTYTRATNVNNGSSSRAISNWQFNENKDINDPRVGTADYEIRHRILGTLNYTLTYGDRFGTTIGLIYEGRSGEPFSWIYDGNANGDTQSFNDLVYVPENESDIVLESDNWDLMNAFIEGDDALSDARGSVIERNTARAPWQNILDVQISQSIQTFNGQRIEFIAEVNNFLNLLNEDWGRIQNTSFNNVTAWAFEGYVRPDQVGTIENGRVITEDDVGKPRVSFEEETVRERLNGEQFFTSDIPSRWRARLSVKYTF

SEQ ID NO: 11488 - protein, 1149 aa, Alcanivorax sp. DG881
MKITMILLTCLLLQVRAAGYAQRVSMNRQQCSIHSVLEEIRKQTHYDFLYDMSLFNSAKPVSIKVNAATVEQVLDACFKGTPYTYIIKKNVVVITASDKADISDQESKPAVAVHLPQQQVGRVAGKVIDERGGALPGAGIKVLKEDKTIQSSVDGSYSLSLAPGTYTFEVSYVSYQTKRITDVIVRSGQLTPLDIVLNSSTNTLNQVMVTGSYKKESIAALYTRQKNEAGISNGISAEQISTLPDKNVGETLKRISGISTTDNRRVVIRGIAERYNLAMMDGATLPSTDVQVRDFEFDIIPSNLIDNVVVSKTSTPDMSFGFGGGLVQISTLAVPDNNFTTFSFGSKYIDGSTGKDFLGYGRGKNDYLGFDDGSRNHFPKELLIFNQRNYEPTKPDAIPAAGEVRITPAMIAEQNRRIGGLERMGTRTYKALPGQNYQFSLGRSYQLAHSRLGFVGSLSYRNEQSNDNISHFGRGVWEKLGNTRYDTETGAEIDPTFANQYNFNTSWGALFNLGWNSKNHKITARNFYSRVFNNQFSRIVGFGNDIGFGKDLPAIREFDRPKFIDLFQTRINGEHTFGDFRFDWNVSRNKLTNLEKDAVEAWLAPTKTLNGSVYNVLPSAFNNPGGGTFNRAQYLYKETNKIAEAALSYGFKVLGQKQTFKSGYQFLRREGTYDWTLLPISTVGQGGIYAFVPVQQWGQFLEFNDPLKDLFYYPASFSQNGYQGRNTNQAVFGMMDTHFANWIRLVWGLRAEYYKYERLKNGVNDLAVTELIRQGEQLRFVDPETGRIVGPYADPENDEKTWRYLPSASLTLSPLKDLNVRAAYSQSVVRPALIENSRMVRQDPAIGAFRRNEGVLSTTIDHYDLRLEWYPKPGEVISVGYFHKYFDKPVELYRTQLDASMRVYVNTQNSEWAKVNGWELDLRKSLGFIKQNWRFLDDIYLSGNLTLQSSEVQASTFEGKSMANDKYEKSYEYRTKLLLKEKRPLYGQVPVLYNLGIQYDGNRLGANVAFNHMGYKTFTTGLTPDIVEYERPRNQLDAQLSYRFLKSKKLHAKLNMSNLMNNPYRFYINSNDTYKLLDKWKGMSMSVISATGVSDWADIYEWKSGFSKKYDDGYYETSEDGKTRTRVGDKDTFTRKVGAAFSMSVSYSF

SEQ ID NO: 11489 - protein, 677 aa, Alcanivorax sp. DG881
MLFNTSAQAQLFNDNKPNVKHIENTPLETMVVTGTRTELAQSQSPIPIEVITGAQLQQVSHGTLASALNFIPGVVTKRNEKDGYTVQMQGFDGDHVLVLLDSQPLISPTGSSVDLDQISVLNIERIEVLRGAASVLYGSSAMGGVINVITRKQNRNSAKFRYQASSYMQNAIDSGDVAGLYQLNVNQMILGWQGSVSAQKIDDPGFDYDQNTLSQSAPSTDKSFVNLGLARDFGEVHLALKTRYFSDEKSKLRYAIPGQVGDISYISDVEQWQHDISVSQSQVWKVQGRYLQHDETSGDSNGLRDAQITLAEIDSQYQWQLSDVALVSGLVLHRDELYQVKQASTAGVAGTVEIDDQSRDSVEAYTQASWQYGDHELVAGLRAQNDSDFGVHSAARVNGLFTLSDDKNDLWQLRVGAGQSYRVPTLKERFYVFDHSNLGYMVLGNEDLDPETALSGNFELSYHGSVQRLFGANRSRDAAGNNSRSDSNKNAHSAYPRLSLRANIHYAKAQDFINTVTDVEASAQTGLLISRYANVDQTYMKGADLSLKLGWQKVDYQLSYSYLHATDGDGVYLAERPTHQIKTNLTWRLPYDINALAYVVYETGEHPSSTQLGIEKDDWLSVNLSVNQHINDHWQWNAGIDNLFDEHQNSDAIAQGLLDVRPLSSQRVFVGVSYQFY

SEQ ID NO: 11490 - protein, 1239 aa, Alcanivorax sp. DG881
MKMNPMKRNRFSSLKLPEILVFASLATASTPLLFAQVSDPDLEEEVYELSPFEVTADENEGYRATSSLAGSRLKTQLKDVASSISVVTEEFLKDTASTDLQDILIYTTNSEVAGIGGNFYGTNADDGGYRNEMLVNPQRGTRLRGLNQADITRNYFTSNIPTNSYNTSRVDIQRGSNSILYGLGSPAGIINGSLKDPYMNEAGGAFEIGFDSYGSHREVIDVSRPLIEDVLAVRFIAMNDESKFRQDHTFNDDRRYYGALRWQPKLADGIFTQFDVRGEFGEIDANRPVSTTAADFASNWWRAEQLYMYEPLSANGAPQEPTGDPDNPYATRDDLRTFFTGAPAGSWWNGWPATIFQDPNSSVVGNGTLDAYRQRDGSPWGGLSGLGGRNWASDKDQVSYYANNPDVSSLISSYESATGQSFEGFGSLWPTQMILDGPLAFIDQTIQGPNKSEYNEFDSLELSLSQTYLGGDLGFNVGYYKETYDHGRMNFIDTNSVTIDVNANLRAGYSNPDAGRPVVYGGNSASDAEDTVSSFRTTAYYKFDPGEASGNDFIGKFFGEQTFTAVYTDEKKTNFGANYNPFVWDAETFNQRYNDSLTYGNTWSARYIGDNLSGYSTFDSIPASAIQGLNVVQEPGDSNHVLTFDYADTNTWVTGTSNILNYRGDKAPLYNWAWEGYDTTESLAFVWQGRLLNDSIIPLFGWREDEYERWDKAAPPRDETYNYYLPFASDWDYEGIEPINAKASRTSWGVVVHANQLLDLFGAEMPKGTEFSVFYNDSTSFRPADVGIDNYGNKLASPSGSTEDYGFRLSLFDNKVELRTTWYETTQQNTTLSDPGMIFWAKAGIVRHVDGLAMETWGSSTERYHQPVPEWLVNDWFLGEGAYDASVMNQPIPADWRDQLSTLVGQPLRIRQGAVSGSDNYVAQGDINPDNGLPYLGPLLTADEKEYRQAWFDARTDAEWFRPLDSEWVASKDFEKITNDYYLWEQNPPAGQKLTNDLVSKGVEFEITANPTDRWRMTLNASKNEATRTNILPDWPAFVDSMAPIWFDGFNNTQEEVDGLNYWTIDGFADVRHWYSDQSYSGYGETTGGRMMNAVYGPYHNFIAGEGQGVNELRKWRFNLVSNYQFAEDGLLKGFNAGGAVRWQDKAAIGYYPEYNEDAGIWVTDVDRPIYGPTEENFDAWVGYERPLNDNIDYRVQLNVRNLFADDAMIPILANPDGSIAQVRIPSKTTWTLSNTFSF

SEQ ID NO: 11491 - protein, 768 aa, Alcanivorax sp. DG881
MSTFPNSPPVEARASCAARRPVRRVWLLAGLAPAVALLSTTALTSTEAQAQAQNATGLSTIVVESSRQKPRPARAGRAARAPVVAPAPIPPVGVELEPGYVATLSADTIASRALGTSDSGALISDIPGGAAWGAGGVSSLPAINGLGADRVQVAINSMLISPACPNEMNPPLSFVNPQMIAKLQAYYGVAPVSVGGDYIGGKIDVTTAPPQFAKGPGWLTNGSVSGFFRSNGNAYGVNATATMANNDTSVTYTGGWAKASNYTAGDGSKVKSTLYEIQNHALSISKQTFGNLFTVQVGGQFIPYQGFVNQRMDLVYNQSAFINGRYEGLFDWGKFDATGFYHQINHTMGFIAPDKVSEMPMDTKARDAGYTLKATIDASPQDVVRVGSELYHNTLRDWWDPVAGSMMMSPNVFVNINDGTRTRLGTFVEWEHRWNREWTTIAGLRNDVVWMNTGPVQGYNMMDYGADAAAFNARDRARTDVNLDGSALLRYEPNLLGSYELGFARKTRSPNLYERYAWSTNSMAMNMNGWFGDGNGYIGNVDLEPEKAHTVSFTAGWHDPAQKVWELKVTPYYSYVQDYIDVKKCATSGMGMMLTVNCNGSSAVANNFVYLKFINQDAQLYGVNIAGKLALWDDLSYGRGVFRGTFGYVRGHRTDGIDLYHIMPINAKLALDHTLGAWTNSVELHLVGSKDFVSQVRNELTTPSYALLNIRTGYQWESVRVEAGIDNLFDKFYYLPLGGVDLVDYNKAWGQNVAGQGRSYNGRLTVTF

SEQ ID NO: 11492 - protein, 1276 aa, Alcanivorax sp. DG881
MKYSLPWLLTSSALVFSLHPLMAANTDLSSSDNYENGSSGSAAFTAKETSDASGTTYTLTSDVSITNVSAITPADKSCFTNTGGALSFVGADHSLVLQTIALTHDGAAINNTNTALSFSGFSSLLIDSAPATGTSGGKGAICVTNTEGGTATFTDNASVTLQKNTSEKDGAAVSAYSIDLAKTTTAALLDQNTSTKNGGALCSTANTTVQGNSGTVTFSSNTATDKGGGIYSKEKDSTLDANTGVVTFKSNTAKTGGAWSSDDNLALTGNTQVLFQENKTTGSAAQANNPEGCGGAICCYLATATDKTGLAISQNQEMSFTSNTTTANGGAIYATKCTLDGNTTLTFDQNTATAGCGGAIYTETEDFSLKGSTGTVTFSTNTAKTGGALYSKGNSSLTGNTNLLFSGNKATGPSNSSANQEGCGGAILSFLESASVSTKKGLWIEDNENVSLSGNTATVSGGAIYATKCALHGNTTLTFDGNTAETAGGAIYTETEDFTLTGSTGTVTFSTNTAKTAGALHTKGNTSFTKNKALVFSGNSATATATTTTDQEGCGGAILCNISESDIATKSLTLTENESLSFINNTAKRSGGGIYAPKCVISGSESINFDGNTAETSGGAIYSKNLSITANGPVSFTNNSGGKGGAIYIADSGELSLEAIDGDITFSGNRATEGTSTPNSIHLGAGAKITKLAAAPGHTIYFYDPITMEAPASGGTIEELVINPVVKAIVPPPQPKNGPIASVPVVPVAPANPNTGTIVFSSGKLPSQDASIPANTTTILNQKINLAGGNVVLKEGATLQVYSFTQQPDSTVFMDAGTTLETTTTNNTDGSIDLKNLSVNLDALDGKRMITIAVNSTSGGLKISGDLKFHNNEGSFYDNPGLKANLNLPFLDLSSTSGTVNLDDFNPIPSSMAAPDYGYQGSWTLVPKVGAGGKVTLVAEWQALGYTPKPELRATLVPNSLWNAYVNIHSIQQEIATAMSDAPSHPGIWIGGIGNAFHQDKQKENAGFRLISRGYIVGGSMTTPQEYTFAVAFSQLFGKSKDYVVSDIKSQVYAGSLCAQSSYVIPLHSSLRRHVLSKVLPELPGETPLVLHGQVSYGRNHHNMTTKLANNTQGKSDWDSHSFAVEVGGSLPVDLNYRYLTSYSPYVKLQVVSVNQKGFQEVAADPRIFDASHLVNVSIPMGLTFKHESAKPPSALLLTLGYAVDAYRDHPHCLTSLTNGTSWSTFATNLSRQAFFAEASGHLKLLHGLDCFASGSCELRSSSRSYNANCGTRYSF

SEQ ID NO: 11493 - protein, 501 aa, Alcanivorax sp. DG881
MNAGKAAWAALGLCTALGIGATSAEAQDAPAPPGRAQVANGAPALVRRPALRRVARRAPRPRPFGNDGSAAAAADVLGQTATPPALSPGTFDLGNGLSLLLNYTGQAAANPIGGIRQGSAYAGQLFFGIDGDLQRLAGIEGGSFHIAVTNRHGRNLADDRIGNNTSVQEIFGGGQTTRLTLLSYQQKLFDNRLDIEVGRLVANINFLNSPIYCNFQTNSACGNPTFVFKTSNFTFWPVASWGGHAKAWLTDRVFFHVGAYEVNPLHQQPGDNGLDFSTKGATGAIVPFELGYSTTFANDELPRNYGIGGWIDRSDYTDPVLDAAGGRRVLTGLSPATRFGRSGVYARFDQMVWRPDPKGIQGLTLFGVAMAGTGGRLVEDYFLEIGALQTGTFAGRPYDTVGFVINTQAFSPLALGNIEAAQASLGLFRAIPRQQIMMELNYGIQVSPAIRLTPNLQYIVNPDQTRFPFYPKNIPDAFVVGAKLSVDLFTLAGLAKGPGSP

SEQ ID NO: 11494 - protein, 946 aa, Alcanivorax sp. DG881
MAVSAAVGAAFAMGMAPVNAQDEQLVEEVVVTGSRIQRANLVSSSPVTQLDAEQLRFTGLTRVEDALAAIPAISLDQSSGQAIEAVGTATLQLRNLGSQRTLVLMNGRRLPAGSPNSASNAADINLIPGQLIERVEVLTGGASSTYGADAVAGVVNFIMIDDFEGIKLDVQAGQFRADNDGGLVAGAAERAGQPFATGTATDGDQYDMTMIMGGNFDNGRGNATAFLTYRDIEGVTQAARDTSACPVRSSGECLGSGTNQSGSWIIGGTNYRTEGNEFLEGRGPGFNFAAPSFFQRPDRRTTMGTFAHYDINENVEAYTELMFMDTKSDTQFGPSGVFFRTFDDLNCDNPLLSAQQLGVAGCTSPDDRFSATLGRRNVEGGPRKGALRHTTYRGVFGLRGDINDSWRYDVSYQYAEVNMTNRNTNYVDLIRVEEALNAVVNDDGTIGCESGNSECVPYNVYQTGGVTDEATAYFSQVVYENGRTTQEVLMGYVQGSLGDYGIASPFAESGIEIVAGAEYREESLTYGLSDNAARGDAGGFGVPVPVDGRYDVNEIYFEASVPVIEDAPLVQALVLDLGFRYSDYSTGNTTDTYKIAASWDINDDIKVRGSYQRAVRAPNIVDLFEPDSAGLFAMDRDPCNKANPGDNLSLSGYTFEQCARSGVSRAIWDQGGPEDSPAAQYNSTGGGSTELEPEEADTYTLGAIWQPSFIEGLQLSVDYYEIEITGAIQGIQEETTLLQCIETGDAAFCDQVNRGQLDTLWLGQASPTNGINAASTNIGFLLVEGVDVEINYNFDIGDMGTVNIANIAGFVLAYDQEEYPGAGVVGCEGTYGGACQIPTPDLKNRFQATWATPWNVNANIIWRHVAGSTQEFTDVPNDIDDFNYFDISATWAVTDTATLRFGINNVLDEDPPFVYQGVTARENGNTYPGIYDPLGQYWFLGGTIQF

SEQ ID NO: 11495 - protein, 717 aa, Alcanivorax sp. DG881
MFLSLNLVIASTFGAVAPSSANYDLDSLLEMPLCSLADTKVVSATRTSQSLADTPASVYVITAKEIKGSGARSVADALSLAPGLHVAKYSNYDWGVTARGNNETLNNKMLVMVDGRSVFNPMSSGVNWDLIPVSMDNIAQIEVVLGPVGTVWGGNAVTGVINVITKEAEGSARGKVSASFGNYDYREYQLHHQGYVDEYTNYSIYGEFVDHMPWTSDEDRVAHIQHFNVYTERFGGRLDFQKHEHTLSVQAGGTRSREDYNWGNYQPHFAMPGADPFDFYATEMTMQEYFAGGHHIFDRSNGDSWENEIWFTYNSNDISHDNAQFFRTDLDSRYTFADFRGTEFTVGANIRLIDEKFGLFDKHDEITMPYLRISDSPHFFNQSYGLYVNWDIPLDERITLTLGSRWQYDNITHHVEPQPQVRLSYELANNQRLWAGWGKAIVTPSRLESSTHLRENHYLESLQFSDGNHYDYYYSYISKGNNDLDVESVSTYEFGYRFWDEQRLQFSISGFYTRHDNIRVYKTESALQTIIIGGSSPGTSGTVVEHYTAQLIDPIWSESFGGEVAAKWQPIDNVQINANYSYKRIVGHCEGPICSRNNAVKRMIENEPHHFANAQVMWDITPQWWLSVSAQYVSESELHNDYESALNPISVVNKDYIWPEVMSFDASLSWQYNHMTEIIASVENLGASQSKEFPNNYNAFANGTQYWLTLDWKYVGW

SEQ ID NO: 11496 - protein, 439 aa, Alcanivorax sp. DG881
MIIMKIFNKTLIAVSVALVSTQTMAAGFQINSQSATGVGRAFAGDAVIADNASVLSRNPAAMALFDEKQLSMGLTYADVQVEVQDVFVNSNLGELHYGNIDDGAEAKVIPNFYYVSPVNDKFAYGVAMFSNFGTGTDTSELSQPKSILGGAAQIPAPADLLGKTEVTTINFNLSASYRINDNLSVGAGLDVIYGSGVLTRSGELPVAPDGSLVPVDLVDVDADGIAFGGIVGAVYEINADHRFGVSYRFSPEFTADGTVNYAGVDFEEINIPLPDIFQVAGFHQLTEKFALHYTAQMTTWGDFHEITVTDPSEAQLKKYAWDDSWLFSVGGTYTLNDSWTLRAGYMFDQGVVGEVSSISIPDSDRQWYTMGATYNLSKHTSLDFGIAFVRGEETQLTEHSSVLDAVGQEMPILGADLGTVHATTTSNATYYSIQYNYKF

SEQ ID NO: 11497 - protein, 380 aa, Alcanivorax sp. DG881
MTVRHGLLAGSFLAATLAFGSVLSVAPAHAQPVQGLYVAGEGGASFNQDQRVRSSPNFPDGRDSYHTGATGIGSIGWGLGNGFRVEVEGDYRNNGLKNFGSAGVPSSHVGGRQQTYGVMANALFDLDIGKSWLFPYFGAGVGYAWQAMNASVTAPNFSQQIGGTFGNFAYQGIFGLAFPVPWVVGLSATAEYRFWTMLGPQSHGARSIGTVGGYDTTRAYGPAAGNRDTMTDFNHSLMLGLRYEFNPAPPPPPPAPEPAAPAPTQSRTYLVFFDWDQAVLTDRARAIVATAAQASTRTQTTRIEVDGYTDNSAAHPGPRGARYNMALSVRRAQAVQAELIRDGVPGTAIDVHGFGETHPLVATGPNTREPQNRRVEIILH

SEQ ID NO: 11498 - protein, 943 aa, Alcanivorax sp. DG881
MPSLAIAGEGSFCAKFESPAVAAHSITGTDQPMNRSLLATTIASCLVLTACGGGGGGGNVRSDAPQTTVIAPTPTTPPPAADPLPKTTPAPTPAPPRYQGVGSNLLVPTNADLAQQAGARGQGVKLAVLDDNLVPSYAPISGKVDSFNDYTASPGTPESSANALRGHGTIVSALVLGSAQDGFAGGVAPDADLFYARICAENSCGTQQTRRAAVDLAAAGVRIANLSIGASYPDAASSANAALAWKYALTPLVQADALIVASTGNEGAAEASYPAATPVQEASVRNNWLAVGAINIDSAGNAAGLTSYSNHCGAAAQWCLVAPGSYTAPALAGTELQGQIAGTSFSTAAVSGVAAQVLGAYPWMSASNLQQTLLTTATDLGDPGVDALYGWGLVNAAKAIKGPGQFASNWAANVTAGYDSTFSNDISGAGSLTKNGAGKLTLSGNNSYTGGTSISDGVLTLSGSLRSDVIVLNSATFESRGGVINGNYSLVNATGTTAVELGRGLTVTGQASLKGNLLLLPEAAGYTVGSTEKIVKAGFLQGTFDRVQYANNFFWTAALSYDPTTVTATLTRNASAASAQAAGAPQSVVNGANQADALVKVLDTRVASGDTDNLGGLISATGSLIAASDAQVAASLPTLTGQVHGIERTLGFQSALNDARVAADRLPYLADTTTLTTWMQGSYLDGNLGRSGFASADYTQQATTFGVDLPMGSGGTIVGAAVTSGQDRAHIAASSSRLRSDRYAMTAYLYQPIGQAYLSAIGSYGMSNVQTERNVQAGSIGERLQDRRHDTNWSARAEIGLMPHAGLSPFVAAGVVSQTQDAFSEASVTGLGLSANSDTLRAGYGEVGVRGHLARGNWGFDGLVAYRSLLGNPNADFSAWFTGLPEARFNVAGEPVSKQSLRASVGLRYQLNDAFSIYGNVGAERARSDTNSINANIGLRWQF

SEQ ID NO: 11499 - protein, 238 aa, Alcanivorax sp. DG881
MICVGSFVTPMWVYSSRFYNHNDGADMKKLTVAALAVATLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 11500 - protein, 705 aa, Alcanivorax sp. DG881
MTSPAQAQPDLPVTTPVAVALDELAVEGLGLGRGVPRLEPQGGVTVGYLGKATRSATKTPTPLLDTPQSVSIVTREQILDQGFQSIGEATRYVPGVIQAQGEGNRDELIIRGQRSNADFFVNGVRDDVQYYRDLYNTQRIEVLKGPNAMIFGRGGGGGVINRVLKEADGVPVREIVAQGGQFANKRVALDVGDRVSDSVFFRMNGVFEDTATYRDFVDIRRYGVNPTMTFLLGPQTTLRLSYEYFHDDRTTDRGLPSQFGRPYRYRENTSTYFGNPFLSPTYVNAHIAMAQLDHVFENGVVMRSQSRIADYEKFYQNVFPGGAVNAAGTAVNISAYNSQTDRTNYFNQTDFTYQFLTGPLKHTLLGGFELGYQEGLSLRQDGFFATTGTQTLVVNPLAPLTRVGVNFRNIASGANSTYDLGLAAAYVQDQIELNEYVQFIGGLRYDHFDFAATDRRTNITNARVDDLISPRAGVVVKPLPNLAFYTSYSVSYLPSSGDQFSALTPGLVIAQPEKFENTEVGVKYDVSPVLQVTGALFNLDRTNQRIADPNRPGFFLTSGQTNTQGAEIGANGYVTDWWSIAGGYAFTDARITNRLSDTIVAGNFVGLVPLNSFTLWNKFDIDPSFSVGVGFINQSHSFATSDNTVRLPSYSRFDLGLFYRISENARAQVNIENLFDRSYIVSAHNNNNILPGAPRTVRAQIIVRW

SEQ ID NO: 11501 - protein, 981 aa, Alcanivorax sp. DG881
MRLGLLPAGIAIALTPAFAANAQEQSAPSTTTLDRIAITGSRIRSVDVETAQPVFTVTQQDIQKSGLVSVGDILQNLSIAGTQTYSKAAVLSSAPEQGGQYVNLYNLNENRTLLLVNGKRWTSSLAGLSDMSTIPSSLIERIEVLKDGASAIYGSDAVAGVVNIILRKNYDGAEASAYFGQNGRGDGSKAQYSFTAGTTTDRASLVFGVNYTNEDPVWAKARPLTRYSSGPNHIEDSLSATGPWGRFNDPRAVGTPGAGNYRDTDGKVVGAADGTWRPNQWVLNHTGSFDGKGTGADSRSLSNYHIGAGVDDYYNSVDQMMLQQSSKNKSVFTTGSYNLTDSLTFKSTAMYSERDSNRQIAGYPLQAASQPQFPVAISGSSYYNPMGQDINRWFRRTVELPRTTENNVKTLHFDAALEGVFDVGSHGWNWDVGFNYNKYDVTQVLRGNINLLALQKALGPSFLNAQGQVQCGTAASPLPLGTSNALGQCTPFNILGGPSASTPNALQYINALGQATQQSLSKQWTANLTGGLFHLPAGELGFAAGVEHRQVSGYDYPDQLSSAGYTTDLAAQATEGRYQTNEAYLELLIPVLKDLPGVKELSFDVAARYSNYSRFGDTTNSKFSFTWKPIDDLLVRGTYGTGFRAPTLSDTFGGGSQTFDNFTDPCDATFGSLGNAGVAARCATQVPAGFRQTDSAGKPVARRDVQGNAPFNSGVGNAELQPEYSITRTVGMVYSPHWVQGLDFSLDWYRISISNIITPLSANDVLNNCYLNNLENYCANFARDSVTGQVTTLSRGNVNLGRLETEGYNFGVRYRMPETAYGKFAVKLDTNYLATYKSQTQADADWANYAGYWNFPRVRATLGLDWSLGSLSANWDLRYYGGFRDYCLDASAGIACNDPSYRTPNPGWGGGTGSNKKGSISYQDVSVTWQAPWDGSVTVGARNIWNKQPPITYSITNSSTAAIDPMLDYDRFLFVQYNQRF

SEQ ID NO: 11502 - protein, 191 aa, Alcanivorax sp. DG881
MQRLFPALWMALFIIAFPLRAEPTVYGEQRISRWWDAMTDDISQTWEQPERYDLYLPFLSWHARFMYDKEKTDKYNEMPWGGGLGISRYNEEGNWSALFAMMFKDSHNEWQPAMGYGWEKGWYLDNAKDFRLGLGAAAGITARDDFANYVPLPFIFPLFSAGYKRATVQFTYIPGTYNNGNVLFAWLRLGF

SEQ ID NO: 11503 - protein, 778 aa, Alcanivorax sp. DG881
MHAKHRTFVTASALTIAIAAFAPLVQAQEETPDDDNRRLGTITVTAQRVEQNIQQVPISVTAIGGDALEARQIDGFDQLQYVAPGVTFNSGVNARQSATTIRGIGTGLFNIGIEGSVAIAVDGVIMGREGAGIFDFADVERVEVLRGPQGTLFGKNASAGVISVVTKKPTEGFTAEMNLGYGSYDEVNAYGAISGPIVDGVTARLSAYSNTRDGYIKNVNPNSPQGRVNERNEQGVRGKVNFALSDTSDLLLSADYVTRDQAAGALTYRQASAGGPGTGLLGFGVPAIRNQSAALGIVPGPDNLSIGSEVPFSSEMDAWGLSAEYSRSLGNFEFVSLTSHREWNSVDNNDSDLTPLPILEINSGDLGQNQFSQEFRLVSPRDKAFTYTLGAYYFTQDIDQNNIQAGTAGLNLLGALPAGARVGTRLESEFSETNYAVFGQGEYAVTDKLSLIGGLRVLNSEVEGSQEKFAAAGAVAPFAGQVVSNGVQSASDEDTALVWRLGAQYFVNDDTNLFATVTRGYKSAGIVQGLTINPVSGTTLPTVEAEIPTQFEAGIRRSSVDRRLVTNFTGFYGQIEDFQAQTLVPGPSGTSIFTVANAGKAETYGFESEITALPTENLTLSAAIAYTNATFDEFTGAPCYQLQTPAQGCSGTPASQDLSGKRLPNSPEWVVNALARYDFDLTAQNAAFVQLGAQYRSDTMSGLANDPNTVIDAYTLLDMQVGVNFWDDRATFTVFGRNLTDENFAEAIVAMPFDTGGYAQFVTLEAQRTWGAKLSLRY

SEQ ID NO: 11504 - protein, 839 aa, Alcanivorax sp. DG881
MAIFRKKFDFEVSVYSRSSCLVALGLALPAVTFAVEFNAEFLNNEGGAPVELKYFENGNSVSPGTYSVDIHLNQIMIRREDVVFSADSETGSVRPVIRVGLLKEIGVDIARLTRDKLIPANLENNTPLNVAELIPGASVEFDVNSLSLLVSIPQLYVQRHSRGYVDPSLWDDGVTALFSNYQANFTRNTNFGQNSDYRYLGLRNGFNLFGWRLRNDSSLSGGTGMRNKFSSNRTYVERDIRALKGTLSLGELYTSAQGDAFESVRMRGVQLQSDIGMLPDNEISYTPVVRGIAETNATVEVSQNGFVIYSTNVPPGAFEITDIYPSGSNGDLEVKIIEADGRQRSFKQSYSYLPVMTRKGNLRYGLAAGEYHNDGQPSVNLLQGSAVYGLSDRVTGFGGLLAAEKYNATNLGLGFNTPLGGLSADVTHSQSRTRRGGRNQGQSLRLLYSKTINATETSFTVVGYRYSTEGYRTLSQHIDDMSDESYLYGSSSSRQKSRIDLTVNQTLFRRSSLYLTAGETTYWNRPGSSRRVQFGFSSGIKRASYSLAVSRTQETGSFGRSDTQFTASVSIPLGGSARSSQVYANAVSSQHGDSSLNTGISGYLDEANAFNYSAQANYSKDGGNSGSVGLGWDTSKAKLSANYSQGRDNKQINLGASGSVVVHPGGVTFGQPVGETFGLVEVPEVGGVGLDGYSSVRTDGRGYAVLPYMQPYRYNWVNLDTNTLGSDTEISDSTQMAVPTRGAVIAKRFSAESGRRVQFDLSMDSGGKIPFGAQAYDKEERVVGMVDNLSRLLVFGIEDQGRLSIRWSDGSCSVDYQLPPRNKDLTYERVALSCRRSSI

SEQ ID NO: 11505 - protein, 727 aa, Alcanivorax sp. DG881
MVCMFKFKRLSPALFLGLSVGVRLFAQDGAGDVMNTVELKPHVVTASPFVTDVDELVVPASELAGGELDRRAVSNLGATLDGEPGVHSTYFGPGAGRPVIRGFDGDRVRILNQGTDSHDVSQTSPDHAVSIEPLFADDIEVVRGPASLLYGNAAIGGVVNVISKEMPRERALRSFSGEFEASYGSVADEKVGGIALQGGRGDFAWSFGYLERSSGDIEIPGFAESIYQMEAKEHEHEDEEEEHDEDHEEHEEEDAALGVLENSFVDTRSGYLGMTWFGDAGSLGFSYSKYETDYGVPGHSHAHEHEEHDDEHHEEDEHDDEDHGEEGVAVDLDQTRFALRGELISPIDLFESVELDFSYGDYRHAEIEGDVVGTVFDRDGYELRLTAVHSPIRDFNGAFGLKVKDESFSAVGEEAFIPSNDTSQYGLFAVERLNRDWGAWEFGGRIENVDVDPVGSSISGKSFTTGNASAGLVRKMGEGAVFASNLTYAERAPNASELFAFGPHIGTQSFEIGDSSLGVESSVNLDLSYRLTAGRLTGEFTVFYSDFSDYIYMRFLDHESVGELYGELDTDDLNVFKATPADAQFYGFEIDLRYHIIDGVDRAMHVDLLVDQTRATNERFDTNMPRIPTRRIGGRYEYTIGPWLMGFEGRYTEAASHLAPNELPTDSYFLWGADLQYRIQTTDTMTIDLFAIGSNLGDDEARPHTSYLKDLAPMPGRSVKLGVRTRF

SEQ ID NO: 11506 - protein, 830 aa, Alcanivorax sp. DG881
MPAGFFEFKPLVKALCMSRSISARSSRALLGKGVLGAALMLPMAAQVWAQGVNFDIAAQSLPNALRALGEQADVQFIYNASEMADLRGNEVRGSYTVDAAVAKLLRGLPVSYSLEGDTLTLVRRERPASSALELGTTSITGNTLGVTTEGSNSYTTGGVTIGKSEHKLKDIPQSVSVMTRKRMDDQNITDLPTLLANAPGMTFAKSPGTGGFITSRGFEIDSLQYDGVPMTRGIYALGSYLTEPTAFYDRVELLRGGAALLQGANSPGGAINFVRKRGQAKPTVTLTAQAGSWDHYATQVDVGGPLNEAGNIRGRAVVDYDTRNSFIDYVGGWEQKVYGALDFDLSEDTTLGVGISDRKTRFTPMVAGLPRFSDGRDVGLSRSTFTGSDWNRGMTEQLALYVDLEHRFNDHWKFKTAAVAINERNEMTYAYVVAPTGLANDGSGLFDWRYATDFNSHSRGLDMFVDGDFNGFGFDQEVVFGGNYSRFTSDNTMAVVRSAGANIFDLDNHLPFENYDSLAARGTRTDSQYKIVQKGIYGTWRVKLTDPLTLILGGRTSWYSYDYDSQVYQAGVHQYDSPASKANNGVVTPYAGLVYELTPQWSAYASYADVFIPQSAIGVGGSTIEPITGSNYELGLKGELNDGQVNTSVALFRYDHENRAVPILNTESLCGGSNCAAASGKVRSQGLEAEINGEVLPGLQASASYVYNTTKYLKDNTNEGKIFSTWTPKHSVKVWTDYTLPGDFSRFSVGGGFNSQSSTVAYDRKFDSPGFTIWNARLGYKVSDEVSLAVNFNNIFDKVYYIPSYAAVSANNYYGDPRNFMFSVKYTPQF

SEQ ID NO: 11507 - protein, 857 aa, Alcanivorax sp. DG881
MMEKYIKPNHLLRSRAAVSRSNMKLSCLAMAVFGAISGQVFAEEAQAPEEAKEQKASAFEVIEVTAQKRVQRMQDVGIAISAFKADELEDLGAYQASALAEFIPNMEVAVSDDSGIPIFVIRGVGLQDYNTNNTPNTAVVVDDVYQPYGIYSAFAMFDTDRVEVLKGPQGGLYGRNSTGGAISFSSKRPELETTEANVAVDYGNYNSLNIRAGASLPLGEVAAVRLAVQSETSDGYYYNTYLNRDQGGKDKQQARFTLHYEPADYFAADLRYTYGRDTSEASIPEVTGLLDSNAYWEGPLAGFPGLPSMNIPYNQDGTPAYCDAVLQTGIPDASCINMNRASADGDPYSGADARVHPNDDTYHSVSLNMNWDFSDYSLISITNYTQMQFKHRNGVGSVGLGPGQDQEAWEQASRDYGRLNGGDLNEMYVTQYDSDTSSWSQELRLLSNYGGDFNWMVGLVYAEDNLDDLRNCSFAANVYADWKQFPGCGTMAYTQDTEVISGYAQLTYAISDTLSTTVDLRYTQEKKDYVGDVFVNDGTWICTANGLNTTDPDSPTYCANFIGWDPVTGRYDLARGNKSHYDESDPSWKVNLDWKVTPDTLLYASVGSSFKSGGFFGGFLTNPNAIRPYKPERNNGVELGFKSTLEDYRVQINGAAFYYDYRDFQSAIQEVDQSTGGVFNGLRNLGDVIMQGAELDLRWMATEDFEIRAAIGLLDTEVDKVTKFESADVGITNIFGEVIDIQGNELNNAPKFSGNLIARYHYQLSAELEGFIQLDASFKDDYWLSVSNEPIYREKGYTLVNMRAEIFSPADNWSVAVWGRNLTDKTYRNSFYLDGLDSGYSEYNAPRTFGVSLSYNY

SEQ ID NO: 11508 - protein, 973 aa, Alcanivorax sp. DG881
MVLATSAILAWPQMALAQDSTTDEAEPQGSVIIVTAQRQSQSLQEVPIAVSAFDATALESQQIENAADLQLTLPNVSFSKGNFTGSSFTIRGIGDLCVGVTCDAATAIHINGSPLFGTRLFETEYFDLERIEVLRGPQGTLFGRNATSGVVNLVTAKPDLGSFGAAGEFEYGNYNSIKAEGMVNVPIGDSIGVRVAGFFLNRDGYTTNLFDNSDVDDRDMYAVRGSLRFEPGADTTLDFMAYYFREDDTRLRNQKQACQRDPLGVLGCLNNRRDFDITNANSTVGATLSSQEFFAIQGIPSVLGLGSLYGPDAFAGFDKPDDVRTVNTAYTPFYFADEVQLQARLEQRIGAMTLTATGLYQDTEVDSRQDYFLGIQDRTGFATALNVLSGFAANGLPTGLPAPAPAFVPGSSAYFTPIVEALIPNGPGGVLCTSDNDDGNRGAFEGNVLCGETPLSFDRSSEQRESWSGEILLSSDFDGAFNFLLGGIYAKSKTTDNSYYVNSFALDYASAILGSFGTLAGGAPPSYFATSMYRNNSLEANLESFGVFGEIYVDLTERLTFTGGLRYNDDKKDVTARTTLISFLNPYANDGEPFDSPITPLTGPSGLFDADPGTPGEQLTQFREVGFDEITGRAVLDYEVTPDNSIYASYARGYKSGGINPPLSPVFDVAESFGSETIDAFEIGSKNTFANGALQLNATAFYYKYSGLQLSRIVARTSVNDTIDADIWGVELESVIRPDPDWLVNLTFSYLNAEVAGDQFFSNPRDPGGGDPDAVIIKDISNGANCAVTGPAPGVADAFVAGVNAALGLRGPEEFPNDGNLASSGAFSICDVLAGAVPAGSGLAVLSPGVEVNIKGNKLPQAPEMKVSMGVQYTATFDNGMTLVPRVDVALTGEQYGNIFNGRVNRIEPFVQANAIVQLNSADERWFVRGFVQNIFDSSSVTGLYLTDASSGNFTNIYTLDPRRYGVALGFSF

SEQ ID NO: 11509 - protein, 249 aa, Alcanivorax sp. DG881
MKVHRIVFLTVLTFFLTACDVDLYRSLPEDEANQMLALLMQHHIDAEKKQEEDGVTLRVEQSQFINAVELLRLNGYPHRQFTTADKMFPANQLVVSPQEEQQKINFLKEQRIEGMLSQMEGVINAKVTIALPTYDEGSNASPSSVAVFIKYSPQVNMEAFRVKIKDLIEMSIPGLQYSKISILMQPAEFRMVADVPARQTFWIMDVINANKGKVVKWLMKYPYPLMLSLTGLLLGVGILIGYFCLRRRF

SEQ ID NO: 11510 - protein, 219 aa, Wolbachia endosymbiont of Odontosema anastrephae
PETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWAE

SEQ ID NO: 11511 - protein, 633 aa, Acinetobacter genomosp. 3
MLKAPFLRTSLATLVFACSQAIAAPSPYSSLIVFGDSLSDAGQFPDLTGGTAGMRFTNRDANGNYAPVSPMILGGRLGLSDGSLGPSTSLTNQLRGIPDGNNWAVGGYTTQQILDSITTTSKAVIPPGQPGSGTVLRQRPGYLANGLGADPNALYYLTGGGNDFLQGLVTSPATAAAAGARLAASAEALQQAGARYIMVWLLPDLGQTPSFSGTPQQGPLSQLSSVFNQSLVSQLAGIDAEIIPLNIPVLLQEALASPAQFGLATGQNLVGTCYSGGNCVGNPVYGANGTTPDPTKLLFNDSVHPTIAGQQLIADYGYSILAAPWELTLLPEIAHASVRAHQDELRNQWQTPWQAVGQWQAFVATGAQDLDFGSQRSAASGDGRGYNLTLGGSYRLDDAWRLGLAAGVYRQKLEVGQQDSDYKLDSYLASAFAQYRQGRWWADAALTAGHLDYRDLKRTFALGVNDRSEKGDTDGEAWAVTGRLGYNLAAEGSDWQLAPFVSADYARVKVDGYDEKSGRSTALGFDDQERTSRRLGVGMLGSVQVLQGTKLFAEVAREHEFEDDQQDLSMHLTTLPANDFTLTGYTPHSNLTRASLGVTHELAPGVNLRGNYNWRKSDELRQQGVSLAVSVDF

SEQ ID NO: 11512 - protein, 439 aa, Acinetobacter genomosp. 13TU
MLKAQKLTLAVLISAAIISSAQASEQSEAKGFVEDANGSILFRTGYLTRDKKQGAKDTSSFAQSAIVNLESGFTPGIVGFGVGVVGDGSFKIGENNNAGNQMIPKHNDGSAYDHWGRGGGSVKARFSNTTVRYGTQVLDLPVLASNTGRMVPEYFTGTLLTSHEIKNLELVAGKFTKDQMSDQINTDADASGRGLDRAIVWGGKYKFNDNLNASYYGLDSKNALERHYANVNFKQPLTNDSSLTYDFSGYHTKFDANAHTYSATGAVAPNYGNTGVAGEEKTNNIWAISGTYATGPHSVMLAYQQNTGNVGYDYGQNADGFQSIYLPNSYMSDFIGNHEKSAQIQYNVDFGKLGVLPGLNWTTAFVYGWDIKVRNVTDDAQEREFFNQVKYTVQSGFAKDASLRIRNSYYRASDAYQSNAYIGDTNEWRIFLDIPVKLF

SEQ ID NO: 11513 - protein, 439 aa, Acinetobacter genomosp. 13TU
MLKAQKLTLAVLIFAAIISSAQASEQSEAKGFVEDANGSILFRTGYLTRDKKQGAKDTSSVAQSAIVNLESGFTPGIVGFGVGVVGDGSFKIGENKNAGNQMIPKNNDGSAYDHWGRGGGSVKARFSNTTVRYGTQVLDLPVLASNTGRMVPEYFTGTLLTSHEIKNLELVAGKFTKDQMSDQINTDADASGRGLDRAIVWGGKYKFNDNLNASYYGLDSKNALERHYANVNFKQPLTNGSSLTYDFSGYHTKFDANAHTYSATGTVAPNYGATGVAGEEKTNNIWAFSTTYNTGPHSVMLAYQQNTGNVGYDYGQNADGFQSIYLPNSYMSDFIGNHEKSAQIQYNVDFGKLGVLPGLNWTTAFVYGWDIKVRNVTDDAQEREFFNQVKYTVQSGFAKDASLRIRNSYYRASDAYQSNAYIGDTNEWRIFLDIPVKLF

SEQ ID NO: 11514 - protein, 424 aa, Acinetobacter genomosp. 13TU
MLKAQKLTLAVLISAAIISSAQASEQSEAKGFVEDANGSILFRTGYISRDKKDGRADNSSFAQTAIVNIDSGFTPGIVGFGVGVVGDGSFKIGENKNAGNNMIPQHNDGSAYDHWARGGANVKARFSNTTVRYGTQVLDLPVLASNTARLVPEYFTGTLLTSHEIKDLEVVAGKFTKNQYSDQIATDQNGLDRAVVWGAKYKFDDQISGSYYGVDVKDKLDRHYVNVNYKQPLANDSSLTYDFSGYHTKFDKGANLSYATGPADEDKTNNIWAISGTYATGPHSVMLAYQQNSGNIGYNYGVNQDGGQSVYLPNSYLSDFIGNDEKSAQIQYSLDFGKLGVLPGLNWTTAYVYGWDIKTSNGADDSNESEFFNQVKYTVQSGFAKGSSLRLRNSIYRADNAYTTDYMPDTNEWRIFLDIPVTLF

SEQ ID NO: 11515 - protein, 471 aa, Rickettsia sp. 1A
GGDVDYTSLDIVRTEDSLEIETVTQEFRLTSTAGESFDWMVGGFIFQEDIETDGSTFFGNDFRAYGDVLFGAFPNILSTVELLSGLPAGAILSSDNVASTAFEQDNFAYSLFATGDYHFTDKLTATLGVSYTYDEKEVVKDSYRNNDLYSAVDLVPVLGATPLAGLIPSLQGLQFRPPVIDYPNSVENGESDDDKVTWTARVTYQVNDMVNVYASAATGYKSSSWNIGGASRPFPASEAALDAAGLLVANQSFGTRFASPEEAMVYELGLKASFEQGAFNIAIFDQTIEDFQQNAFDGDSFVLTNAGERSTRGIEFDALYSPTDAWLFNLAGTFMDPKYDSYTGASGIGGAPIDLSGEEPAGIHKENVTASATYRFTVGDGITGYVRTDYIYESDVRAAWNVPEEFSREVSTWNASAGLQFTNGVNVQVWGRNINDDEYYVGVFQGVVQSGTYNAFASAPATYGVNVSYEF

SEQ ID NO: 11516 - protein, 1038 aa, Rickettsia sp. 2A
GGGNVIHYQFKGAIVNGNNAILNVNTGSLTAYHPTIGTVARINIGANNLFAIDVSAGDVTILDGQAIAFGNADSVLALSNLTGVGVKNVLLAANLAAPGANEGRLIFNGGANGLNIGSNAAGTARKMGDRGGDKFNYLLINNVVTITDDVNLDGIRNVIVNDNADFTSNTAVNADTIQINDGIYRVDASGGNVAIPAANIEFAHANAQLVLQNSSNADDRTITLCANIDPNNDDEGIVILNSVNAGKKLTIAGGVTLGGPHRLQAIKFQGVGDFGTAGITFNTANIELDTTGATELGAILGNVILINNNVQLTQTGNIGGFLDFNATNGTVTLNNGVNIAGAVQNTGGTNNGTLIALGASNLGSVNGLTMLKVGAGAVSITQGGNTSITEIQGNGTALLTLPANFNLTGSINKTGGQALKLNFTNGGSVSGVVGTAANSVGDITTAGTTNFASSVNAKGAATLGGTTSFADTFTNTGAVTLAKASITNFAKNVTATSFAANNATINFGNSLAFNSNITGSGTTLTLGASQVTYTGTGGFTDTLTLNTTFDGAAKSGGNILIKSCSTLDLSGVSTLALVVTATNFDINNISPDTKYTVISAEAAGGLKPTPAGNVKVTVNNDNRFVNFTFDESTLTLFAKDVSQEVIDNDFKLGGPLANIPNAANIKKSLELMEQAPIGSDARLVFGNWGKLTPIQEADAVTHLMQDVVKPSDTIAAINNQVILSNISSSLINLNARMDVIQPAAVAAGDKDRDAKFGAWISPFVGNATQKMRNNISGYKSDTTGGTIGFDGLVNDDLALGLAYTRADTDIKLKNNKTGYKNKVESNIYSVYGLYNVPYENLFVEAIASYSDNRIKSKSRRVIATVLETVGYQTASSKYKSESYTGQLMAGYTYMMPENINLTPLAGLRYSVIKDKGYKETGTTNQNLTVKGKNYNTFDGLLGAKVSSNINVGEVVLTPELYAMVGYAFKNKVPVIDARLQGMTAPFPTNSFKRSKTSFDVGVGVTAQHKMMEYGINYDTNIGSKYFAQQGSVKVRVNF

SEQ ID NO: 11517 - protein, 1038 aa, Rickettsia sp. p1A
GGGNVIHYQFKGAIVNGNNAILNVNTGSLTAYHPTIGTVARINIGANNLFAIDASAGDVTILDGQAIAFGNADSVLALSNLTGVGVKNVLLAANLAAPGANEGRLIFNGGANGLNIGSNAAGTARKMGDRGGDKFNYLLINNVVTITDDVNLDGIRNVIVNDNADFTSNTAVNADTIQINDGIYRVDASGGNVAIPAANIEFAHANAQLVLQNSSNADDRTITLCANIDPNNDDEGIVILNSVNAGKKLTIAGGVTLGGPHRLQAIKFQGVGDFGTAGITFNTANIELDTTGATELGAILGNVILINNNVQLTQTGNIGGFLDFNATNGTVTLNNGVNIAGAVQNTGGTNNGTLIALGASNLGSVNGLTMLKVGAGAVSITQGGNTSITEIQGNGTALLTLPANFNLTGSINKTGGQALKLNFTNGGSVSGVVGTAANSVGDITTAGTTNFASSVNAKGAATLGGTTSFADTFTNTGAVTLAKASITNFAKNVTATSFAANNATINFGNSLAFNSNITGSGTTLTLGASQVTYTGTGSFTDTLTLNTTFDGAAKSGGNILIKSCSTLDLSGVSTLALVVTATNFDINNISPDTKYTVISAEAAGGLKPTPAGNVKVTVNNDNRFVNFTFDESTLTLFAKDVSQEVIDNDFKLGGPLANIPNAANIKKSLELMEQAPIGSDARLVFGNWGKLTPIQEADAVTHLMQDVVKPSDTIAAINNQVILSNISSSLINLNARMDVIQPAAVAAGDKDRDAKFGAWISPFVGNATQKMRNNISGYKSDTTGGTIGFDGLVNDDLALGLAYTRADTDIKLKNNKTGYKNKVESNIYSVYGLYNVPYENLFVEAIASYSDNRIKSKSRRVIATVLETVGYQTASSKYKSESYTGQLMAGYTYMMPENINLTPLAGLRYSVIKDKGYKETGTTNQNLTVKGKNYNTFDGLLGAKVSSNINVGEVVLTPELYAMVGYAFKNKVPVIDARLQGMTAPFPTNSFKRSKTSFDVGVGVTAQHKMMEYGINYDTNIGSKYFAQQGSVKVRVNF

SEQ ID NO: 11518 - protein, 244 aa, Wolbachia endosymbiont of Pityogenes chalcographus
CACSLLISGSSFAYSGNNDASDVSGVMNGSFYVSGSYSPSFPSISSFDISESDRGGSYVKGYNKNLSTLNVSDPASFTQHEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYRLTPEISLIAGGFYHGIFDEQYAGIPASNRVNIAGGA

SEQ ID NO: 11519 - protein, 117 aa, Wolbachia endosymbiont of Pityogenes chalcographus
CGGAFGYKMDDIRVDVEGVYSQLSKNNVTGATFNPDTVADSLTAISGLVNVYYDIAIEDMPITPYIGVGVGAAYISTPLKKAVNDQKSKFGFAGQVKAGVSYDVTPEIKLYAGARYF

SEQ ID NO: 11520 - protein, 255 aa, Salmonella paratyphi A
MGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDGKDLVKYADVGATYYFNKNMSTYVDYKINLLDEDDSFYAANGISTDDIVALGLVYQF

SEQ ID NO: 11521 - protein, 312 aa, Salmonella paratyphi A
MKKHAIAVMMIAVFSESVYAESTLFIPDVSPESVTTSLSVGVLNGKSRELVYDTDTGRKLSQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGNTAYFGGDAAGIANNNYTVTAGLQYRF

SEQ ID NO: 11522 - protein, 350 aa, Salmonella paratyphi A
MKKTAIAIAVALAGFATVAQAAPKDNTWYAGAKLGWSQYHDTGFIHNDGPTHENQLGAGAFGGYQVNPYVGFEMGYDWLGRMPYKGDNTNGAYKAQGVQLTAKLGYPITDDLDVYTRLGGMVWRADTKSNVPGGASTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 11523 - protein, 751 aa, Salmonella paratyphi A
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGIRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGVTWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 11524 - protein, 656 aa, Salmonella paratyphi A
MTQKRTLLKYGILSLALAAPLSACAFDSLTVIGDSLSDTGNNGRWTWDSGQNKLYDEQLAERYGLELSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHFLSAKFSNIQRSITLGALRRVEEGETNGRLWGARLTSGYDFVMVPWLTTGPMLQYAWDYSHVNGYSEKLNTSTSMRFGDQNAHSQVGSAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 11525 - protein, 377 aa, Salmonella paratyphi A
MTIKITALAASIGAAVAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGTTDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11526 - protein, 400 aa, Salmonella paratyphi A
MKKTLLAVCFVAAFPAFVHAQSAVTLYGIIDEGVSYTSNAATPNSNGSVSGHSAVRLLSGVMQQSRWGLRGSEDLGGGMKAIFMLENGFDASTGKFGQGGLLFGKKAWVGLSGAFGTVTLGRQYDTNVDILGPFEVGDQWGGYMAAHPGDLDNINNTNSTNNSIKFTSNTYGGLTLEALYSLGGVAGNFSRNRIWSVSAGYVNGPLALGVGYLDVANPNTSFFGSMGSPAATANGVPGSNMLSPVYSGYASAKSMHVIGAGASYLFGAATFGATYSNTSFRDLGDLSSGPNPAGLSGNATLNNAEVNFKYQITSDLLCGFAYDYTKGSSVKGMTGASYHQFASGIDYFVSKRTDVYLVGVYQKASGTDSTGKQAVAAINGPSASADDKQAVVRIGMRHKF

SEQ ID NO: 11527 - protein, 992 aa, Salmonella paratyphi A
MHSWKKKLVVSQLALACTLAITSQANATTYNTFGYHDDADTAFSWSDWENADNLNYITYNGYIYNNTTDGAYDQTFNGDVVNGVISTYYLNNDYADNTANTLNIYNSTIHGMITSKQVYDHDNYGWTNGTDVDYRWNDGDTFNLNIADSTIDDDYEYFYFTDSYLDADGKRTSEDMRTADYAYLGTAVTLDVESNINITDNSRVAGITLSQGNTYNGDYATGGDSAYAHTWDNTITVDNSTVTSGAFTPLEGSGWYGNSEEPSDYSGNAVYDATTGTWYHNPNDTALSFSDDPDSYYSMKNNVTFTNGSTLMGDVVFTSNFNNAGDANADSNGDGVISASDGFSPIGYDTNNDGVEDTNGGWSHDNNNVDELNLKLDNGSKWVGDAYFSYEYIAPADMYDLEDGTNSLEPSSTVDKWGNVVDDKTFQSGIFTVALDNGSEWDTVNTSNVDTLTVNNGSQVNVADSSSLIADTITLTNGSTMNLSSYGEVDTDHLTVDSYSKVDLTNETAYLYANTITVSNGGEFSIGAGEFDADSFGTDTLELTNAGVFNINNSDYVLDADLVNGHTNTTDTSNATYGYGVIAMTSDGHLTVNGNGDYYNGDNTADTTYSANGEADNSYTDNVVAATGNYKVRIDNATGAGSVADYKGNELIRVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 11528 - protein, 1063 aa, Salmonella paratyphi A
MFATSLETYENQSVAAVQQARKITGTLTDAVGEPIIGATVLEKGNPSNGTITDINGKFSLSVHPNAVISISYIGYITQNIKITNQTSLKVVMMDDTQALEEVVVVGYGSQKKANLTGAVSSVKMDEVLGDRPILNASDALQGAVPGLFVSNGGNAPGTSKSFQIRGAYSVGVKNSDGSYGNTIKPLVLIDNVEGDLDMVNPEDIESISVLKDAASAAIYGARAAGGVIVVTTKRPKGAAKFSLNYNNNFAFGTAVNLPKQAPLMDYLQAYLDCGYSDAYWSLGSPSVSKWMEYLSEYQKNPSAFNTVGDGIYMDESGVPYYLNEKDLYKNFMETSFQMTHNISASGGTDKLRYRISGGYTSNDGVLVSDRDKFERMNINTFISADVTNWFTQEVTMSYAHSLQTSPGGMGGVYNTRLVSYYPEGDLPASVNTLANEDLPLFTPRNQILLSNPVNNNNDNPRIFLKSILKPLKGLEAVFEYTFDKNIYDYHWYTGQYDYTTIQGGSSKSFVDDYLRKYKQHTNYNAINVYATYSKKFGDHNFKVMAGFNQESSYQETLDAYSYNQAVIDVPAMGSGTGTIKATDSYSEYAVRGGFFRVNYNYQDKYLLEVNGRYDGSSKFPKSSRFGFFPSVSAGWQIAQEKFMESTRNWLDGLKIRASYGVIGNQNVNPYTFTPTMSVSNKSTSWIIDNTYVTSISSLPALVSQNFTWEKVGTVNVGLDINLFNNRLNGVFEWYQRNTNGMLAPGVQLPAVVGASAPYQNTADMRTRGWELSLNWRDQIGKVGYRLGFNLSDYKSKITKYDDNATTKLLSSFYPGQVMGEIWGYIADGYYSVDDFEDTSSWKLKEGITSINGYNVRPGDVKFKNLRDDESSTNVITSGDNTFDNPGDRKVIGNTTPRYQYGINLGANYAGFDLNVILQGTGKRDYWISNVLTFPMNGDNFIPLFDGLSDYWMPKDPDNGDWTAVNPNAKYPRLYGNRGNSGSNLRQSDKYLSDASYLRIKNITLSYNLPKKWLSQIFLSQMKAFVSVENVATFTSLPSGIDPERIEWNYPAFRTVSFGINITL

SEQ ID NO: 11529 - protein, 350 aa, Salmonella paratyphi A
MNKSTLAIVVSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFGIVDGLDLTLQYQGKNEDRDVKKQNGDGFGTAVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDNIVAIGLTYQF

SEQ ID NO: 11530 - protein, 322 aa, Salmonella paratyphi A
MRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTADEHLYGNGDRATVYTGGLKYDANNIYLAAQYSQTYNATRFGTSNGNNKSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 11531 - protein, 663 aa, Salmonella paratyphi A
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 11532 - protein, 138 aa, Salmonella paratyphi A
MRVKHAVVLLMLISPLSWAGTMTFQFRNPNFGGNPNNGAFLLNSAQAQNSYKDPSYNDDFGIETPSALDNFTQAIQSQILGGLLSNINTGKPGRMVTNDYIVDIANRDGQLQLNVTDRKTGQTSTIQVSGLQNNSTDF

SEQ ID NO: 11533 - protein, 394 aa, Salmonella paratyphi A
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNENGGAGAGEGTGNGGNRKLARENGDGFGMSTSYDFDFGLSLGAAYSSSDRSDNQVARGYGDGMNERNNYAGGETAEAWTIGAKYDAYNVYLAAMYAETRNMTYYGGGNGEGNGSIANKTQNFEVVAQYQFDFGLRPSIAYLQSKGKDLGGQEVHRGNWRYTDKDLVKYVDVGMTYYFNKNMSTYVDYKINLLDEDDDFYANNGIATDDIVGVGLVYQF

SEQ ID NO: 11534 - protein, 239 aa, Salmonella paratyphi A
MNSLYTAEGVMDKHSLWQRYVPLVRHEALRLQVRLPASVELDDLLQAGGIGLLNAVERYDALQGTAFTTYAVQRIRGAMLDELRSRDWVPRSVRRNAREVAQAIGQLEQELGRNATETEVAERLGIDIADYRQMLLDTNNSQLFSYDEWREEHGDSIELVTDDHQRENPLQQLLDSNLRQRVMEAIETLPEREKLVLTLYYQEELNLKEIGAVLEVGESRVSQLHSQAIKRLRTKLGKL

SEQ ID NO: 11535 - protein, 234 aa, Salmonella paratyphi A
MIVRKRRGRRTLCCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLALTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 11536 - protein, 955 aa, Salmonella paratyphi A
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTRIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVVPDPVDPDPVDPVIPDPVIPDPVDPDPVDPEPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQLGGDLAQWSTDGLDRWHIGAMAGYANSQNRTLSSVSDYHSRGQVTGYSVGLYGTWYANNIDRSGAYVDTWMLYNWFDNKVMGQDQAAEKYKSKGITASVEAGYSFRLGESAHQSYWLQPKAQVVWMGVQADDNREANGTLVKDDTAGNLLTRMGVKAYINGHNAIDNDKSREFQPFVEANWIHNTQPASVKMDDVSSDMRGTKNIGELKVGIEGQVTPRLNVWGNVAQQVGDTGYSDTQGMLGMKYSF

SEQ ID NO: 11537 - protein, 193 aa, Salmonella paratyphi A
MKKFTLTTLAATSLLMTSGASFAATNDGVDHHGIYVGAGYGLVDVDGDEDFDRDDNAANVYIGTQFNQYVSIEGGYIDFGEYGNDTFNTEVDGYTLGLKAGLPVNEYITVYAKGGQLWWDADINAAGVNDSTDGDDLFYGVGASFAVSEGWDVRLEYTRFDLEFERDEIGILSEIDSFDSDVDYASVAVQYTF

SEQ ID NO: 11538 - protein, 706 aa, Salmonella paratyphi A
MKIISVRQRLYPALLLPLTFSPVLQAASAPNEQTMIVTATPQTVSELDTPAAVSVIEGEDMRLATPRVNLSETLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCRGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWRFE

SEQ ID NO: 11539 - protein, 614 aa, Salmonella paratyphi A
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYFGSRYDSDYSAYPYRTVKMGGVSLWDLTVAYPVTSHLTVRGKIANLFDKDYETVYGYQTAGREYTLSGSYTF

SEQ ID NO: 11540 - protein, 4248 aa, Salmonella paratyphi A
MYGKLAHYLRRSAFLKLQTWKEDMQVTKSIGVSFVKGSGGRSDVVSSRGRSVSLLFCGFLVFLLLSVSPALRAADPPPPPPNPSSSSFVGQTVTNPANGIVTKVARLIVDPLDTPNPGTIAFVYTEDDYAILVKPVGAFIYNKDNPPLAYKIESKDTVNKTVQLSQVNAVNYDGTLKIANLQYQGTITNFEKYFALNPPLGPDPPSDDSVTLANGVRIVSTGRGGSNGHAGALFVPPGAGGNGAPGKAVSYTNALNISTTNQIGIEAGSIGGKGGKGGDSYLSFWNGRAGGDGGAGGSVSVTNPSGYRVATTGENMHGIFAYSRGGAAGNGGDGYGAPGGGDGGHSSNGGDVTVNNNGTIITTGNGAFGIYGLSVSNSGGGGGSQWGVVGTSGKGGVGGNGGSVTITNDVSGGIYTSGEYAHGILAQSIGGSGGSAGNSGNLIISLQESGDTGGAGGAVTVTNKGVISTTGSYSRGIFAESIGGGGGTGGSTWGGVLALGGSGAYGGNGGQVNVYNNSTGSITTTGIGSDGIFVQSVGGSGGSGTDAGGFLVSIGGRGSAAGNGGEVTVENYGTISTSKASARGIVAQSIGGGGGDGGRSGGMVSVGGSGAGGGTGATVTVRNGGTITTVRDDATAILAQSVGGGGGNGGSAGSVGAVVGVAIGGTAGAGGTGGDVKLTLQGQDADTPSLITTQGDRSTGVFAQSVGGGGGTGGGAVQVTEGIGGAVSVAVGGEGGAGGAGGTVTLLKGAGESNIQTGGDDAAGVVLQSVGGGGGNGGYAVSVASSVGLISGSLSVGVGGSGGSGGDGGVVTVGSFAVDGSLSSTGFKGDILTTGERSTGFLAQSVGGGGGNGGLAVSVAGSGSLLFGGSIGVGVGGSGAGGGAGGAVSVATDGNIKTLSDNSTGLLVQSVGGGGGNGGGAIAASVSASGGVAGAISVGVGGEAGTGSNGGQVTVATRSGTITTNGNYSTGINIQSVGGGGGNGGYSVAAGLAAAGAGAGAVNVGLGGTGGGGGNGGTVKADLQSDVYTFKENSTAVLVQSVGGGGGNGGFNVNAGAAGAGVASGAVTVGLGGSGATGGSGGKVTASLAGAITTKKNNSNGFVVQSIGGGGGNGGFNIDASGSGAGVGSGAVTVGLGGSGGTGNDGGDVTATKTDGAVITEGDYSAGIFAQSIGGGGGNGGFNVSAAGSGAGIGSGTVSVGLGGKGGSGGSGSTVLLTVENDVSTLGMNSAAIIAQSIGGGGGNGGFNVNGSGSGAGIGSGAINVGLGGSGASGGSGGNVTATVTGDIETKLANSGGFLAQSVGGGGGNGGFNVTAGGSGAGIGSGTVTVGLGGSGGSGSSAGTVNGSVTGNIITHGAYSDGFVAQSIGGGGGNGGFNLTGGGSGAGIGSGTVTVGLGGSSGNGGTGGMVTALVKGSITTKKNNSNGFVAQSIGGGGGNGGFNIDASGSGAGIGSGAVTVGLGGSGGTGNDGGDVTATKTDGAVITEGDYSAGVFAQSIGGGGGNGGFNVSAAGSGAGIGSGTVSVGLGGKGGSAGDGSTVLLTVENDVATEGLNSAAIIAQSIGGGGGNGGFNVNGSGSGAGIGSGAINVGLGGSGASGGSGGNVTATVIGNIETKLANSGGFLVQSVGGGGGNGGFNVTAGGSGAGTGSGAVTVGLGGSGRSGGAGGMVTAKLTGQIATQGNNSDGFVAQSIGGGGGNGSFNVSAAGSGAGTGSAAVSVGLGGNGGAGGSGGVVTATKKGGNVTTDGDDSRGILAQSIGGGGGNGGFNLSVAGSGAGTGSGSISVGLGGGGAAAGDGNTVSLTVENDVATDGLNSAAIIAQSIGGGGGNGGFNISASGSGAGSYSGAINFGLGGSGGAGGSGGAVTASVTGDIETKLANSGGFLAQSIGGGGGNGGFNFTAGGSGAGSGSGTVNVGLGGGAGNGAVAGNVTASLAGEIATHGDYSDGFVAQSIGGGGGNGGFNVAAGGSGAGSYSGAVSVGLGGSGGKGANAGNVTATKTDGDVTTVGGYSTGILAQSVGGGGGNGGFNISAAGSGAGTGSGTVSVGLGGGGGAAGNGGSVSLTVENDVDTYGIHSTAVIAQSIGGGGGNGGFNVAAGGSGAGSYSGTINVGLGGSGGAGGAGGAVTATVIGDIETKLANSGGFLAQSVGGGGGNGGFNVSAGGSGAGSGSGSITVGLGGSGADGGIAGSVIASVAGAIVTHGDNAGGFVAQSIGGGGGNGGFNVSAAGSGSGKYSGAISVGLGGNGGIGNDGGAVTATKSDGTVTTDGDYSVGILAQSIGGGGGNGGFNVSAAGSGAETSSGSISVGLGGFGGGAGNGDAVTLTVNNDVYTSGLNSTAVIAQSIGGGGGNGGFSISASGSGAGKYSGSISASLGGFGGSAGDGGNVTASVTGTVSTLLDKSGGVLAQSIGGGGGNGGFSVAGALNITTEEGSTAGAITASVGGFGGAGGAGKDVTLTRVGYTQTIGDDAAALSAQSIGGGGGNGGLSIAGSIGGPDSKQVTASVGGFGGAGSGAGVVTVNNTGNILTGSTSIQQQQIAETGNVFQDVTVVTGRNSDGILAQSIGGGGGNGGFSFSGAVGATGENTNLNVGLTVGGFGGDGGTGNDVSVVNNGVIYTLGTTANGIEAQSIGGGGGNGGSAVTGLLAGGDSQKGKAVNVAVSVGGFGGDGNTSGNVFVDQTGAIITRGAGSNGILAQSIGGGGGNGGGANSISLQLGTTCTFDPLGIVTKGLKITAVKPPKNASINAQVDVGGFGGTGGDAATVTVNNHGFITTSGASAAGIMAQSIGGGGGNGGQAIVGLDGLFPGAEYVDIATLITSQAIGTTGFIQGAGKVTVGGRGGASGNGDMVDVTNNGVITTSGGDSYGIFAQSIGGGGGIGGNASSGVTGIFSLGGFGGASGNGGPVHVTNTASANISTTGYAATAIVAQSIGGGGGNGGSSGGFLSLGGFGSASGDGGIVTVTNEAALQTENDLAKGIFAQSIGGGGGNGGSTGLSGITVGGFSGAGGDGGAVTVTNSATGRISTLGDFADGVFAQSVGGGGGNGGGTGYGAITVGGYGSGAGDGGKVTVSNNGAVTTEGDDSVGLFGQSIGGSGGNGGTTKISAVSVGGKGGSSGDGGEVDITNSSFVSTSGERSDAIRAQSIGGGGGSAGGVYDDSVLNSIGLIVSIGGSGTGGGKGGKITVDNTNELFTTGDLANGIFAQSVGGGGGYAGNMIGAIAIGGSQGSYGDGGDIIITNGINGTIWTQGIMANGIFAQSIGGGGGNTSGKVTSGQSLAFHTFIGGDGSGGGNGGSVIVDNSGMIQTDGASSQAIMAQSIGGGGGNAQIAGIMDNASSLSSADVRVGGTGGNGGNGGKVEVTNHESGTIVSNGANSTAIFAQSIGGGGGNGGGAIIGLSGTPATTTSITLGGNGGDGGNGGNVNVANEGVIEINANNSLGIMAQSVGGGGGTAGSAVGSDVIPVSIGGQNGVVGQGGDVSVTNSGSIIINGDNSVGIFAQSVGGGGGMVMPGGGATSIDLQNGGSGNGGSVEITNTAGSIIVTGPNSIALYSQSVGGGGGAVGLVSDPPGQIGAFLFSSTAKGSGSSDKTNIKQTGDLIATSRNSIGLAAQSVARDGNGDITIDINNRAGLTSLIAGGSDQGAGVFILDGAGNTLNNDGIITTISGIDGFGIRATTGSDKIVNNRLIIGSVDLGDGANAFFNNQDKWFKSGETVYLGAGNLLTNHGYVTPGDWNRVLTTRNTGNYLQSDTGVFCTDLDLKNQIADKLDITGTGDVSGTIPINLVDPVNAAGYALPGDHVNVLMTAAMGMQHGTIDLQAPETAVATYSLDYPNATDIDLNYTIDYSPSGLTWNQRSVGYAVNRIQTAQISPDFRPIAAALFFQPDIETLGSIYDSLSGEGVISLQQSSLYASDMFLKTIGNRTGQWVFNNAFGQSEGKEDSSPVKDGGYKQTAKEGNLWMTSYFGNGGVTGNSWIGSANSSYDGICFTVGLDKQITRDAIVGFAVGKGSMDMSVPERETSGGVDFLHLGSYAAVRGDQLYVKGALAYDQFDNAASRHASVPGVYMDTPDGKGIAIAGYDEYLKSSFASSAVSGDIEIGSNHLNGDLLITPFAGLSFSVQNSEGFEEQKQNNEASEIGLSFQEQETISIPFRLGLQLSVLKKLSNESSLAFSARAQWIHEFRQDRTMYSEFLAAPGFQFPIIAAQPEVDAFRADINMNLVVDKNLSFYGGLTTDTVGSMTKYSGMAGWRITW

SEQ ID NO: 11541 - protein, 383 aa, Salmonella paratyphi A
MKRKVLALVIPALLAAGAAHAAEIYNKDGNKLDLYGKVDGLHYFSDDSSKDGDQTYMRFGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNDGDDIRYDNGDGFGISTTYDIGMGFSAGAAYTTSDRTNEQVNAGGTIAGGDKADAWTAGLKYDANNIYLATMYSETRNMTPYGKTDAGYAGGVANKTQNFEVTAQYQFDFGLRPAVSFLMSKGKDLTYNNVNGDDKDLVKYADVGATYYFNKNFSTYVDYKINLLDDDDPFYKDAGISTDDIVALGMVYQF

SEQ ID NO: 11542 - protein, 724 aa, Salmonella enterica
MRVKKFIWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLISYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11543 - protein, 724 aa, Salmonella enterica
MSFIQYRRDKHLPSTAAPSLLAMGMAMAFMPAAFAAEDTVIVEGATTTDAVNREEQDYSMKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGATTSLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11544 - protein, 668 aa, Salmonella enterica
MKNIILFFVVLLSFPAFAQDTLQTVRVQMGRKKLQKSLLKTTNTTVLSGQELLKAACCNLAESFETNPSIDVNFSDALTGTKQIKMLGLTSPYLLITEENIPSVRGASQAYGLSFTPGTWVESIQITKGAGSVINGYESISGQINTELIKPAKDIPFFLNVYGSSDARMEINTHLNKKISDKWATSLFIHGNNRLSKNDMNNDGFLDNPLGNQINILNRWQYTNANKGWVSFLNFRYMNDKKQTGQVNFNPNTDKLTTNSWGSEINTNRFDFSSKIGYVWPEMPYQSIGFQNAYNSHNQESYFGLVQYNIKQNSFYSNLIFNSIISNTLHKFSTGLNFTSDIYKEFVNTKDYSRKDYSLGAFFEYTYDNTENFSVILGGRLDYQNRLEFFVTPRLHARYNPWEGGVLRFSAGRGKRSANIFAENQQLFGSSRSFNILESSGKIYGLNPEIAWNYGAGFLQKFKIFAKSANVSVDFYRTDFQNQVVVDLFQSAQQVDFYNLKGKSFANSLQFEFNLEIIKHLNLRTSYKFYDNKTNYNSGNFQRPLQAQQRFFGNLEFETHIKEKGQQWKFDYTFNWIGKQQLPNTASNPIQDRLSDFSKSYSLMNAQITRTFSSKFEMYLGGENIGNYTQKRTILGAENPFGTSFDSSIVYAPVFGQMYYAGLRFKVK

SEQ ID NO: 11545 - protein, 383 aa, Salmonella enterica
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNSDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTDAGYAGGVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 11546 - protein, 372 aa, Salmonella enterica
MKKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAGAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVALGLVYEF

SEQ ID NO: 11547 - protein, 721 aa, Salmonella enterica
MSRFPLIRLHLSGIFMKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQNVEVLRGPFSALYGNASGGVINATTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11548 - protein, 1941 aa, Salmonella enterica
MQKKKLISIAIALTLQSYYIPAIAAENNDDEKECPSNISSLPKEKRAKLSPTCLATPENDNHWGWVAGGVAALVAGVAIGVENNGGGDSNHSYTPPKPDNGGDVTPPDDGGNVTPPDDGGDDNVTPPDDSGDDDVAPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSNISGAGSTGTVIDGNNARVNNDGDMTITDGGTGGHITGDNVVIDNAGSTTVSGADSTALYIDGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSATSGQYLDVVGLSVTGDDNDVEIGGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKASGDITLISDQTPQGSGGIEVYPLKWYTHTFYAMMASDYGDVVNDEGATIHLQGAGVYGVTASRGKALNEGDIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGKTKAIINNGEINLLCDSGCDIYAPGTTGTQNDHNGTADIVIPDATTAPTEGSIPTPPADPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEGGYKERSAGDFNLSMNSGNETAVDSIVGLKLDYAGKDGWSATATLEGGPNLSYSKSQRTASLQGAAGQSFGVDDGQKGGGINGLATIGVKYSSNDTALHLDAYQWKEDSISDKGFMLNVKKTFR

SEQ ID NO: 11549 - protein, 350 aa, Salmonella enterica
MNKSTLAIVVSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFGIVDGLDLTLQYQGKNEDRDVKKQNGDGFGTAVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAIGLTYQF

SEQ ID NO: 11550 - protein, 234 aa, Salmonella enterica
MIVRKRRGRRTLRCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLALTDPLWHASVSTLGWRVNSQFGDVHPWAQISYNQQFGENIWKAQSGLSRMTAGNQAGNWLDVTVGADVLLNPHMAAYAAFSQAENSATDSDYLYTLGVSARF

SEQ ID NO: 11551 - protein, 696 aa, Salmonella enterica
MFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPQGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11552 - protein, 737 aa, Salmonella enterica
MCYQPKLGKLKTKVSLFVVGILPSLPLLASDVLGEPKVQPIEVIQVHGQQYRRVMTVTKPGEAIISMDQIEEMQATTFAEVIDDMAGAHIDGGTRSGGERINVWGFGETEDFNVYVDNAPVGFEQYRYGSFFLDPDLIKRVEVIKGAHDVRSGNGGFGGAMYVVTKSADDFLKYDQSLGARVKTSYASNNDAMGYTGTVYGRVNSSLSGLLHLTRRDAGDVTLANGEEYEYSGYEQNNYLGKMDYAQGDHQLALSVTHYLDEGRKPWANRRGPMPAISDYNIKKYGSYEQALYATTAYNTYEDNTWSANYRYSPSNPLIDTQVVISHSANARHWVRPDIAWEKMTVSVGNFGHESWLDYKRDYIDINNLSLIGDHEITTGLQYRSLDRTSLVFNKSYEKNPEKNFGWYTPYYQPEGRQDTYAAYVRDAIHITNDLTVTPSLRYDFIYSIGRPNIAPDYNDIAAGHDYSSTHHSGFSPRLGIDYQLTNHARLNFDYAYSLQAPVVDEIYAVQYAKASITGTSRNIDVERLHAFKLGLMTQHQHVLANEDALSTQITLFANLGRDDIAQRRGAKSDKTHLIQSGYTNLDGYHIYGADFEAQYRYQDVFSDLAVSWLQGKHNGSLRDSQDDDEYLANIAPLDIRLRLGMYITDDISIAWQGAWYDAQDHVPHGDIFNAESPSENYFLQNVYFAYEPQAILKGLSVRLMVKNLTNQQVVPFLSDGIPAAGRDVRLSLAYEF

SEQ ID NO: 11553 - protein, 650 aa, Salmonella enterica
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYTGRKRADSATAKTPGGYVVWDTGAAWQATKNVKLRAGVLNVGDKDLKRDDYGYTEDGRRYFMAVDYRF

SEQ ID NO: 11554 - protein, 751 aa, Salmonella enterica
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDQLSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 11555 - protein, 378 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTADEHLYGNGDRATVYTGGLKYDANNIYLAAQYSQTYNATRFGTSNGNNKSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 11556 - protein, 614 aa, Salmonella enterica
MIKKATLLTAFSVTAFSAWAQDTSPDTLVVTANRFQQPRSAVLAPVTIVTRQDIERWQSTSVNDVLRRLPGIDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 11557 - protein, 610 aa, Bacteroides plebeius DSM 17135
MKYISLFFLLLLFCSQAVAQSSTGSIQRLDAVVLSDVKLKRYTNGYKLTVLSDSILRRNRTSLTDVLRFNSNIYFKENGYGMVSSPSFRGTNASQTAVIWNGININSQLNGQVDFNTISSSNYNSISIRSGGGSVQYGSGAIGGTIHLSNDLNFEKHFDHSVQIGYGSFDTKNTSYNAFYGNDSWSGSFGIAYADSANDYRFLGTDRRNENGAYSNLDINLNLGYVLSKTDVLKLYHQNFRGNRQFSSTLLAPSNSKYETEDYRSMIEWTRIGEQYTSSLKAVHLLEQFKYFENRDLDNFSKGYANNWIIKHHYKRDISKRLALSVITDFSHITAEGNSFSNPKRNAFSATAILSRRITSKLQYNLNIRKDVISDFKSPIVFSGDVSYKILQPYTIKLNASKNFRVPTFNDLYWNPGGNLDLEPEKSYQIDLGHELKFSSIDFKLNTFYIKTSELIQWRPNNVTGYWNPVNIANAKQYGLEAELRATQNIGKHTLVLSSAYSYTETEDVEKKQSLFYVPIHKANASLSYNYKSFTAFYQHLYNGEVDIIGNTLDGFDVANLGVSYTFKSKKKMSYITGFRINNIYNTYYENVALRPMPNRNFNIKLTLKF

SEQ ID NO: 11558 - protein, 1602 aa, Bacteroides plebeius DSM 17135
MKNIFKITAIFIFLSSGANAAQLVLTSADHTLTDNSAYDGGTAGIIFNSSVTNRVLNLDGFTISASNNTAQGFQLTGGGVVTVNGNGGAINLTDNRNAAGTSGTGLNLTGATTLNINNADVNISGSVLGISNAAGSKLNFIGGGTNTINSSNNKNATTTGGTGILSTGAGSEVSITDYQNIIFNGNTNIGMQAASGGSITITGKADGTTTFTASGNGRQDGSGNLTAGQGIYISTAGSAVTMTNMQSVDINGNYTGVQNVASTNLTLSGNGSATSSLSISNNTYTGLINSGSTDISGFSTININNNGNIGVSVTGASASLDISGVETMNVNGNASGITTAANTTLNLTGTGSAASKLSVNNNTGTGFSSAGLVTIKDFREIEASGNGGNGFVISGASTIETAAGQNLTIKTNNNTSVGTFGFLSTAANLVLDRVDIFESTGNGRYGFAVNNGKTTMNLTDNGVVTLDGNGVSATAAAAGLLVNGATAELEINGGLNSTLSASGNKNSTGSGGVGIQAASGSLKLNNMETITAEGNITGISTSANGSLLLDGSGSLTSKLSVNNNIGAGISAAQSTSFTIQDFAIIEANGNGGTGLNLGVNSTITNIAGEQISISSSNNTGAASDGIYSSAANLELKDLASLQLNNNGRYGLHVYSGSVSIDAAGRVFGVGDLSVTGNGNHGVYLRLDNLEIANVDGINISGNGGTGMLASGGTLSLKSNNTEGKMIFSNNGGDGAKFTGSTQLINFTQINAFNNGGTGFSLAGNIDWQTQVDSEFSFVAKDNGASGIVLNGSSLEDPLVFNVKELVLTNNGTKVTSNSGTGLSLGRNITFNVTDTDITATDNGAIGLYVSGGGVLNAISSTGTNIIRLRNNGDKSLSGSSMGMDVHGGRFYAENMNVINIENQNFGIIAWYNGEAIMKDSNIIVTDNANGILASRATIDINSTSGLHTIYGSGNTYALITQENAQYEGSEYFNITNMDIYLENNSYAIASTFGGGAMNIKGNGSNILSFKDNLQSGLFAQWNVNRPSAGTKVALSQVNVEGMYIQTENDDLAIAESSQEGGAEINIKDSTINMLTQDTLFQTIGYGVYNIENVTATGNSALLVNTAIADHNDPSVMVGKSEFNAKDAFLSGVITTAADTAAHVSFTDSAWNMINSSNMTSLTNSSSDIFIGSQTSGAYNTLTLENYMGHNGNIYLNTDVNGGSTDMISVSGSANGSTTLFINDTSTTLPGTDPLEIKIVEAKAGAHISANSFVLNGGSIDTGAFKYFLLQGNKDQSDNQSFFLRLSNAMTDTFKTMLNIPQLNVVMAQTGMNSLQKRLGDLRNFGNSSKQHGVWTRSYGKQITVDDLIETDMSIFGFEAGYDFLMREGDENRIYLGLMGGYMTAGNVKTKQDNGFYSKGNGDAPSVGAYMTFITPSSYFLDLTIRNFWTNLDMVNYSSLGTELKYSPRRNLFTMSAEFGKEFQIMSCRGTQWRVEPKAELAFLNASGDSTNVENGNGSLKYENASYIITKASVMLAYMHKRQTGLFTQPYAELAYSQTFMGKGDVSYSGAVSETNLSGGAFETALGLNYQFNKDIYVYGQATFETGSKIQAFGGNLGFRLAF

SEQ ID NO: 11559 - protein, 609 aa, Bacteroides plebeius DSM 17135
METILRHSLKILLPLWLLTAPLTAAAEPDDSIGLLDAWQGETVSASRLPKPVSHTAENVTVVTAAEIQSINAHTLIDILANVPGMQLESTRTLGGLIYFRSQGSSFNHILVMIDGVPFNNLGDNFSDIGLIPARIIERVEIVKGAASSSWGQALGGVINVITKTPDRERRSGGSLSSSVGERRTSDSGAELSGSIERFGYYLSGGYSGSKGLLANNHGDYSNAYAKLVYDLPGKGQLAGTFGYSQANRGDFAFAPLDLKEETYPRQLFSTLTLRTTLTDQLELELNGRHATRELGLDIGLISTYLPLQSYNIDETVSGVGAKLLWRTSSNLLAVGIEYDHVWMRSTDSMVHVDTLNRKTDRWGFYLNDTLTVGNFSFSPGVRLDLTGTSGDQFSPSFGITWQLTDTTLLRAYTARGYSLPAFLLDRTSEKVWTSQIGFESTTIPYLWLKGTLFRNDTWDIVTYDSFSNSFNHERHLKQGFEVEAKTASLFNTSLSAGYDYIDARNTSTHQIVQDIPRHTLLLGLQYDDRQYLKGVLNGRHIWWNAASYHNGSYQGVIWDLHLTATPFGRKQHAPELFFSIRNIFNGSQYLDEFFKNAGRWVEGGMRISF

SEQ ID NO: 11560 - protein, 379 aa, Bacteroides plebeius DSM 17135
MKKQLLGMTALMAATLSCHAQSSVTLYGALDDGLTFTNNQGGHHNYQASNGALGSSKWGFLINEDLGGGYSAIARLENGFDINTGKFNNGGRLFGRQSYVGLGSPYGTLLMGRQYDLVLDSLLPLSASSRFGGILAAHAADVDNVWGDYSLSNSIKYLSPTYAGFKLSALFSFGGVAGDFSNSKKESVSLVYTNSALSASAVFSRINNPATSIYDATANPVAGTAFANPITNPTFSGYTSAHTLQVAGAGVNYRIGAALLGFTYTNTRFEDVVRTSSTPFSGTATFNNFEALATYNVTPALLLGASYDYTKAESAKYGQLNLGTQYSLSKRTLVYATTSWEHATGTDSTGKQAVAALSFLTPSSTGNQVAVRVGVRHSF

SEQ ID NO: 11561 - protein, 848 aa, Bacteroides plebeius DSM 17135
MMSTFTRTALYAAASTLVLGAAAQAQVFEQVGGGERRTIDTITVTAQQREESAQDVPISIGAYDTDALQNAGVKDIKDLISIAPGLMVTSTQSETITTARIRGIGTVGDNFGLESSVGVYIDGVFRSRNGVGFGDLGEIERIEVLRGPQGTLFGKNTSAGVLNVVTAAPEYEYGGSLEATFGDYGYNRYSGSLTGPIVEDVLAFRLFAAKGERDGFTQLVLDDGNGPAEVRDSETQDYYTFRAQALWTPSDSVEGRLIYDYSSRDELCCSAVQWDYAATPEFFVNAVGGQVIAPADPEARIAFANREYMQEVEDQGVSAEFDIELPIGTLTSVTALRRWDNDRTQDIDYSTADIAYRGSGNYTRLDRFSQEVRLTGIWGDLDWLVGGFLSHEELELGDAIRYGDDWEAYLGRLLTAGSVPPLGTPAGVSAVLSQIAPLAPVAALIGVPGAQGFLPVPAPGTAFPEGTGVAQDVYDQTAQSWALFTHNTYRLTDNLSLTAGLRYTHETKNVFATFDTNSPAGCGALETAFGPDPVSGLIAAATAAGLPAASISGLATAAGNMCLPYARTGLDQTGYQRERTDEQVSGTIRLTYDFSDDMMGYVGYSRGFKAGGFNLDRSFNGPVDGALGYTDVDSGFAPEIIDAYEVGFKSQLFGNVLQLNANAFYQEVEDFQLNTFTGISFVVNSIESVTSYGLEVDFAYATPIDGLDITGGYAYVNAEYGDEASTAPNLRGKQISLSPENFLTAQIIYERPLWGDIWGLASLDARYVSDYNTGSDLDPEKLQEAFTLLNARVGLNQADGQWSIEAWGRNLTDEAYAQVAFDQFAQSGGFGAFMAAPRTWGITLRTEW

SEQ ID NO: 11562 - protein, 455 aa, Bacteroides plebeius DSM 17135
MKDILKRSATAALVVLAAPSAYATNGYFLPGFGVKSQGAGGVGIAVQADALSQAANPANATQTGMRVDLGLSLFNPERKSKTGPESPASEGGFGFNAESQSGNRLYLMPDMAFTMPVNERLSVGVAVVGNGGMNTTYKENIFASPGLAPLAAAAGIAGSQPDSSLGVDLMQVIAPVTAAYKLSDQHSIGASINLAAQRFKANGIGQFAFFGISSDPEHMTNQGYDYSYGAGVRLGWLGKFANDRVSLGATWASKTYMTKLDKYRGLFAEQGDFDIPETYGMGLAVKATETLTVAADVVRIKYSDVAAIGNPGPGTATGSGVSQSEILLLALSPSAAGKLGNDEGMGFGWKDMTVYKLGLIYAATPDLTLRLGYNYGKTPVRNDQLVFSALAPGIVERHYSLGFTKKIKGEIDWELSGTYMYVANNTQEGCAQAVVDCVSFSMHQHVLGVGFGVQY

SEQ ID NO: 11563 - protein, 492 aa, Bacteroides plebeius DSM 17135
MCGGEYGTGPGATRSGRRERGRGWAAGALAGALVLGASGGALAQQPSPVGQFNDQTQPRTDPNIAAKPADPVRTGPLAPWATDMAARGLTFDINIYNFYQANPSAGLRTGEQSNSTYFVLSMTADMQRLAGIAGGTIKFTQTFFGNVRNLNMAADIGDTTVGYQPPYNPNSNRLSLLTYQQKLLDDRLVIEVGRTHPDRYYGLPPCNSINSCFQDLFYINAGFTSPLYAVWGANAAYQLSPTTYVQAGAFSVNPGTNALSGYDWGYERLSGALVMTEVGYKTDYTMTAYPGRASLTGFFNTADHDDNFKTVFGTSKGLNPGAPVLQKSGTSGIVLTGTQTVWRADGGLVANPHPTAVSLYTGTGYSFDPTVPIRFNSFVGVRLDAPDQSRPNDSYGLKMNWQRLSENYTQFLSDANFISGGSGAPYSRDKFVFEANAHFDVGAGVIIEPVVQYVVNPNSFWNPFTARRAKDGFYAGATLVVPLGTLLGLAPG

SEQ ID NO: 11564 - protein, 322 aa, Bacteroides plebeius DSM 17135
MKKTVLTTAVLTALVSVPSFAATVYKDDSTELKVGGRVEFRGDFIGSGGAEVDGTMEDQSRARLNLKGKTDIGNGLSAFGVYEAEQKTGKSEFKNRYMYAGVSADLGDFSVGRQDMAAVIISDMTDITEFSGVQQVIDSSSDKQDSVFAYRGEFDALQVQTTYQANSGDSQDKYSIAGLYSLPMGLDLGLAYSGGDVDKNNSEDQILGGVAYSLENLYLAGTYSQGSLNDSEDFSAYELVASYKIASKFTLAGLYTFQENDPNGAAKFDAVDGFELVGYYKLNSNFRTYLSYYMNQLDEEKDPQGKTVEGEDTLRLGVRYDF

SEQ ID NO: 11565 - protein, 803 aa, Bacteroides plebeius DSM 17135
MKDRTSPSTPAPRRPIPARHALGLAIALAGLGVSLPLRAAERTTLAEANAEVVGEAGGESAPAVTAQVASRSGQRLGTVTVNARRREESVQDVPIPINSVDAQTLENHRIYRIQDLQQLVPSTNVSYVHARQSSISIRGLGNNPASDGMEPAVGTYLDNVYLERPGMAVFDLLDVEQIDVLRGPQGTLFGKNTTAGVVNITSRKPTFHPERSVEISGGEDGYFQTKGSVSGPLSDTLAGRLSAYRSRDDGYIKNIHDGDELNGGSRQGFRGQLLWKPSETFNLRWIGEYNEEDSDNGTPTLYSSGPTINGVNRYEQRATAAGARLVKARARKVDLDSDQQVTVFQGGTSLEANWTLPNDFTLTSISAYRWWDFTPRNDLDYLGISAAINAGVAVRDKQYSQEIRLASPTGDVFDYVLGAYYFKKDLDNETFFSYGPMADVYYGTAPGALANVRSTGKGRIETDSYALFAQGTWHITPKLELTAGIRGTYEEKDARVRRYAPTGGNSASGTTAASVRAYDSGDLNLYSFSPSGLLALSYRFNDRWLGYASLSHGEKSDGVNLSVSSAPSAGADSLLVGTERVNNAELGFKSTLLDGTLLFNANLFWAQVHGYQANAYDPEARSSYLTNAGDVRSRGLEVETTWRPIRGLTINANGSFNDVRYTDYKDGPCPPEVSFRSGAPASCDLTGHRVVGASRWIANLNGHYQWRLDNGLQPYVNASYAFRYRAVGTMEDSEYAQIPSYAVVNLSTGLRGDLGNSQWDVSFWMKNAFDKTYYTSLWSASNGGYTGILGTPRTSGLTARLDF

SEQ ID NO: 11566 - protein, 926 aa, Bacteroides plebeius DSM 17135
MQRILLTFIGILLGASVFAQTGTIRGTVTDAKTGETLIGATVVIKGTTNGAPTDIDGKYTLGELAAGKYTLLVQYVSYQNKEVKDIEVKAGQVTIQDVKLGSDAKVLETVVVTARIEKKAEIALLTMQRKSALVQDGISAQAISRAGDSNAAGAIKRVTGVSVEGGKYVYVRGLGDRYTKTTLNGADIPGLDPNRNSVQMDLFPSNMIDNMVILKTFSPDLPGNFTGGYINITTKDFPDRFTFQVNASLGFNDQATFNSDFLSYNGGSMDYLGFDDGGRQLPVSREDALPGKENFSKDIRPVTKSPFLNQSYSVSVGNQYTVAGRPLGFIAALSYRKNNQYYDNGKIGEFGEKARLGRFSLNSDASVINSLNPEYTVRNNVGTENVLWGAVLNTSYKVTDKSKIGLNLMHNQSGKTETRVQQGKYQDLDPANTFNSIALDFLSRSLSSAQLKGEHAFGEGGNNIKLDWITSFTVSRLNQPDLRFFSYENEPNGSIVVRSNAAPRRFYRDLTQTNWDNKINLTLPFKLGENKGKLKTGVAYVSKNRDFSQTIFAYASNRTDFAADANGGFDFNTYVDVPGTRIQNGSQDRDVYNGKENIFGAYIMADTKLSPKLRMLAGVRFERTDISVISNDVSLVKGLLENNDILPAINLTYSLTENMNLRLAYGRTLARPVFRELAPFDSFDAFGGLIYVGNPNLKRSLIDNVDLRWEMYPTPGEIITVSAFFKNIKNPIATAFSAFTPNQQVTWVNQEDAQLFGAEVELRKKLGFIGLKDFTIGANASFIVSALNIEAQELSQIRANDVNRVTELAQDGTRPLFAQSPFLINANLNYNNINSGWSASLNFNIFGERMAIVSRNGVPDVYEQPRPVLDLTVGKSLGERWKLTLKARNLLNPEYKFLINFKDAQHIVNNYTVGRTFSLGVRYLID

SEQ ID NO: 11567 - protein, 1030 aa, Bacteroides plebeius DSM 17135
MKVDNKKQPGQTGRVFLLKALNRAVLCALATLGTAQAAPYVESGRAGNPDSWRSSEFNAEWGLGAINAQQAYAAGYTGKGVKLGIFDQPVYAAHPEFSGTGKVVTLVTSGIREYTDPYIPVKAGDAFRYGGSPTVGSDGKLGSHGTHVGGIAAGSRDGSPMRGVAYNAQIISADNGDPGPEDGIILGNDGAVYKAGWDALIASGARIINNSWGIGITDRFDLGGRDPAFPHFTVQDAQLQFDQIKPLLGTKPGGAYEGAIAAARSGIVTIFAAGNDYNLNNPDAIAGLAYFVPDIAPNWLTVAALQINPDTASADPYTISTFSSRCGYTASFCVSAPGTRVYSAVIGGTSADDLTVGYANKSGTSMAAPHVAGSVAVLMERFPYMTGAQVASVLRTTATDMGAPGVDALYGWGMINLGKAIDGPSMLVTEQDIPEEFRIEGAYGSGQFVVDLPGIGAIIDAGKSTERLCSGIQCGLDVWRNDIAGHGGLTKEGIGTLVLTGANTYSGPTLVNQGRLAVNGSLASAVTVNDGGILGGNGRIASLTANRGGSVAPGNSIGTLQVAGDVTFQPGSNYAVEVSPTSSDLIVAGGKASIDGATVSLSLENSPTLLTAGDVKACWAGSSISCRPSMVLTGASHEVLPNYAFLGGDLAYSASGIQLAVERNDASFASLGLTPNQRSVASAAEQLGAGNGLYEALLLSPSAAVAQQAFQQLSGEIHPAIGTLLINDSRQLRDAVGDRLRQDALYDAGTPTDASSNAWFKVLGAWGKNDGGHDHASTTSSIGGLLAGVDGLISDQTRLGFVTGYSDSSLSMGDGTHSSAKADSYHLGVYLGHEIDALRLTVGGAHSWHRIDVKRDLQWGDVSGREKTKRDARTTQLFTEAAYRLDLQPVALEPFANLAYVHLDSDSFHEKGDNAALHAGDDRRDAVLSTLGVRASHTLALSDKQQLQLSGSLGWQHNLSSTTSEQDLAFADSSSTFAVQSVSMDRNAAVIGARAGLAVAKDVRVNLDYNGLLGSRDKSHGVGLTLDWQF

SEQ ID NO: 11568 - protein, 180 aa, Bacteroides plebeius DSM 17135
MPMSSRRLFLSLLLLPLPNLVAHADPSPISRAFQVQAVVANGCAFGTAISNNAYDLGTLSFGTLGNLASPVNVASSSGAGSIVLTCTPGMTVSVALDYGVNGGSSSQRYLKRVSGNETLAYQLYQDAAYSQVWGNGALARTIANFPASTQTYTVYARLFAVGSLPSAGNYRDTVTVTLSF

SEQ ID NO: 11569 - protein, 1006 aa, Bacteroides plebeius DSM 17135
MQTEFQFKLSWKRGLSVLLLTLFSFSLAVAQVLVRGTVIDQTGESVPGASIQVKGGTQGTTSDLDGKFSLNVPNKKSVLVISFIGYTTQELPVDVSKPMSVVLKEDTKTLDEVVVVGYQEVKKKDLTGAVAKVNMEDLLKTPSSSFDQTLGGRIAGVNVSSGEGMPGGTMNIVIRGNNSLTQDNSPLYVIDGFPVEDPAIAATINPSDVESVDVLKDASATAIYGARGANGVVIMTTKKGKIGKPQLKYDGSFGVQKVTNTIPMMDAYEFVKLQNEMFPADTKKNYLKEYEGKQWTLEDYRNVAQYDWQDEIFRTAWQQSHNVSLMGGTEGVRYNASASYFDQDGIVLNSNYKRFQTRMNTVVRRGKLNMSITANYSRAIQTGSSTSLYSSSGMNNLFYSVWGYRPVTEPDVPLSTLMDNALDSSVEPTNDYRFNPIMSLKNEYRKNYTNNLQLNGFVEYEFIKGLKLKVSGGYTYDARNNDTFNNSKTRYGSPISTDKVNAQVVRNQRLTWLNENVLTYQTNIKKKHFFNSLLGVTLQNSDYEYYSFKTTNIPNESMGMAGMSEGIPATTSSEKSSWSMMSYLGRVNYNYKSKYYATASFRVDGSSKFAKKNRYGFFPSGSLAWNFTEEDFMSKYKSVISSGKLRASWGLTGNNRVGEYETYALLKMLKATSNNVQTGVYPFENNLNSIGMVPISLLNKDLKWETTEQWNVGLDLGFFNERIGINVDWYMKTTRDLLLDADLSYTTGFKSAMKNVGKVRNSGVEFTLNTVNIQKNGFKWSTNFNIAFNKNEVLELAENQTSLLTAAYFDQAYNTQPTYIAKKGYSMGMMYGYQYEGTYKYEDFYKSGDTYVLRPGVPYFSSESNTQPGMPKYKDLNGDGVIDTNDRTMIGRGLPIHTGGFTNDFEYKGFDLSIFFQWSYGNDILNANRLFFENVNNSRNLNQYASYANRWTPENPYSDIPVAKNSSSNKVVSSRVIEDGSFLRLKTLTLGYTLPKKVIKKWGIGN

SEQ ID NO: 11570 - protein, 1122 aa, Bacteroides plebeius DSM 17135
MNYRKKAILMVVALFCLNIAMLAQAVSLKMNNVSVKEAMTQLKNKSGYSFVYKVGDLDTKKIVSVKAEQLNEAIDQILYGQNVVYEVKGKNIIVQKGQPRPKVVKGDKKRKITGVVNDLNGEPIIGATVKEKGDVNGTATDLDANFTLEVSPGAILEVSYIGYQPQEVKVGDRTTLAITLIEDQQVLDEVVVVGYGTTSRKNLTTAIATVKTEKISKAANSSVASMLLGRAAGLQATVNSTQPGGEINISIRGGGNPIYVVDGVVMPNSSLEVGSGETGLPDGVKRAALAGLNPSDIESIEVLKDASAAIYGIGAADGVILITTKKGVEGKPRITYEGSYSVQKRYSYGMNRLNSQEYMNMVNLFGKENYLFINEQYPYGNVGYDGKWTPVFTSEQIANATTTDWLSYVLKTGQVNNQNLTISGGSKTLRYYLGLNYYDEDGVVRNAGMQRYSLRTNISAQLFSFLKLTTIANLNHNKYSNSTVGGDTGNQGNSAAGSLYTAMNYAPYLAIYDNMGEYTIFGREPNPLAALQIRDGSKQSSYYVNFALDIDIIKDMLSAKLLYGVNKENGKRSAYIPKDVYWGLVRKSRGSLGYNERQYETMEGTLSFRHKFWNMIDVNAVAGMGRYLDKGTGMTVSYQNANDMINDSNLAAADGPFSPTSYKYENEKRSQFLRASFDVLDRYVLTGTLRRDGTDKFFPDKKYSLFPSASVAWKMSNESFMQHLSWLNLLKVRASYGVTGSDNLGTSLYGIIGISREDVKFSNSGVTYVPYALQSANYSDVTWQKTAMKNIGLDFSILKDKIWGSLDFFRNDVTNLLGTAPTSLLNMYGYRPINGGHYKRTGVELSLNTLNIQTPNFKWTSSLALSHYNAYWIERMPNFDYKKYQKRENEPMSAYYYYKTVGVINEDRSNMPDSQRSLPREAQLPGYPIIDDRNGDGKIDIDDIYMDNTLPKVYYGFGNTFTYKNFDLDIYMYGQLGVKKFNSTHASNCSAANLASGTLASNPTDYAYAIWNSQTNPNGTVPGIASSKSVALPENAPINTFWEKASFLRVRNITLGYNWDTRKLAFLKGNVQTIRLFVDFQNPFTLTKFEGDDPEITTAAGNLGHGQYPQLRVYSFGAKISF

SEQ ID NO: 11571 - protein, 504 aa, Bacteroides plebeius DSM 17135
MCIPMSFQRVRDRVRASSRLAVTLPPVALGCVLMAGPAMAQSSGTTRLPGSAISDAPNPRVVPGLIKPIQTKEIRNDEGPLGPLARTLLKRGISFHVSLFDFFSSNPSVGQDTGNTVNSTYLLTGADFDLDKILGIHHARLHFEETFFGLRANNIEATKQFSDSSTGYQTTYNLRSEQLSTLTYEQTFFNDRLNIELGRTHPNRFFALPTCQTLNSCYNNILYHNAGYISPLYSMWGGRVSYALTPTTYIEAGSFAAHPDANAHSGWDWGQEPNPGALTLVEIGHKTGYETQLYPGRYSLTGFYNSSSHPDNDTTAYGRSRGLNPGDPVRNQHGTQGIVINTEQVVWRADGGHPDADSLRPSKSNPAAISLYSGLGYSFDSTVPFQSDLFVGANLHAPFASRPYDRFGVKLRWVRMNGSFARYLAEANAEAGGSGAGFSRDKAIFEINAHVQVFSAIALEPVVQYVLNPDSYYNPYSARRPRDGWYVGAALIVPVGAILGLKPL

SEQ ID NO: 11572 - protein, 255 aa, Bacteroides plebeius DSM 17135
MATWTPMPNNQLRLRFERELGQLDFSDFAASADLEEENVYGGNVDLEPEQRWISELTYERRFWGEGVVSIGYRHDEIIDAIDRIPLAGGLSAVGNIGEGTLDRLSLNVTLPLDKLGAPGARFTFKNDWNKTAVTDPTTGEERPISGVRATQANIGIEQDITRWKLQWGVNWLPYLGQPNYSPDQVSRWRGTDYFEMFAEYKPSPTLAIRAQLNLWDDFTNSRTVFADRETRAVAFIEDSTVDPRTFVSIRVRKTF

SEQ ID NO: 11573 - protein, 759 aa, Bacteroides plebeius DSM 17135
MNRKLSRYSLATLIGLGLGASAFAHAAQQTETTAETDSVAKNKKEAAEDTIVVTAAKQNLQAPGVSTITADEIKKRPPARDISELIRTMPGVNLTGNSTSGQRGNNRQIDIRGMGPENTLILIDGKPATSRNSVRQGWRGERDTRGDTAWVPPEMIERIEVLRGPAAARYGNGAAGGVVNIITKKNTKELHGSLNAYFNVPQHKQEGSTKRTDFSLSGPLTDELSFRLFGGYSKTQADAWDINEAHKSERVGIYANSTPSGREGVEDKNIDAMLHWDFAHLQSLEFEYAYGRQGNLYAGDTQNTNSNPLVQSNYGKETNRIYRETFGLNHRGAWDSGVSTNNYIQFERTRNTRLNEGLAGGTEGIFDTKNEGFGTTKLDDFLAHSEISVPFELGVTQTATLGTEWNQQKMKDGSSTSQTLMGGTIPGQANGTRSPYASAHIFSLFAEDNMELTDSTMLTPGLRYDLHSEAGNNWSPSLNLSQELGDFFTLKMGIARAYKAPNLYQTNPNYLLYSKGQGCSSSDVKNGCYLLGNDDLKAETSVNKEVGLEFHNDGWLAGVTYFRNDYHNKIEAGNSRIGTSSTGTAIYQWENVPKAVVQGLEGTLNVPVSETVSWTNNATYMIENKNKTTGDYLSIIPEFTINSTLSWQATEELSMQSTLTWYGRQKPKKYNYQGKPVSGTETKEVSPYAVVGASATYDVTKNVSLTAGIDNLFDKRQFREGNSQNVGDPTTGAINIAGAGAATYNEPGRTYYMSVNTHF

SEQ ID NO: 11574 - protein, 738 aa, Bacteroides plebeius DSM 17135
MRYEVREPERSMMQGARVARFGRWRPSLYLGLLIAAHPAAAFADAAPAAGAEVRRDKAAAAQPAGSELKAIAVNASRGVADDPSVATVGKMPLALREIPQSVSVTTRERIDQQNLFSLDEVMQQSAGVTVQPYVLLTTAYFVRGFKVDSFEFDGVPVVIGDMASAPQDISVYERVEILRGANGLLHGSGNPAATVNLVRKRPQYQFSAHATASVGSWDRYRAEADIGGPLNAAGTVRSRLVAAYEDRHFFYDHAKQDTRSIYSVTEVDVTRDTLLTFGAQYQTTTSVPDMSGVPMARDGSSLGLSRSTFLDTAWGRFNWDTTRAFASIEQKLGAGWKAKVSGEYQSVRSDLKYAGSFGAIDPATGAGGRLTGAAYQFSSYSRSIDANVQGPVHAFGLTHDLLFGVTYANSSSGQMTAPLLGDVAGTPVNVYRWNPSSVPEPGIGPYQQSQQNDVSQKGVYGLGRIKLAEPLTLVLGGRMSWWNQDSLGAHYNTGHQFTPYGGLIWDFARDWSWYASYAEVFQPQTKSMWGGGILTPVKGRTYETGVKGELAGGKLDVSLAAFRIDLDNNPQVDLAHPCAGPSCYYVNGGSVRSQGFEFEANGRITPWWSVWASYTYDTMRYADNLANAGSFAPLLNPRHLFRLWTNYDLPWQERRWSIGGGVQVQSSYSAQANGVTMSQGGYALASVRLGYRYDKHWSAALNVNNLFDRTYYLSLSQPGWNNRYGEPRNVMLTVRGQF

SEQ ID NO: 11575 - protein, 1135 aa, Bacteroides plebeius DSM 17135
MFNLKFKCMRINDSCRGSKIFRALLILMLFALPAQSAIAQLTIRISNSSLGTVIKQIQSQSKYQFFYDDNLASMRIESLNVKDVSLVEVLDKALKGKNVVYKIDDNVVYLSKANASSSTKSTQQQQKVTGKVVDANNEPLIGVSVLEKGTTNGTITDFDGNYTLVVTGSNAVLQFSYVGYQTLERAVAGKTAINITLKEDAQVLDEVVVTALGIKRSEKALSYNVQQVNADAVTTNKDPNFINSLSGKVAGVNINASSSGVGGVSKVVMRGTKSIMQSSNALYVVDGVPMYSNANKVNGTEFSSKGNTEPIADINPEDIESMSVLTGAAAAALYGSDAANGAIIITTKKGKEGRVNITVNSNVEFNAPLVMPRFQTRYGTGIGGVKDDNSSRSWGPKLTEARYFGYNPRDDYFQTGVIGTESVSFSTGSEKNQTYASAAAVNSKGIVPNNKYDRYNFNVRNTTSFLDDKMTLDVNASYILQKDRNMVNQGTYNNPLVGAYLFPRGNDWEDIKMYERYDVARKIYTQYWPTGDGNMTMQNPYWVNYRNLRENKKDRYMLGASLNYQILDWLNVSGRVRLDNSNNDYTEKAYASTNTQLTELSDRGLYGISRSYEKQLYADFLVSVNKTFGEKWSLQANMGGSFTDMRYDEMAVRGPIADDSKTFAGEKAGLTNGFYIQNLSTTKTSKMQSGWREQTQSIYASAEVGYQSTYYLTLTGRNDWPSQLAGRNSVNKSFFYPSVGMSVVLSELMPKLNKDYLSYWKIRGSFASVGTAFERYIANPLFAWNTSIGQWSNLTDFPVYDLKPERTNSFEVGMNMRFLKNFELDVTYYNAKTMNQTFNPELPVGEYARIYIQTGAVRNQGLELALNYNNTWKDFTWNTGVTYSMNKNKILTLADNAINPITREKFSISSLNMGGLGSTRFILKEGGSMGDIYSLMDLKRDANGAVYIDENNSVVTESLEANNYIKLGSVLPKGNLAWRNNFSWKNINVAFLVSARLGGVVFSRTQAVLDNFGVSEASAAARDKGYVSVNGNDRVNPEGWYSVVAGGTAVPQYYIYSATNIRLQEASIGYTIPRKWLGNVCDIKVSLIGRNLWMIYNKAPFDPESVASTDNFYQGIDYFMMPSLRNIGFNLSFKF

SEQ ID NO: 11576 - protein, 397 aa, Bacteroides plebeius DSM 17135
MNKQLIAAPLLLSLAGVASAQSSVTLYGIVDAGVTYRSNERVGSPGAYTGHSEVGLTTGNLSGSRWGIKGSEDLGGGMRALFVLENGFDVTNGTSGQGGRQFGRQAFVGVGSTRYGTVTLGRQYTSLNDFVSPVAPSSFIGGFGAHPGDIDDLDQTARVDSSIKYTSANYAGFTFGALYGFGSQPGSMKQRNTWSVGAAYAAGPLRVGVGYERSDNSKTGATDPTAGKWQSTDDGLFNSSINEGYASAQSQQVIATGATYNFGPAVVGVNYSNIQYRSGAQSLFSGHATFNVAGVFTRWNVQPQTQLFVGYSYTRGSDVDGIDDRAQYHNVTLGAVYDLSKRTSVYLLGAYQRASGTTLDALGRPVAATAAASDKANGHSSDSRSQAIVSLGLRQKF

SEQ ID NO: 11577 - protein, 366 aa, Bacteroides plebeius DSM 17135
MDKMFKRTVIGAAVALASTGLMAKEVGVNSDFNVDVYGVAAMSVVNYNTTDNRDDSSGYVLENESRIGFRAHKEMFENFTVTMQIESGYVDSTDWGHGGVSGGVLGFRDTYIGASGDWGNVRVGRVLTPLYEIVDWPFSNPGLGAAFDWGGINAHYDRQSNQIRYDSPKFGGFSFAASVGRDDNDNGGGAATRDANFFGANARYSFEKITLLGAVESGTRVVAETGGDWELDNTGTAVQNPVVAGYDDDTFAYLVGFEASLPAGFGLAAAFKGEELDNGIRKHKQDSFSIVGQYWNGPLGIKIGYAANLDSKIDGVKQDDANNILSGQVMGVINGFVPYVRVAARSDFTSDKDTDIVTRVGLEYGF

SEQ ID NO: 11578 - protein, 292 aa, Bacteroides plebeius DSM 17135
MKKFLLTSAVLLSAGAPAFADDLSTAAAPGAYSWTGFYAGVHAGPTWQDRSAERGLVTGSVAPDFDYDANLNEGGPSGGVAEGSPLAAIFPSEFGSSEKVGMSGGVQAGYNQQYGRFALGFEADFTGLGSNGGDDGAVQGLTASNPAFGDAVFGTDLRVRSSMDYLATTRLRAGVVTDRFLVYGTGGAAVGNPEHQVDFSAGLTATGGTLVGPLDRSNSFSGRKDDWKGGWTAGAGGEFAFTDNMTLKAEYLYYDLGETHVGATSTSAPGFAAVYGFENRGQSARIALNRKF

SEQ ID NO: 11579 - protein, 723 aa, Bacteroides plebeius DSM 17135
MTSFMIRLSGGALLCLPVMVAQATGAEQAPRPQKEETLEVVASPFSDDGSTENTGSYTTSQMTTATGLPLSIKDTPQSVSVITRQQIDDINAYSLKDILRWSTGVSESNYDSERSSFNYRGFSVDNYQYDGVPTFFDSGYSGGESEIDSITLDHVEIVRGAAGLLNGVGNPGAAINLVRKKASSLSPFARVELSAGSWDHYRTTVDVGTPLNDEGTVRVRVAAAGERSHSFMDRHQERKGTIYGTLEADLSSDTLLRLGADYQQNRPKASTWGGALPTGWFSDGSEINWDRHYSGASDWSSWDTTLSTQFATLEHQFDNDWKGVANYTHSRQAFDAKMAMSLGGLIDPDTWAVEPSSPYAGRYEGYRDQHAVDLKLNGDFSLLGRNHKFVVGSSSAWQHSYSTYRSASASQLFSGSLLDWNGGLGEPEWSDKMPQMDYRTRQIGFYSSADFSLTDRLDLVLGARFNSFKNTTTTTANKVTPFVGTVYKLTDQVSAYASYTDIFKDQNLLDSSGHYLAPIEGVNKEVGIKAALLNDRLNLSLSAFRITQDNLGVLDEDTTNLDWLQQTYHESQGATSKGIEFELNGELAQGWNAQFGITHFSLKDKDKVDLNTEQPRTRINLFTTYQLTGALRDLTLGGGARWQSKVYANVSGADNGEMVQRKAEQGSYVLVDAMARYRLTPQTSVQLNLNNVFDQKYYSQVNFYSTRNYGEPRNFMLTLKHEF

SEQ ID NO: 11580 - protein, 400 aa, Bacteroides plebeius DSM 17135
MKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYMSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 11581 - protein, 208 aa, Bacteroides plebeius DSM 17135
MKLTIATTFLALVATSAFAADAVQDVPAAPVAAAPAFTWSGPYLGIDGGASWLNGDFSAGGASDSQDFNGGVFGAFAGYNFQFDNNIVVGIEGNLEYNWNEEEALGADVGTDWAGAVRGRVGYAFDRALLYGAAGWTATRGYVDLPGSDKETETFNGYTVGAGVDFAITNNIFARGEYRYNDFGEKDILGVDVDLNQHELKFGIGVKF

SEQ ID NO: 11582 - protein, 914 aa, Bacteroides plebeius DSM 17135
MKQRALALAIRRIVWAELALSAVIAVPAFAQSQPATTGTAAGATTTESTPATGAAATPSADGNTATPTGKGVQQLKKFEVTGSLIRTSDKVGNTEVQTITTKDIQQSGYTTVADFLRGTSANSGSSWGQTTMNSSAQGGGGIALRGLSEKYTLVLVDGQRVANYGKAVNFTDTFFDVNSIPLNMIDHIDIVKTGAVSVYGSDAIAGVVNIITKKDFQGLQIDGQLGKAQHPGDAQGNFSVLGGIGDLNGDRFNVTAAASYYRDTGSSLGDRDMTAGQDFSQFPGGLAGPLGPNQQSYWTTADGTNTALSPCPPGSVSANGASTCKSNPASATSLVPAITRLNAKVRGTFKINDDVQAYADFWVSRDETVQNEGPAVLSSQTNAFNPATGSALPLSRTVSGTNPYNPFGVPTQINYTFPNTVSADTVSTFWRALTGVKGSFTTAKFGDWDWSADYGHSQSTVDTTYGNALNVAGLENILQNGVFNFSNPSATPNGLNGVFQNDYEQAISKLDSVTAKTSTSNLFTLPGGPVGVGFGTEFRHESNIINSRTYSALGITAPANVQTVDGERNVAAVYYQVDIPIIHNLTFTQAGRYDHYSDFGGAFSPSFALRFQPVRAITAFASYSRGFRAPTLVENSQATYLAHQNLVDPNDPSGTPTKHFTTEQVNGNPALQPERTKNYNIGFQLSPDSSTDIGAAFYKIHIDGVIGTQDPNAVMDANNPSNVIRNPDGTVAYIKEQFVNLGSLDTDGFDMNFRKSVGTKYGTFTLAGDWAYVWHFKLNSPGAPTQDFAGNNLALLQPFGASNPRWKGNTSLSWDYRKLTTTLTWQYTGPYTNAVASEFGDGGTLSVASYSQFNLMATYRGFKNWTIYGGINNIFDRKPPFDVEWQATPDITGYDQSLYTNIGRFFQVGASYRF

SEQ ID NO: 11583 - protein, 177 aa, Bacteroides plebeius DSM 17135
MINIKKSGKDCRSLLKIGLKMKKTLLALVLASVSTTAAADSWIYAGAQVGSADYRGESSTVYGAHVGTGILPFIGVEMGAWNLGSYDYGSQSTDVTSVNFAIKPSIDFGPLHVYGKAGMHSWEADGYRKDDGVDPFFGLGVEYNIFPMFTVGAGYNNFTVGDENIDFASLNLTVHFL

SEQ ID NO: 11584 - protein, 809 aa, Bacteroides plebeius DSM 17135
MQRLLLFIFLTFITTATAVAQETGSVRGRITTSDGTIAEGVTVKFKGTTFAGMTNEDGEYSIRKVPYGTYTLVVSAVGLYPKEKQITIGKGVLVADFSLNENRSQLADVQISTNRKKFKVDKVSPSLRLQSPLIEVPQNIKVVTSRVLADQMVFDVVDGLTRNVSGTTRTGHWDAQYANISTRGTTIPAFRNGMNMKMPWGPLADDASTIERIEFVKGPSGFMMANGEPGGIYNIVTKKPTGENHSSVSLSGGGYNLGRAAVDLDGKLSKDGRLLYRLNLAAQSKGSFNKYNFNDRYIFAPVISYQIDSATTITAEYTHQHVTAQALGNYSFSAIGFKDVPPSFFLGDPALDPSKLSDHNITLYFNHRLDNNWKVNGQVAYVKYGLEGGSMWLSSIAKNGDMLRYYNLSEELAINKNAQMSIMGDAKTGSIIHRIMGGVDMGNLKTWGDFSPGNSDIRLAITPTNPTGIFNVYNPIYGIPTANIPIFDRSRSIQVRSGSNTYATNLTYTGVYLQDEIRMLEEKLRLTLAGRFTHSVTVGKTNATQISDNVFSPRVGLSYSITNDFSAYGLYDQSFLPVAGQNYAGEAFKPIRGNNIEFGLKKDLFDGKWNATVAAYKINKKNVLTADLDPEHLAINPNAQIQLGGIESKGIEVDIAGEVVKGLDVLLNYAFTDARVKKDANPLLIGRHVPNSVKHITNGWLSYRLKNANSVLNGFGLTGGYQLQFDRYAGSTASPMKLPAYVRFDAGASYEKGKITISALVNNLLDRRLLTQGSYTNLGSRETATSSSYYTYIYDMPRNARVTLTYRFQ

SEQ ID NO: 11585 - protein, 345 aa, Bacteroides plebeius DSM 17135
MKKNIIALAVASAIAAPVAMADAPTVYGQMQLSIDSISYKDTNGDKVQAKSGSQVNSYNSRVGVKGSADLGNGLKAIYKAEFKVNPDSKESFENRNQYVGLSGGFGTVLLGRHDTPYKMAQPKDLFNDARGDNKPMTGGLGILGNGGENRVSNALAYVSPSFGGVKLVGALVPKENSGDTTKESSMTDWVSVAAMYGSKKKGLYLTAAMDSANKALIGDGAGGSAAGDATQYRLAAQYAVAGLIANAMYQDVSGDGAKKEGSNIMLNVGYKMGNLMPKIKYSMNDYKDNAIKDSTGLGLGVDYALAKKTKVYAEYVSYDKTTYDRKNIGGKASDSAISVGLFHKF

SEQ ID NO: 11586 - protein, 709 aa, Bacteroides plebeius DSM 17135
MRNPLQKWGMLQSGTCLVALLLSSPSHAAKGKKEDPADLVITAKKDSDDYGQKRNTAAKIDIANRDLPQTVNTVSAQLMRDQMVLSQQDALKNVPGVSFSTGDGQRDQVFIRGFNAFGDEFVNGFRDDALYFRDMSNIENIEVLKGPSAALFGRGSAGGIVNRVTKQADTNITNVIFTGGSWNDYRGQWDFGRNSKRTGNGFRLTGAIENGDSYRDQQFVHRFAIAPSFMYGKGTDTVVTVQADYLKDRRIADLGNPSLNGRTINVDHPEIYYGSADAAKYDYTQSTVFSQTINAVHHFSDNLSLRDGFRHYDYKMFRGNTSPASGVVDGLVQLSHHPASRDENGWDNQLELTQKIDSGKIHQTLLYGFEVSRQSKLSTTYATYPGKNASAAEKASFYVDAYNPVLPTITGDDLTSITNQNRGIFYDYGLYIQDTVDFSHGFKLLAGIRWDSFSQTTLPLAGSASYAHRLDHTWSPRVGLTYEPDNHQSYYISWSKSYQPSGETLNIVAKQADLIPSATTSKEIGAKYNLWHDRLTIQIAGFIIKKTHIQATNPLDNSTMAIGTQRNEGAEFSATLDVGKDIHLIAGYAYLRTKNLASAVPAYVGKEGTLAPHNQGNFYITKSFGKHFGIGGGMNYVGNRWADPSNTVILPHYVTGDAMGWAQFGRYRFQINAYNLSNAHYVVSGHGTNANLNMPGAPLNFRGTISVSL

SEQ ID NO: 11587 - protein, 183 aa, Bacteroides plebeius DSM 17135
MLILIGWQIQVRQPSDYIMNKTEFYADLNRDFNALMAGETSFLATLANTSALLYERLTDINWAGFYLLEDDTLVLGPFQGKIACVRIPVGRGVCGTAVARNQVQRIEDVHVFDGHIACDAASNSEIVLPLVVKNQIIGVLDIDSTVFGRFTDEDEQGLRQLVAQLEKVLATTDYKKFFASVAG

SEQ ID NO: 11588 - protein, 726 aa, Bacteroides plebeius DSM 17135
MNHSNTRFRVAPLALALSATLSSTTFLTNAQAADPAAIIDAQSSVIEEVFIFADADEVRALPGSAALVSEEQFRIEFANDINQLLKTVPGTYIREEDGYGLRPNIGIRGATSERSSKITLMEDGVMIAPAPYSNPAAYYFPTAMRMHSAEVLKGAPLLRYGPQTTGGVINMVSTPIPDSVTGNLDLRVGQNGEQDLLANFGGRYGDFGYLVETAQRRSDGFKEIDRGNDSGYDIEDYLVKLSWTGERQSLLFKAQYSNEISDETYLGLTDADFANNEDRRYGLSSIDEMNNYHAGMNLRYGLQLGDDLALSVTAYQNNFSRDWFKLSGGNSFVRAANAGDLGAQAILDGEADVFGLGYKHNNRDYESRGVELNLDHSLGDHSLSYGIRLHEDEMDRYQPIDVYDQIDGELLLSGRIEPVGGDNRLEDAEAMSLWLIDSWQLSSALNLNLALRYEDVDSSRRQFSDPDRETDPSRRSNSSQEWLPGASFTYDLSDEWQALAGVHRGFSPLGGGAQEFEEPETSVNWEAGIRYRGSWFLEAIAFYSDFDNKTENCSNANPCSNGATAGAFTTGQAVIQGLELQASTVLNFGNINAPVDLAYTYTDAVISRDNPEEGFSDGDTLAAVPENTLSLRLGLETAMNWDSYAVIKYIDETCVTIGCNTDSNPFNRTEDLLVTDLISRYALTDDAVVFVKFENVFDERSIVSRQPEGARPNKPRTASVGLQYQF

SEQ ID NO: 11589 - protein, 1050 aa, Bacteroides plebeius DSM 17135
MKKLLCNLPRFVLWIAFLLIIESYVTLQAQTSSSNNSSKAISGKIVDETDLPIAGATVQVKGSTKGAISDIDGLFTISSEPGSILIFSFLGYQSIEYKIDKVPQTIKLLPKVDELDEVTVVGFAKQKKESVIGAISTLKPERLKIPTSNLTQALGGNVAGIISYQLSGEPGNDNVEFFIRGVTTFGYSKSPLILIDNIESSTTDLSRLSADDIAAFSIMKDATATAIYGARGANGVILITTKQGKPGKVKISARVEGSLSAPTKRIDMVDPISYMKYHNEAVLTRNPLAVRPHTDEKIASTKAGKNPYVYPAVDWYNELFNDNVFNSRANINMSGGSETARYYVSLGISDDNGIMKVDKRNNYNSNIDLKKIYVRSNIDIDVTKTTTFSVKFSGNFDDYTGPIVSGNDLYRRAMATSPVLFPKYYMPDENHTSTSHILFGNAGDGNYINPYAEMIRGYKQYTNSVISAQAELNQKLDFITPGLSIKVFASTTRNSYSGQQRSTSPFYYSISYYDKLTDTYTLRELNPNGGREDLDYTAEGNQVSSSYYYEASLNYNRTFREKHNITGLLVGVLRENKSGGASSIQTSLPARNIGLSGRFTYAYDGRYFAEANFGYNGSERFAKNERFGLFPSIGAGWMISEEKFWNQDLKNIINKLKLKGTYGLVGNDNIGAWNDRFFYMSEVNLNGSGANFSWGQDFERNVGTIDMIRYRNDKIKWEIAQKMNLGLEVGLFNIFDIQFDYFTEYRKNIFGERQTIPYEMGFSAPLFANKGEASSHGFEVQVDANHAFNKNFWLGVRGNFTYATGKYEYVEEPYRPYPWLSHIGKRIEQSYGLVAERLFIDEEDIANSPVQTYGEYMPGDIKYKDINNDGIINDEDIVPIGFAKSPEIVYGFGVSMGYKNFDISCFFQGAARSSFFINSKATNPFMQMDLGGNNLNGMMQAYADDYWSESNRNIYATFPRLSTTDIANNNRNSTWWLRDGSYLRLKSVEIGYTLPKRLTSHLGMSNLRIYASGLNLFAWNRFKLWDVEQGNDGMQYPIQAVYNFGINLSF

SEQ ID NO: 11590 - protein, 123 aa, Bacteroides plebeius DSM 17135
MKSKVLALLIPALLGAGAAHAAEVYNKDGNKLDLYGKVDGLHYFSDNSAKDGDQSYARLGFKGETQINDQLTGYGQWEYNIQANNTESSKNQSWTRLAFAGLKFSDYGSFDYGRNYGLDRYAA

SEQ ID NO: 11591 - protein, 706 aa, Bacteroides plebeius DSM 17135
MKSKILLSAAALNLLFAVEILAKEAALGTIDVVGEMRHDERDYSAKELVKGTTRLNLTARQTPQSVDVITEAKLKDMDIKDYQTLLANIPGVTLNRMDETIRPMSRGFFIDYYLIDSMPSLGGFGLEATDMSMIAYDRVEVVRGANGLLAGAGNPAASLNFIRKRADSKELTGSLGVEAGSYDKYGVYGDVQTPITADGDVRARLAFIKEKAGSYMDFHKRENLSLYGVVDSDIGDSSWLSLGASYQDLKRRGIRYGGMPAFYTDDSLVKFFRKRIFSQPWTKWDIKTLDLYADFRHYIGEDASVNLSYSYKKVKSDIKMLYYGGKVNPDMTGDSNDVLIWGSKNDSDIHNLDTYANLPYELFGLGHEFVLGAMYNDFNEGSYRLTNFDDYKATPAGMAYLADMKVDFNNLHIDDVDMPYVDQKNPSKTKQRAVYFANKLSLSDELKFLVGTRVSYYKRNQTVGNVDQKFTHQITPYVGLTYDVGQNHTLYASYTSIFKPQDVKNINGKYLDPIEGKDYELGIKGEYFDGALQASFGVFKIIQDNVGEATGEQIGSTGEDAYKAVKGATSKGFELDLNGRATDNLTLSFGLAHFQAKDASGKKFNTNAARTSADLFAKYEFRDFRVGAGLGYKSKTYIYNADNDVTITQKPYMLADLMFGYKIGKNFDIQLNIDNVFDKKYYEGIGSDEMIYGDARTFNLSFTYNF

SEQ ID NO: 11592 - protein, 886 aa, Bacteroides plebeius DSM 17135
MKNIRNILIILFIQPTKKFIKSETLNILQFNKLFPPGRNEPSLMLLKRISFLFFIFITTPIFAEVSFRARVFSRSKSLGDANVSVRISETKKFYQTDSEGYFQAVVPSSGTYTFRILRDVGFQEIRQEIGEGEALVILYTDESTKSSESIPKGTINVTGEKEKQLMSRTKLRFEEIKRMPGTFGEPLRSIETIPGVVPVAAFGGGANNYSFRGADPNTNLYLYDDLPILYPFHFDGLTATINGNLIKSMDVYTGVLPANFNNALGGVIEIESPDKVERSSGNFLTSLWAASANYQTTFANGKGYILGAVKVGYIDKTFETLGTLAGGSLLPEGVRLPRYTDSQVKMVYNFNDEHQISFYSLTAKDDFALDPPAKRQNDPTKDELAGFAGGNLSAGQGYRTQAFRYTWRPSEKFNNRITLISYDPFVDFNVSFGSIKAKQRGSGAYNGVRQDASWEPNKHFTLEFGSELRFLNYKTTGSTIQQTDPNNPDPNPYDTTSPDFKTVPDTNRVQSKYYNAYTTMKIKFGGLLIEPGARYDYIPYIKNGALGPKAQISYKFEQGILKGTTVFGGAGNHFNFPLDTRFSEQSGNPHLKFQKAFKYGGGIDHQVTSEWQIKGEVFKQEFSNLIVTDPYITEAIGTNPDQYGRITQPYILNKPLSYSNNGTGHSRGYELVIRKTAAPGKRDWFGWISYTWSQTFRNPNIYKPDAIMTQVATGSEQRLVAQTFPNSKETLYDYDRTHIINLIFGWRFSQDWQFGARWSYMTSTPITPIVGDDGGKFSNPANNQTIWIPVSGNNPYLAEYTNSKRLKDYHRFDIRIDKFLNYEWGYVNTFLEIINVYMRENVSGENFDVTRPYSATNPKPNPTFGTLTLPGGAIIPFFNMGIEVKF

SEQ ID NO: 11593 - protein, 384 aa, Bacteroides plebeius DSM 17135
MKNIRFACATAGVLAATAAHAQSSVTLYGLIDTGIMYTNNVASGNSHGGLVQATTGAVNGSRFGVRGTEDLGGGLKALFVLENGFNAENGKLGQDGRLFGRFAYVGLSDNRFGTLTIGRQYDSLVDFVAPLSATAGTFGDASFAHPFDNDNLNHSLRINNAIKYTSNTYAGLKFGGMYAMSNSTDFATNRAYSFGASYTRGPLNVAAGYLQINGSKGTTAGSPGAVDIVESAANGKGGFSLGADRMRSYGGGLNYAFGPATLGFVYTRAEYENTASFGSTGGTVRFNNYELNGKYQLTPAFSVGGAYTYTDGHVENTVKYGSDPKWHQVDLMAVYRLSVRTDVYLEGMYQHASGRNYVAMINTAGGASSTGNQVVAAVGLRTRF

SEQ ID NO: 11594 - protein, 998 aa, Bacteroides plebeius DSM 17135
MLNVQLKRKRTFAQSMLFVVFLLSSTLAFAQNKVTGTVTDKSGEPLIGVNVLEAGTTNGCITDVDGKYSLNVERGETLIFSFIGYNKQEVKVTQNIIDVTMSEDTELLDEVVVIGYGSMSRKDVTSSITTVKADKLNVGVFSDAASMLQGKVAGLTITSSADPNGSPSITLRGASSLREGAAMSPYYVIDGIPGVDISMVAPDDIESIDVLRDATATAIYGSKAANGVIIINTKKGKNGMERTNVSYSGYVAFDNILKKMDMATADDLRAYAKKNGLTLANDQGANTNWQDEVLRTAISTNHNISINGGAQKTTYMASLNYMDRQGVVKGSKMNRLNVRSLVTTKVLKDHLDLSVGVNARYGKAVGVPMNNEGASVLDAMNYFSPTLPVKNEDGSWTKGSGSKNYNPLSLINEDTSETIFKNTQVIGKATLKVIEGLNWNANYSFTNNQRTYSSYDTHNTQLEGVSAYNGRATRSTYFGHEHSFETYGNYDTTIANVHKLSLMAGYSWEEKMSNDGFGLTVHDFYDDVLKWNQLTYASTIDGIPAVESGTKETIRNISFYGRASYSYNSKYMIQATIRRDGSSVFGKDHQWGTFPSVSVAWNITEEGFMKNQNLFSNLKLRIGYGVSGNALGFGAYTAVATYGASGFFNYNGKDWRTLAATKNANPDLKWESTGMLNVGIDYALFNGRINGTIEVYNKKTKDLIWDYPVSTNIYPFGTIAANVGKITNKGIEFSINATPVQTEDFTWNTTLNLSHNKNTVDKLSNDKYQVGTFTQGDPMVAGVSSNGYTQRIIEGEALGTFYTYEFAGYKDGKATYYVRDEKTGERTGETTSEPAFKDRTITGCAQPKLNLGWNNSFNYKNWNATIFITGVFGNKIYNGARANYTSPEMFANGKNVLKEFITDRPATDTGGNVPSDRFIENGSYLRLSNLTLGYTFKNLDGWLQNVQLYVTCNNLFTITGYKGLDPEVNMGGLAPGVDYRWSTYPHSRTTMVGLKVNF

SEQ ID NO: 11595 - protein, 1039 aa, Bacteroides plebeius DSM 17135
MKENSFKRNRKVLTALLLCTGFIAAQPLAVMAEDSVTSVHAVQQQKQTVTGIIKDATGEAIIGASVLEKGTSNGTITDLDGKFTLSVTPNATLVISYIGYQTQELPVVAGKVMDIQMKEDAEMLDEVVVVGYGTTKRKNFTGSVSTVKASETPLALMPTSNAMDILRGTATGITVSQQQGAGQAPSLQVRGQKSVNGGSTPLIVMDGVIYMGSFRDIDPTTIESMSILKDATSLAAYGSQAANGVIMITTKKGKLGKPVINVNTSWAFSTAAAKPDLLSPEDYVKKVNLLSGLAEDADPTWMREFEYENYKNGNTIDWYDYCTRTGLMQNYSASVSGATEKINYYLSGTYTDQQGVVKGDDYDRTALTARLQSDITDWLQLGGQVNYTYNDYSGASVYDLYQAIRLSPYGRAERADGGGLEKFPCNEGIYRINPMWNVESGTIDDHDTYATTSMKGHVLVKCPWVEGLTYRLNGSYSVENIERDYFTHEGYYVKEGSSDDRYSASTVANYLASANGYSARTKNTSWVLDNIVNWQRQFGKHYVDLTYVYTRDSYEYSYRRFDGSDFAALGNTNLSYDGLNLATTQKINGLNYTRHTNVGYLGRANYNYNDTYHLSISVRRDGSSVFGANHKWGTFPAVGLAWTASNEAFMKNIKAISYLKLKASWGKNGNQSLSPYETLSKITLGQSGGYSYPFGNTSLVSWGQRITSMGNSDLGWEETESFNYGFDLGLIDNRIRLEFDGYFSKTTNQIFNRNIPVMINGLTSMKATMGQVNNWGIEVNLNTTNIQTKDFNWGSTLTFYMNRNKLKELYGDGQDDITNSLFLGKSLGAIYGYKNIGIVQEEDTEYMAANGAEPGDVKFANLDGSEDGKITADDRTILGYKKENFRMSFGNTFRYKDFELYMLFTGIFGGNGYGQAVNYYAFRTSSDVQGDNNFNHGWWTPENKSNKYPRINYTDGRYTPLQGYGFVRLQDLSLSYTFRQPWVQKAGIGNLKVYMACKNLFTISGWEGGDPEVQQTLGSGYTYGYPLSRTVSFGLNLTF

SEQ ID NO: 11596 - protein, 220 aa, Bacteroides plebeius DSM 17135
MAVERPSRPAEKPERGVKTKERTKEMKKHILTMTVAIAALGTAASAGSLDVTPVEPAPMTPVEVVPAAPVGNWTGGYTGLSLGGAQASSGGSEESGMIYGLHGGYDYQFGNGIVLGGEAEFQGNNDLSVNGFDVDNVSRAKARMGYDLGQALVYGTAGVSKVNTSIGEATSPVYGLGMEYKVTDKFSVGAEYLNEDFQDLGSTNTDLQQDSLSLRGNFRF

SEQ ID NO: 11597 - protein, 888 aa, Bacteroides plebeius DSM 17135
MIRSKNSSARCAGAVAILAFAALASSQAAQAAEPAAAPVAEPAETADTVDTIVVTSYGKSLQAAAALKRSAAYGLDAINAEDIGKFPTRNAAEALQLVTGVTIDRQRGAGLYVSVRGLGPQFQYVELNGRSIAVNELIENGGAKGRQFRFEVLPAELISQIEVVKTPTADMDEGALGGNINIKTFKPLDVGDKAAFSIRETYGDVRKKADPSASGLLSWTNADNTLGLLASGLYDERHVRNDRLYQVGWNLNKFTSTLGAGRYTPSRTRPTIETEHRKLYSGAVTGQWRPNSDFQTDVDVLVTRLDVDYDEFGLDIYPDDTTFQKPIFVAGSEKLIGDTVVGGTINNVRWMASRETSLNRHDLTAVGLKQAWTPGAWTFNGEYAYSRARSYHPDGEATKRNRLAFFGPLTYDFSRGYKSIPQLTTTVDYTNPANFVGQAFDYTWKDSRDTDETIRADGGRVFDGWFSKIAFGAERHNLKRDYRRRDWVLNNDLNVPTSTLGSAYYEPLPYSGFLKDFDGNTPRNWVTPTRDAFYNALFTPTVAGQPISAADARNSFVVDQHITSAYVRGDFAFATAMPISGNVGVRYARTEQVASGTLTSTDASNNPVLTPVSYKQDYGNWLPSLNVKIELRDDLIGRFAASRVVNRPNVTDSAPRISVARDTPSASGGNPDLKPFLADQLDASLEWYPAPTTALTGAVFYKKMDNYITQQNTTIQVPGRGDVLLSTSVNGGDAKLTGVEVAYNQSLAFLPGPFDGLGVQASVTLVDSKASYFAGNRQIKDDLIGLSKTSYNLVGYYEKGPLAARLGWFWRSRYLSGTGSTTTAESYIDAYGSLDGSISYDLTKNYALTLEGSNLTDEIRYVYGKTKDQPMETYHWGRTVSLTLRGKF

SEQ ID NO: 11598 - protein, 875 aa, Bacteroides plebeius DSM 17135
MHKHRVRPARAPKLNQIAALLTSSAFAVLLAGPVQAQGPVAAEDKAAEATQADAAKAEASAATGAAGAAVAGKRDKGDVVGLDRVVVTGTSQKKSKMRSSVSVTDVDQQQVADFGARSEADVLHLIPGIRAESSAGPGGNSNITVRGLPISSGGSKFVQLQEDGLPVVEFGDMNFGNNDYFIRFDNNVDSIQTLRGGSAATFASHAPGAVINYISKTGKEKGGSIGLTRGLNFDETRVDGDYGGKLSPNLRFHIGGYFRDGEGPRANDTHALRGHQIKGNLTNAFNGDKGYLRVSFKSLDESAPTYTSMPARASLSGNTVTGMSSINGFDIRKDSQLSIYNTSMPTIGPVGTSTGMADVSRGITVKSKTVGLEFHNELPTGFTIDNKFKISRTSSAFQTQFWGANTLGGMLGNFGAGSSAVYFNGPKAGQAVTDTNLQTGLVSQSAAINQQSPDMGHYANDLSLSKAFELSGNKLNTKLGYYRSNQDIVQEWQISERLMEIGRNGALIDVRDAAGAMLTTAGLTGYNNQWGGCCARSVNAHYTTDAPYLSLALESGPVDLEASLRHDMVRATGSYAGGKQVAGGLDVNRDGVIDGAERNVWLVDTSNPSPINYKVNYTSYSLGANYRLSNDTSTFARVSKGGRAIADRLLFSPFVNSVTGALMAGLEAQAVATVKQREIGVKHRGSRDWGSYGLFATLFTATVDEYDYDQTRTIGPKLNVVGTRARGLELESALSIGNFAINANAVYTDLKITKDLVGTAQGASTVGKVPGGVPTVLYSISPRYTFGPVTTGASIFGQTSVWNNTFNTTKVAGRYIVNAFVGYEMAENTTLTLNASNLFDKVASSGGVGGPNAQNIVELRPETGRSFTASIRHAF

SEQ ID NO: 11599 - protein, 774 aa, Bacteroides plebeius DSM 17135
MHKIGKALLLLCSLTSAGEIAAQTVSGKLIDENKQPLPYANVVLLTLPDSTFVTGTVTAEDGTFSLNTTTPNQLVRISSIGYNTVYKPVQPANLGVIQLTSDTQQLGEVVVKADLPKMQLKGDAMITTITGSVLEKAGTGEDLLNKIPGVSAEDEEVNVFGSGTAEIYINGRKVRDNSEIDQLSSEQIKRVEVVKNPGARYDASVKAVIRIITKKAAGEGFGFNNRFVTRHRRTYGWTTFDQFNFNYRKGGFDLSGTLFGGRFRNGNNQQIGMKTYLDKLWEQKMDASYGKNSNSNVQGVLSLNYQFNEKHSMGVRYDMDKYFNSTGDWRYTANIYADQELYENNASTMIGEDPSTRHSLNYYYNGQIGDWNIDFNADGLWNVKEESQHTREITNGETENDVNTFNKNNGTLYATKLIVSYPLWKGNLSFGGEYSHTSRTNLYHNQEGILDNDDSKIKEGSTAAFMDYSHSFGKVDVQAGVRYENVKFDYYEQGKHIDEQSRTFNNVFPSVNINFPIGKTQIQLSYSGGITRPSYDMLRGNIYYGNRYTYQTGNPFLKPIINQDLIFSASYKWVNFSFTYNRTKDDIIQVCEPYSEADPTISLLKTVNTEPYNNIISAITLSPTIGWWSPQLTAQVFKQWFHTQGPDGKLTLNKPRTIIVWRNSITLPAGFLFDVDGTYYTKGHSQNMYMGINSLDVSMGLYKSFFKERLSFQLQVTNLLEKDDVDCTIYSGIKTMTDYITNFRRISLTMRYKFNATKSKYKGTGAGESQKNRM

SEQ ID NO: 11600 - protein, 384 aa, Bacteroides plebeius DSM 17135
MKHKLCAVAVLGALSAWNGAAHAANNVTLYGVIDAPIEYVNRVATSAASPNTGASRIGMPSIGGLSASRWGMRGTEDLGSGLQATFVLEGAFMPDTGTMPSSGLFGRIATVGLKKNDLGQITFGRQTTSLLDGLVNFSPLRFAATYEPGIWWMGVNYRESNMAKYTGQFGNVLAVAHYSFGTGVPALSSGNLLANGGAGEDPAHGKDNTAYGASVMYLDNQFGLGIGYDQWNPALTPGQTAKVRKASIGGSYATGPFKLSAGYRWNKADFPNGNTFLRDDYYWAGVNYQVTPALGLSLAYFYADVKKTAATPTAASSNPPNMQQYTFLADYNFSKRTDVYFSVGYARNGSLSFDSAATAYAFNYPSMAGQKGMLGVITGIRHIF

SEQ ID NO: 11601 - protein, 422 aa, Bacteroides plebeius DSM 17135
MYQSIRRSGVFICLASGLAATGVAQATNGYQLIGIGAYQKSLGGAVTANPGSAMTAITNPAGMARIGKRADFSMEAFMPERSVDFTATGGETGKSSVDLYGIPAIGWTAPVNGRDDLWFGGGMYGTSGMGVDYAQTEVMPGLSFDGYSNVMLWQMAPTLAWQVDDRLTLGASLNINYQSVAFKQRFINALGDVENNFDLSRSSSAFGIGASFGLLFDVNDRLTLGAAYKSKQVFGDHAYNLAQGDIDMSMMGGGPLPAGTYKLGLDFPQQLALGLAYRAIPAVTVSADVKWINWSDTMDKLAVTGPGGISVPMDPGWDDQTVYALGVDWAVNNRLNLRAGFNYGKSPIGNEDVSRNLILPAVVETHYTLGAGYNMDGNWELAFHYMYVPEKTFQAPATDPMLPGSKISLSEQSFGVNLGYRF

SEQ ID NO: 11602 - protein, 940 aa, Bacteroides plebeius DSM 17135
MKRRILRLILFLAMSIFDDVYAKEFVVSESSDNVPGSLRAAIDGINASSDVDNVITFATPTVTVSSALPTLVNPVMFVVPASGVSVVGSGLINGTALFAASESSLGGLVNGMVVSASGGSKIAAIKNATGAVHISGDMAAALTTTTTSSWYSYGIHAGDGSITVDGNLSGSITATAKTNYAYGLRAVGAATIGGDLSGTIAVTAGTGYRAYGISSDNATTIGGSLSGAITAVAGSYSAYGIKASALYVGTDISGAVTSTAGTYDACGLTLGGSLTVGGDISGTISASALDGDKAYAIKTKSAISIGGEVSGTLTATASGSDAAGLYCFDSSIHGATSSDPARISGSINAVSSGASAAVMAWTEMNLYVTGTLYAEGASAYAIRSGMFNGTGGFTDNTTERVDTVVLASGAVLTGGVYLGDGDDTLMLSGTADIQSVPSLDGGTGDDRLVFSGWSGSFSDAMQGWEHLDVGSGSSLGMDALGSFSGEVSVLEGAVLRPGAAGGRDRIAGSLLNLGLIELRDGNAHGVLTVDGSYTGGGVVGMDVGAGSADLLSVSGAVSGTTTLLLSIAPSVTELAAAEPSLLIHTDTAAAADAFVVQDATDYGPYVAGVMVVAEATGSADWYYGVSGLHDDALTAQALMPVIAGPLEDFVPRFSDRKAYGGSSGVMPGFGGGWTRAGESWSRTVLSGDAGTLTDGTSRFVQLGWDLWYALGAKSYRGAGVFGGTGTQSASVVSTGGRPAGGVEGTNYSGGIYAFLVRPRSYRLEVAAVFGYHELSLNYEMSSPEHLATGSRMVSAEGELQLGLGEGLALSPRLQAVWRHVDGFGLAPLSTGPLMVEDEDGLIGLAGLGLTLNTDCPGWYLVAEATVRVDGSPTNAVRYPLPAVTLSTEAEAVLWGGSLTVGNRAGGMLDPVYWLKAGALGSAGSMESYRLSLEAGVKVPF

SEQ ID NO: 11603 - protein, 1042 aa, Bacteroides plebeius DSM 17135
MKRKLMLLLTCLFVGIGLVTAQITKVTGTVISEEDGLPVVGASILVKGTTVGTVTDMDGKFTLSNVPSSAKTLVVSFIGMATQEVAIRQTVNITLKSDTEMLDDVVVVAYGTAKKSSFTGSATAVSGEKIAKMQVSSVSKALEGAAAGVQVINTSGQPGENAKIRIRGIGSFSASSAPLYVVDGMPYDEESVNALNPADIESMSILKDAASASLYGSRAANGVVMITTKKGMVDKSKVTLDARWGVNTRGVPEYDIMKDQREYVLTAWNTLKNQSTGAEASEGLIGSIGYNPFIGVANNAMVSADGVVSSAALRHNDDWADAALHNGMRQEYNLSLQGGNAKTTHFLSLGYLKDEGILRHTDFERISARANINHTVNKFIDINGNLAYARAEKNAGQSQNASLSNYSNAFMFTQQIAPIYPVYAYDENGNRIYDEEGNTVYDFGDGTYSTRMGGFSNQNVAANSGLDVHQTLNDNFNGRGTININIIDGLKATANIGYDLMNQIRTDHMNQLYGDAANVNGRTYKYNQRIESFTANQLLTYSKAFGHHNIDIMAGHESYSYTLKYQYTHKYNFYTIGNPEFNNAITMSDMNSYTQEHSMESFFGRVNYDFDNKYYLSASIRSDESSKFHPDHRRGTFWSVGGSWRLTQEEFLKDVEWLSNLKLKASYGTQGNDGILDINGYVVYQPYLKQYSVTNNNGDFSVVETYRGNKDLTWEKSKNLNIGLEAAFLNNRLKLETEYFLKKTSDMLYNMPYPISSGISYVPMNLLDMQNKGIEFTISATPIQTKDFIWNLSFNGTHYSNKILNLPEDKRENGIIHGTASLFRLMEGGSIYDLYTYEYAGVNPETGAAQWYMDEKDANGKVTGRTVTEDYTQASKYELGSTLPDFQGGFSTDFAYKGIDLSIATNFQIGGKIYDSMYSSFMHAGSNIGSNWHKDILNAWTPENKNTNVPIMDGAQNSNSQSSRFLINASFFNIRNISLGYTFPKEWMKAISASSARIYVSADNVALFSKRKGMDPRQYAYGYSAANYSAIRTLSFGINLNF

SEQ ID NO: 11604 - protein, 941 aa, Bacteroides plebeius DSM 17135
MQSPIARQLGSLLPQQAHPVARVHKRLTSRLSALSLAMVLAGLSHNALAIGKLEGQIRDNSSQQPLAGATVTLKELNLSQQAGRDGRFFFVGVHDGDYTLVVNYLGAMPTEHRISIRDKQTTLQDINLNSQDVEHIRVVGQQGALSKSMNRQRGADNVLSVVSADVLGNFPDSNISESLQRVPGLSIERDQGEGRFVRVRGMAPDYNSVSMNGTRLPSPESDRRAVALDVVPSDLLQSVEVSKTLTPDMDADALGGAIEVKSLSAFDRDDTYLNLNAEASQDTLTDNTNPKLAASYSDIFADKLGVAIGASWYNRDFGSDNVETGGKWEFAGDNGFEDAALESVDARDYEINRERLGIGVNFDYRPSDDTDLYLRTLYSEFDDTETRNSAKTKWKSPQQENALGQGKTTRSLKSRTENQNITSFVLGGQTRFERWTFDYQASHSTASADKPRDIAGADFVAKIDNTGFSNTKQPQIIAPEDYYQNDNFELDEIEIAASKAEDTINSGQLDLTRQLTIADYSVELKTGVKLSRRDKSNREDIWIYSDLGDQGVSDEDLLLSQYAGNELDYDLGRFGSGINAAPLWQLIDSLDADSNRDDIESTINDFDISEDINAAYLMGHIDIDKLRILTGLRFEQNQWDSSGYGYDGAKGEFIDIKHSRDEDHWLPALHLTYRYSDNTVLRAAWTNTLVRPTFGQLAPGYLLEEDDGDIDLTFGNPQLKSLESMNFDLSLEHYFGNIGLISAGLFYKDIDNFIYQADLAGRGDYIDAHSAVTFVNGDSADIYGVELSYVQEFNFLPEPFNALVLNSNLTYTDSSAKINWQEDGQLLSRDIPMPSQSDLTANLSLGYENSYASVWLSAAYKSEYLQEVTELSDERYDLYQDNHLQWDFVAKAHLTSNLTLYFKGVNLTDEPYYSYTGDSSYNAQYEAYGRTFQLGVQYTNY

SEQ ID NO: 11605 - protein, 450 aa, Bacteroides plebeius DSM 17135
MEIKMIKRFCFLSILGISSSAATTGHAAGFALIEQSASGFGNAYAGMAARADDASVQFFNPASLSWLPPGRQIIVGGSAILPSAKLRNVNSTHRSTGTPIPGNDGGDAASLELVPNFYFANDLGDNLKFGLGVTVPYGLTSDYDSGWKGRYQALKSEVMTLDINPAFSFKANEKLSIGGGISVQYIRAELTNALDSSALCQANPALPAGTCNALGLGQIGNPAVDSYSKMQGDDISWGFNLGVIFKPWDGTTLGASYRSHIKHKLEGKAKFRPVAPLAATLRNSDISTSLSLPETASFSIAQRLNDRVELLADVTWTNWSRFQELRIHFDNGLGDNVTTTKWNDSYRFSLGGNYRYSDRLTLRAGVAYDQTPVPDAAHRTPRIPDADRTWFAVGASWKLDAANTLDFGYAYLRLKDTSTRHVSEGAVSHVLEGDFTSKVNILSAQWVYSF

SEQ ID NO: 11606 - protein, 705 aa, Bacteroides plebeius DSM 17135
MFNFFSKNPCTAPVQPDFPRHRVGQACAVFLVLAAAAPISHAQETTNQALSEVVISASRAEQRRFDAPGAIDAVQVDPFRTASPLVNLSELMGGVAGLQIRDRQNFAQDLQLSVRGFGTRSTFGVRGVRILIDGIPATMPDGQGQAATASLMSAKRIELLRGPLAQLYGNAAGGVLQVFTKDPPVTPGKPDYSLSAGAGSDGQRHVAAGIAGGSETLGGLLDVSRYSTDGFRDHSAARREQLNAKVVAKPSADTTLTGIVNLFNQPLAEDPLGLTHAQFNQNPRQVIANALAFNTRKTIEQNQAGLVVEHKLSASDTLNARVYGGTRKVDQKLAFQANGVVNLDRTYGGVGASWTHAMQVNQLPVRWTVGVEADQLRETRKGFDNIAGNNGALRRNEDDTARNTDVFGQIDWTFTPDWQAIAGVRASRVRFGVDDRFNPAASSTSGSVQYRNTSPVVGLVWHAADTLNVYANLGTGFETPTLAESAYRPGGAPGPNFALKPSKSTQGEIGVKLRSGLHSFDAALFEARSKDEIVSSQSSGGRAIFQNADRTTRRGLEASWSANWAGGLDTRLAYTLLDARFKSPYAGAQGLVPVGNRLPGAPRHSLFADVQASITDSVRAGLEMRLESKTYVNDLNSDAAPGYAVFNARLSREFRFNGAKMLLYGRIDNLFDKTYAGSLIVNDTNARFFEAAPGRRLFVGVRSMF

SEQ ID NO: 11607 - protein, 1065 aa, Bacteroides plebeius DSM 17135
MKRKLMLLMTFLMIGIGLVNAQVSKVTGTVTSEEDGLPVVGASVLVKGTTVGTVTDIDGNFTINNVPSPAKTLVVSFIGLESQEVTIKPTVKVVLRSDAEQLDEVVVTAMGIKRSEKALGYSATSVNGEKISASRTSDVMSSLAGKVAGVQISATSSDPGASNSVIIRGVSSLSGSNQPLYVVDGVPLDNSSVSSSDGLNSGFDFGNGANAVNPDDVENMTILKGAAATALYGSRAANGVVMITTKSGKKGKGLGIEYNGGVQWSSVLRMPEMQNEFGMGWSGSHTTLENGSWGPRFDGSMQLYGNVYNNSQKIKPYVAVEDNMKNFFDTGFRYNNSLSFNGATDKSTYFVSFSQISDDGIIPTDADSYNKYTFSGRGSHKIGNLTFSTSLNYAYQDNKFATTGQGLSMANSLWQTPRDINVESLADLNDPFNTPGYYYTPYGVMNPYYILEHNLNTYNSERFYGKFQLDYDFLKYFKFTYRMGLDSTTGQTEYGTENLYALYYEGTPNGEGMGASSPFAGQYGEYSIMTTRRREINQDFLLSFDMPINDFHVNALVGFNGNERKYSYQKSAVNNLTIPTWFNLSNSSQTPTVTQYSELRRLMGVFGQFEGSWKNMLYLTVTARNDWSSTLPKGNRDFFYPGVTGSFIFSELLNDEIKDIITFGKVRASWGKTGNDADVYMLSPVYGSAQYSIPFGYLKFPLGGVNSYTLGNILGSNTLSPEMTTEYEFGLNMAFFNNRLSFDAAYYNRNSDKQIMSLSMDPATGYGSQNINLGKISNKGVELLVSGTPIQTRDFSWDVTVNFTKNWSKVVSLPEELGGETVIYGLNGSTSMYAIVGQPLGVFKAEAVERDPQGRIVADANTGLPVAAAEFATYGDMNNRYQMGVSTTLTYKGVSLSADFDIRQGGIMYSKTKNTLYFTGNAIQTAYNDRNTFIIPNSVNKVTNADGSISYVENTTPVSSADICNYYYDPMGGIGGEIDLIDKSYVKLRTVVLSWDLPKKWLAKTPLQGVRISAYGNNLFIWTPSSNTFIDPETTSFGNDLSGNYGEYSSNPTSRNFGINLNVKF

SEQ ID NO: 11608 - protein, 702 aa, Bacteroides plebeius DSM 17135
MDNRTPQRRRPAAPRLLHLSLAASLAAGAAQAQTATEATTLPAVQVTGRGKTATGPVDGYAATRSATATKTDTPLSETPQAVTVIPREQIIDQGAQNVQDTMNYAAGVRPNAYGVDNRGDYVRVRGVEPVQYLDGLKQFFNYNNPRTEVYGLERVEVLRGPASMLYGQGSTGGVVNLVSKQPQPEAMREIGVTVGNHNRKEIQADLTGPLTEDGTWLYRVVALGRDSDTQVQYTKDDRMMVAPSLTWQPSAATSLTLQAYWQKDKSGTTQAFLPWSGTVSGNPNGRIPTRRFTSEPGFDRYDTEQFSVGWQFEHKFNDNWKVRQNLRHTSSKVDYSTLYPAVYGNPDNPFIDADQRVVNRYLYIKNPRMRSLLADQNLEGKVNWGRAEHTLLMGVDYSRYRETGETGSGFGAPLDLYQPVYGTLPDYAMSDVPKNKQQQIGVYLQDQIKFDRNWIVVAGLRHDRVANSVEGADKETDNATTKRLGLMYAADNGWSPYLSYSESFTPIAGTDNSGNRWVPMRGKQWEAGLKYMPQDTGYEATLAAYDLRERNRQTNDPSDPTNQVQTGKTRTRGIELEFRGRVTPQMDVIANYNYTDIDPQLEGLPKHTFSLWSKYRFSVGDVHGFAAGAGVRYLNAFRDGSAPETGSVALFDAMLSYDTGSWRYALNVANIADKTHEVVCLRRGDCFYGQRRTVTLSAMYRF

SEQ ID NO: 11609 - protein, 385 aa, Bacteroides plebeius DSM 17135
MKKTILLAASAATFSAAAVHAETSVTLYGLIDTGIGYAKVDGSYTNPNTGAKADVNASRIGATTGQTAGSRWGLRGKEDLGDGLYATFRLESGFDSTNGESSQGGRLFGREATVGLGSADWGEVRLGRQYNVASRMMGSLFGNQFGGFTQLTTGAGLGFSGSNWVRYDNLALYESPSFGGFRLSAGYSFNANDLSAAQSGFATADNTRAITSGLSYNNGPLLAFIAYEQLNASNKLSNAQTSATPRSFTVGAAYDFEVLKLIAAYERATDGWFAGKGLPSGANINGFQGTPSNAFVDGFSTNSYLLGVAVPLGGASSMFGSWQRVDPNNSDLTGGDSTSNTFALGYSYKLSKRTNIYAAGSYTKNFAFQSDAKATEAIIGLRHVF

SEQ ID NO: 11610 - protein, 853 aa, Bacteroides plebeius DSM 17135
MKLTIIAIILCVSLGAKAQQDSTEMKKAIDAMQKMYSVHFVYDSSLANIKPKGIFQRSSSLPENLKRIFSGTGIRWEIQGEYVLLFRQNNYTFSGHICEDKGETLINVTIFDLNTQTGTLSNEQGFFSITLPEGKHKLRFSYIGYQDVVKEVDLTSNYNGVIYLKESNTSLKEVVVVADLNASLRTTQTGKVSLTSEQLNTEFSLLSSPDLVKTLQNIPGVASGTELLSGMYVHGGKNDENLFLLDGTPLYQINHLGGLFSAFNTDIIKNVDFYKSGFPARYGGRLSSVVDVRTKEGNMKEFHGTFSLGLLDGRVQFEGPIIKDKTSFNIAMRRSWADLFTAPAFFLLNRSNPDDKKNVRYAFHDINGKITHRFSDNNKLSLSVYSGNDLLKTKARQTFEDGEHYDSDFKAQWGNLTTALTWNCQIVPKLSGSFTGVYSRNISMYDYVEGSRFFSDGEQTSMTGMERSNRSTIDDMGYRMEFDYRPGTNHHIRFGSNYLHHIYHPQSTASRNQTDRDTLSTENASSYKGNEVAFYVEDEMRLSSRTKLNAGLHYTLYQTDGKMYHSLEPRLAMSYQCSEKATMKVSYTEMSQFAHQLSNTYLNLPTDSWVPSTRKVRPMRSRQVAAGIYTELPWHISLNVEGYYRTTSQLLEYDGGNSLMLPAENWDNLVKTGKGKSYGVELSLAYKDRYNVIEAGYTLSWSLQKFTDFYPGWYSSKFDNRHKLNIAYRHKFNDRIDAYAAWVYRSGDRATVPNQYVNGPSFPGIPDSGEPELVYEKPNNITLPAYHRLDLGVNFRRTTKRGFERIWNVSIYNAYCRMNAFYTRIERLPDGGFRGKGFGIFPIIPSFSYTLKF

SEQ ID NO: 11611 - protein, 904 aa, Bacteroides plebeius DSM 17135
MKKLFLLRFSVAAFFCMLCVLSSLAANIKVKGAVKDKLSKEPLIGATIRLIGTQAGAVTDMDGNFELNAGGVLEGMYDIEIKYVGYKTEVRRKVRVENGKLVILNLELETDAQELADVVVVAKKNRENENMLLLEQQKAVIAVQSVGVKELSRKGVSDAEGAVTKVSGVSKQDGVKNVFVRGLGDRYNATTFNGFSLPSEDPEYKNISLDFFGTDVIQSVGVNKAFNAGGSSDVGGATIDIVSKELIGGGNFGIGISGGLNTQTLTADFLKMDGVDFMGFANRTEPADENTWGFKNKLDPTEKHLQINRSYSISGGKRFYIGKDKNPLSFFLTAGHTTDYQYTDEVIRNTTTSGTIYKDMQGKKYAENISQLLLANVDYDMNNRHHVSYNLMMIHAGTQSVGDYTGKNSIFSDDYDNLGLTRRQQSNDNLLIVNQLLTNWGLTKSLSLDAGASYNMVKGYEPDRRINNITKAENGYTLLRGNSQQRYFSALDEDDINVKAGLVYRLKDDVEEISNIRLGYTGRFVDDSFKATEYNLTVEHASDFPSLDGFSLDDYYNRDNLSSGWFKIQKNVDKYTVTKNIHSAYAEATYQFTPRWIVNLGLKYDYVDINVDYNVNRGGSEGSNTIRKDYFLPSLNLKYNLNEKHFLRLGASKTYTLPQAKEISPYRYVGVNFNSQGNPNLKPSDNYNFDLKWDFNPSPTELVSLTAFYKHIKDPISRIEVASAGGYLSYENISDRATVAGVEVEIRKNLFVRPLSSAANGMNKLSFGLNGSYIYTNAKMPLATVTTGSQLEGAAPWIANFDLSHHFTRDERSFVNTLVLNYVSDKIYTIGTQGYQDIMERGLVTLDFVSQVRLNKYLSLNLKARNLLNPSHKLSRKANESGEKVVLGDYKKGINISLGVSCTF

SEQ ID NO: 11612 - protein, 812 aa, Bacteroides plebeius DSM 17135
MECKGINGRTARTGLAGWVALLLTTSVSALALNVPATAQTVAQASTAPRQISIAAGPLTSALNQLATQTGLQILFDGSIANGKTSRGASGNLTPSQALAAVLAGTGVQSRFAGQNQIALSLAAAPANAAAVAADGTTQLQAITIYGSRNATTLASTSSSIGIVNAEQISDGQIRSFRDSFRRMANVMDGDWADAGFIIRGVSSEGLVPGGAPLATLYIDGVQQTVRGARRGARGLFDVEQVEVYRGPQSTLSGRAAMAGAIYIKTKDPTFEKEAELSTTIATGNLYGTGFMFNTPLVDDQIAIRMSGEIQRSKNDINYPTFERYENYNEFTHDFYYQVRGKVLFEPAEMPETRALLSYSFSHDNPAVRDIGGPKGSIPFSFDEKRGDYQLPVYIEYRPTDVHNVGLEVTHDFSDELKLTSLSAFSYSDADRLSVNYGTPGEIDTYHGYYKEWIASQEVRLNYEGEKWDWVGGVYFSYEDEKNFYDRTIPLTATVKRNQVQHNTQKSFNAALFGEATYEFVPTWKITVGGRLDYTDQDITQNLVRTQPLGGRTTVVTDYAASFSEVNFVPKIGLSKELTDTQTVGITYSQGFRTGGASYDAYQRTAYNYKPEEASTYEIFYKGSFMDERLTINSNVFLTKYSDQQVLMQFDPTDLLSRRIINAASSEAWGFEFEPSFKVTDNLETFASLGYVHTEFKDFNDLNLGNLSGLPFPEAPKWSLGLGARYTFDNGVYVGADAKYTSSYLARLGSLPHDYLKSRWIVNLQAGYKTERWEINAFAQNLLDEKYFVYNDNDIAATLGERRSVGLNMKVKF

SEQ ID NO: 11613 - protein, 177 aa, Bacteroides plebeius DSM 17135
MKKNIAIAAVVTAMFHAVNVNAADHTFSVGYAQTDIEGVNKNLTGLALKYRYEPGRLGLLVGLTGTTLNESTTATIVNNQVQINTFDRTYGSIHIGPTYRFNDMVSGYATLGYATYEAKRKSGDSVTSGFEDSNFAAGAGIELNLTQSLALNGGVEYSEHLINSTALTYTVGLGFRF

SEQ ID NO: 11614 - protein, 1004 aa, Bacteroides plebeius DSM 17135
MKKYKILALAIFACVTLNGWAQSEDNVTGRVLDEKGKPVAGALVSVEENPLVRVATDKNGRFEITAVKGSRLKVQTGDDAMKVVKIENGSELTVVMDYSSEKVNYGFGLQQTNAESTGAVSTVYAENIDKSSAFSIGNSLYGNVLGLTTMQSTGVVWEQMPSMYIRGLKTLNGNNGILLVVDGLERDNNWQALKYITPEEVESVSVLRDAAALALYGYRGVNGVVNIVTKRGKYDTREINFSYDHAFNYMTRKPELADAYTYASALNEALTNDGKQVRYSQNELNAFKNGTSPYLYPNVNWWEEVFRDRGASDIATLSFRGGSTKMRYYTMMNLQNNRGFIKNFDTNADYSTQEKYSKANFRTNLDIDLSPKTKMQANIMGILNEFSRPGMGSDNLISKLYQLPSAAFPIRTKSGLWGGNTTWGENWNPVALTEGRAYSKGHTRGLYADMSLRQDLSSLTKGLGASVRIGYDNLASYWENHTKGYKYGMASVASWENGLPIAGEEITGGKDTEMSGDSKLDWQYRAFNFQMNVDWQRQFGVHSLYSMLLYTYKYDNAKGINNTFYRQNAGWYTHYGFKNRYFADFTLMASASNLLAPDHRWNVSPTVGLAWLISNEKFMQSQNVVDFLKLRASFGMLNTDNIPGNGYWNETVGGGNGYPINNNFGGDGGWHEGRLASVNGTTEKAYKYNAGVDATLFKGLTLTVDGFYERRSDIWVSSDGQNSAVLGASGSYVNAGIVDSWGTEIGANYYKKMGNVELNLGGTFTYNRSKIIEMLEEPAAYDYTRSTGNPVGQIFGLQAIGYFVDQADIDNSLPQQFGPVKAGDIKYKDMNGDKVINSDDRVAMGYNSTCPEIYYSFSLGLEWKGLGFSAQFQGVGNYTAILSGTYYRPLVDNTTISNYVYRNRWTPETPNARFPRLTTETVDNNLQTSSLWLADRSFLKLRNCEVYYKLPSSWLNRFWVKNAKVYVRGVDLLCFDSIDQLDPEAMNSSYPATRSIHVGLSVGF

SEQ ID NO: 11615 - protein, 395 aa, Bacteroides plebeius DSM 17135
MNKKKLKMKMDIRVTGVLLALVSPALYAQSSVRLSGSIDAGVAYVSDIGNASGHQSAWQAKNGDINISRWALSGNEQISNDLSAVFTLTNGFSVMNGTAAQQGRLFGFQSWMGLASQSTGTLTFGRQFDEVVQFVEPFALGGTRYGGTAFAHVFDNDNLDNYTRTNNSVKYTSPTLLGGLKFGALYGFSNEGGGFADNRGYSFGLGYQYNNLDLGAGYFQFNNASNLATANTNGAEPAGAPFNAARQRTWAAGGLYHLAQVAVGLILSETRLDKATSINNVADTAISLPGDDVRFDNVEVNVRYAVTPRWDISAGYTFTLGRFATPTGVRYPKWHQAGIVNTYFLSPRTDVYAEAIYQRANQLGGTGIQGAQISNFSRASGANQFVAALGLRHRF

SEQ ID NO: 11616 - protein, 644 aa, Bacteroides plebeius DSM 17135
MVMTAAFPALSAQAADLPLKAPAIPAYDWNGAYVGAHIGYSFGTAHGEVIDGSAFPTHHHFGGAMAGFHAGYNVLLPSRILLGAEADISFPSYFESNALIATTPTAGNMLTERLDYAGSLRARLGYATPQWLLYVTGGFAFAGERFENELAPFKDKRIAYRTGWTAGAGIEYAIAPLWSARLEYLYSDFGRTSVVMNSGLQATSALDMHSVRLGLSRKIDAAGFGANGGELGAGAPAGWEISGQSTYIAQAYPQFRSPYSGPNSLAPTGQAKSTWSTSLYINARLWDGGEVYFNPEFAQGFGLSDTAGLAGFSNGEAQKSNFPYPRFNPSRLFVRQTFGFGGEQETLESGPTQLGGKADVSRLTLQAGKFAVLDVFDGNSYAKDPRKDFMNWSLWAPGAFDYAADKVGLTYGATAELNQKNWAVRFGYFLMDAESNSDNFDMRLFRRGEYVAELEQRYKLFGLPGKLRAIAWINSAFSGSYRATLDNPALNLDIAATRQGRIKYGYVINLEQALSDTVGLFGRWSWNDGKTEIMAFTDIDASLSGGLSIKGKSWGRPDDTIGLGGAINALSRDHRDFIAAGGLGVLVGDGRLNYRQERLIEAYYAYAITPKLTATADYQFIVNPAYNADRGPVSIFSARLHGEF

SEQ ID NO: 11617 - protein, 648 aa, Bacteroides plebeius DSM 17135
MLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 11618 - protein, 547 aa, Bacteroides plebeius DSM 17135
MSNLLWKTLIFSPVFLGVTLAISASAIAADSQQQPSQTHQSLLAQTNADENVFSQINQYNLEANNQTSLSQVTSVSQFSDVQPTDWAFQALQSLVERYGCIAGYPNGTYRGNRALTRYEFAAGLNACLDRVNELIATATADLVTKEDLATLRRLQEEFSAELATLRGRVDALEARTSELEANQFSTTTKLVGEAVFAVTDSFGNNDNNNTVFQNRVRLDLQTSFTGKDTLHTRIAAGNATPLSLPNGTAEGTQTFNLFLGSNNNAFIDWLAYYFPVGNSQVYVAATGGIQSDYVPTVNPYFEDFDNGNGALSTFASESPIYRIGGGAGIGVNVPFGSGSFKPSLTLGYLGSEPNNPSPGSGLFDGNYAALAQLNLNVGDRLTLAATYVHGYHGANSALFDAGSVSAAVVGTSQANFVGAGNPFVSNSYGFEAAFRPSDKLSISGFALYSNITGFGANDNDEVWSYGLGVALPDFGKKGNLLGIFAGAQPYLGSSNGDKPYHIEGFYRYRISDNISITPGVIWLTNPGQSANNNNDAVIGTLRTTFTF

SEQ ID NO: 11619 - protein, 226 aa, Bacteroides plebeius DSM 17135
MKNLLMAALMTGSTFIGLAGTAAAEDNPWMVRARVIGVMPDEAGALSVGGSRLQGGVDIGDQYVPELDITYFFNRNIAAELILGVTPHDVKATKVTVPGALTDATIDLGDVWLLPPTLTLQYHFQNGTRFKPYVGAGINATFFFNEEEGPVADGIDYDPSFGPALQVGFDYDLDGEEGGWALNADIKKIWINTDVTVDFSTALGAAVNADVDIDPLVVGIGLGYKF

SEQ ID NO: 11620 - protein, 272 aa, Bacteroides plebeius DSM 17135
MKKILSTLSIGSALALSSTVFAVDYSDDIHKNDYKWLQFNLMYAYEELPRDPDAHSGHDYLEMEFGGRSGIFDLYGYIDIFDLTESSASDKDGKPKMFMKFAPRVSLDAVTGKDLSFGPVQELYFATLFNWGGGTEADFEPNNSFWGIGSDINVPWFGKVGLNFYGYYNITAKDWNGYQISTNWFKPFYTLDNGSFVAYQGYIDYQFGAGSSFQGNSQASHGGVMFNGLYWHSDRYSVGYGFKLYNDVYLIEDTNSFESTGISHYVAATYKF

SEQ ID NO: 11621 - protein, 272 aa, Bacteroides plebeius DSM 17135
MKIDTRNLLIVCAGLAPFLAQAETDGKTTFQYEHNWKTEDRRHSDSIKLIHKKTNGWSYEVKFSTSAGGNSNYDVAYDDMQGGSGGMVIGKDFKLSKAATLTPSFEFSIGNASMMYQPGLKYSYRINSDWSTYGRYRYEYKKPTRSSRYSTISTSDKYGYAGESYLSKSDTGRHRLDAGVTYSGLDNINLTYVFNYYIGDNTTKSYKYSKGEFTEREYAVYDNGKTDYEHQFKVQYKLNKQLTPYIEYDDISQSSTSSSRQGKIKVGFNYVF

SEQ ID NO: 11622 - protein, 649 aa, Bacteroides plebeius DSM 17135
MDIGGLKLSNHKTLNRFPFALLALACSLQPLLSAQADDTELEHIVVTASAKDQQLSSAPASISVIDAEEIKLLPVKDLGDVLRGSVGVNVVSGNAGRNSLYVRGMDETYVLMLVNGKRVSSSNGLWRGGNFDITAIPIDAISRVEIVRGPMSALYGSDAVGGVINVITKAPTEDWQLTLDAEYSQMQEGDGGDRQRYNVFTSGKLTDSLGLMLTAESAEQDLWQLPEITPTFDTIEERKTKKLYSALTWQLADNQTLDFDYQYDKDKVPLTTYAEKSKREQQIERNTFGLTHKADWQWGQTQLEANLEDSKLYDYNSRYSLQPPLGRHIDEKNTSFKATSFFSLWQQDFTLGGEYHKTEVEDPVQYPTTKGDSVDQYSLFAQDEIDFLDDWTLTLGARYEDNEKYGNNLSPRAYIVYRATDKLTFKGGVGTAFRAPALFESSPTFASVSCGGACSVVGNPDLDPETSVNYEFSVLMSDNTWDISATAYHNKVKDLITVSTWDRVSPSRTYYNESEVTLQGIELTGRIDLTEDLSLKGNYSYLDTEKSDGSELNGRPDQTANLQLDWHMTDDWQLYVSGNYFGDYLDSSAIKRSGYSRFDFGTSYRLTENIKLRAGMTNFTNEQPAEDSDGTTETILPGRAVFAGVTLTL

SEQ ID NO: 11623 - protein, 709 aa, Bacteroides plebeius DSM 17135
MKRFSLLAGCSLAVAIACSVPALADEAGSTADTQQGGSHAQPSDQIVVTAAFQRDRLDILSGVSVLQGEALTQAIRPTLGETLDRTPGVSATSFGPNASRPVLRGLQGERVRILTDGIGAFDVSNTSADHAVVIDPLLAERIEVLRGPATLLFGSSAIGGVVNVIDKRIPRTLPDEPVHADMIATYGSAADERSIGGAVDVPLAGKFVVHADGSYLKTGDLRVGGNLLAAPARATALANAGSEDDDQLAEGISFAGNAALKGRLLNSAAETWTAGVGAALVTDTGNLGISYSHYDSLYGVPVRYAIRPGEEQEAPRLDVAQNRFDMRAEVETGGGLLKSIRARAGYASYRHYELEADGSIGTAFYNKGLEGRLELVQADRGAWKGASGVQYFSRDFNVVGDEAFLPKNSTQQFGLFTLQQLDLGQLKFEAGGRYEHTVLEAHPTPEQPQFFEGKRTFGTFSGSAGASYGFAKDWRFGINLSRTVRAPSAEELFANGPHAGTQAYEVGDPDFKTERATGIEAVLRGKSGGFSIEASAYHNWFSNFIYEGMTGEVEDGLPVFQFSQAKARYYGFELQTTAALGKIGGMELVADGVADYVHATIDGVGPAPRIPPLRLLGGLALNGGKVDLRGEVEWNDSQDRLAAFETATGSFTLVNAEINYRPWGNARPLSFALSANNIFDVDARRHASVLKDFAPLAGRDIRVTARASF

SEQ ID NO: 11624 - protein, 977 aa, Bacteroides plebeius DSM 17135
MKRFSLWLLFFAVLGIQSALAQSYRVKGNVVSKTGNEPLIGVSILQKGTTNGVVTDIDGNYELQIQGGEATLVFSYIGMQTQELKVNSRTGVLNVTMLDDSQMIDDVVVVAYGVRKKGTIAGSVSTVKSEKLENVPTASFDQALQGQTPGLTVMAASGEPSRAATFQIRGTNSINSGTTPLFILDGVPVESSSFNSISPSDIESISVLKDASSTSIYGARAANGVVVITTKRGRNVGDANVTFRGQWGFSQLAGSNWDMMNTAERIQYEKEIGLDLGDEYYDKVRGIDVNWMDEVFNNNAPTQSYELAVNGATEKTNYYVSGGFFDQDGITFGSSFRRYNVRANVENRAKEWLKLGTSTMLAYQETQQAVDGYYAIYAPISASHFMLPYWNPYNEDGSLASTNDGTWKGSGVNPIEWLTNNPITYKTYKVISSVFAEVTPIEGLTIRSQFGVDYSHDTAFSTSTPSYSLNAGLGSAGRSSLDDLTLTITNTVNYRFNLNDRHDFNFMLGQEGVNYHSENFNVTTSKQNNDALVNLSSGSFAASWGDSTTEYAFLSFFGRGEYNLDGKYYADFSVRADASSRFGKDNRWAGFWSVGLMWDFKKEEFFEGYDWLTNAQLTFSTGTSGNSSISNYEHLALVTGSSNYLGETGIKPSQRGNENLTWEKLWTTNVGLRLGFFDRINFTAEFYNKLTTDMLMQVPVSYADGGYGSYWDNVGAMVNRGIELSVDADIIRTKDFTWNVFANASFNKNKLTELYNGIDQYVDSNVNMYAVGHDVANFYMVRYAGVNPANGDALWYTKDGEITNVFSEEDRVLIEGKSFIAPWQGGFGTTLSWKGLMLSAQFSWMADRWAYNNDRIMDESNGLYTSYNQSKRLLYDRWKEPGDVTDIPRHGITPQFDTHYLENASFLRLKNLMLSYNLPQSVLKSTKFFNGARVYVQGQNLLTFTKFTGLDPEFSSNIYRAQYPMSRQFTLGVELNF

SEQ ID NO: 11625 - protein, 655 aa, Bacteroides plebeius DSM 17135
MYKKCFKLSPIALCVAITTLSYDTFAQDNVQEVIIVEATKQGTPIGRVNNSVIVKTGYELEKAGIHEVKDLEKAFPGLVIQTRGNRTYANTTIRGISSPDYHSPTIGIYVDGVLQDAAFLTQQLLNVERVELLRGPQGTLYGGNAQGGIINIITKKATNQPKASAGVTYSNLSQQLDASTAIALSDEIYADVVIRSLKDEGNITHVPSNTKKANETKEISGMARLHYIPDDSPLNATLSFSADDLDSHEEWYLTKAEFDKKETNQDIPELKRNVNTVSLNVGYDFGSAQLTSITAYQDRDVDRTFIGGTWVEDQNTFSQELRVNTHFNDALTALLGGYFEKRQFDVNSGSQNKISTDTYALFGQSTYAVTNAVDLTFGLRASRMSTNSDYAGNPAWGISAYDQSKSENIISPKAAIGWQANEHSRLYASLTSGYRPSGFSAAPRSNSDKDGFDAEKSLNWELGWRTTLLDNSVDLSGALYLIETKDVQLYTGAPGSQKLSNHGEAKSLGFELELAFYPTDDLTLNLAGTSGRSTFESGNGGLEGNRLPYAPDTTATVGVEYFLPQSLVEGEISLVSNARYTSKMYFNESNTLSQEGYALVDVAIVYDFNDHLSFRLFSNNITDKEYKTYSFAMAGTSLSNYGTGREVGLNAKMEW

SEQ ID NO: 11626 - protein, 714 aa, Bacteroides plebeius DSM 17135
MKKPETRIPLCLRQATLLVATALAFPACAEENLFFSEMPIIASVSRLPQQLSETPASVTVIDQEMIRASGMRTVEDLLRLVPGFQVTSHNQDPAIVAYHGLNYGLSSEEYGPRVQVLVDGRSQYSPLFKSGVNWNLLPVALENIERIEVIRGSNTVSYGSNAFMGVINIITMDPALTKGWMVSANHGNNGIRDEVLRWGGSLGDANLRFTARSFQDDGFQYGYYSGRWTYSPDNRQSQLFDLRADIPLTDRDELQLTGTFARDMSQYGRPGSPVNDPIRNLEQYSAAFGILWRRTLSATEETKLRYGYNDDRAQGPFRTRVNFTTNRVAPASVTFFPGVDPGGRSQQHELEFEHLLSPRKDLRFMWGLGLKSTSVQSYEQFSSTEWKSRFAYRAFGNLEYRLMDPLLFNLGGSYEHDNISGDMFDPRASVSFHVMPGHTIRLVASRAHRNPSLYEAAGHSERRDIGGTGLVDILYYAQGVKPEQIDTLELGYLAELKEYRATADVRVFSERIPNYIQILPLALPASMPDDRETSAPFGGLRMNAVNYAVFPNGRADSAVNLENVRIQGYEYQLNWRPFETTRLMYGNSLICVTADFTDISRIADDFNNGPKIIRQTRDSAPTHSQTAMLIQKLPYDLTASIMYFRASPMRWRRNDDYPIEASERIDWRLAKAFRLGPMGGELAYIAQMVNEQQQGRTINRLADRVHWLSLRLNF

SEQ ID NO: 11627 - protein, 166 aa, Bacteroides plebeius DSM 17135
MASVNKVILVGNLGRDPEVRYSPDGAAICNVSIATTSQWKDKASGERREETEWHRVVMYNRLAEIAGEYLKKGRSVYIEGRLKTRKWQDKDTGADRYSTEIVADQMQMLGGRDSGGDSGGGYGGGYDDAPRQQRAPAQRPAAAPQRPAPQAAPAANLADMDDDIPF

SEQ ID NO: 11628 - protein, 823 aa, Bacteroides plebeius DSM 17135
MCKSVCRSSQIDIFCYILVSFNILSFSSLYKIALLFKVRIILYPLKGEKWQYRKLHQAILNCNQTRPLPPLALHYRLYPWPIWPRRKQPANNKKEATLEEVSVRAARENPYKSERLASPKYTQPLRDVPQSVTVIPKEIIRLQNAQTLEEVLYNSPGITFNSGEGAGGVGDGINIRGLSASTYGGSDIFIDGVRDSAMRTRSEMFNIEQVDVVKGSSSAEWGGGLIGGGINMVTKRPHLENDRSVSVGAGTADYKRITADINQVLDEDNGIAFRLNAVRHESGINGRDWINRDRWGIAPSLSFGLGTPTRAILAYEHLDDDGNLDYGVPTWVSGKPSRFNALGGIGNVRIPGFTAPNGGRAELAPGVKWSDYYGFRNLDRDYTRSDRINFRVEHDFSDSLQLTNNFTWNKLHREYIVTTPEGGTLTYRRLLGVASQYENEAFANQTNAIWKFNTGAISHALVGGLEFARESMDKRGGTGVGLDNRATIGDGGVIAYPTGNHLTKLPYDVDYTWGASVETRADTVSYYLIDTIKFTPQWEMNLSYRHDKWKAHSKDTATRESGSSTEDLDSGRIAVIYKPEEHGSIYASYATAKQPRGLASVVNSTSAANLRDAAAPIKSETTEIGTKWDVFNERLALTAAIFNTEVKNPGSDLDLTTGASSVIDGKLRVRGLELGATGAVNDKLSVFAGYTHLNSELVDQRTGNATTGEGGTLTNAPKNSASVFATYEVLPSLSISYGIRYMDKRYIAPGRSGNENSNPELNHEVPSYVVHNLTARYVMNRNIDWQLNIINLFDKHYFRQYNGRGFGIPGEGLGAQLTMNYRF

SEQ ID NO: 11629 - protein, 672 aa, Bacteroides plebeius DSM 17135
MNKNSLTCQDLKEVGYTVNFEDISILELLQFVSKISGTNFVFDSNDLQFNVTIVSHDPTSVDDLATILLQVLKMHDLKVMEQGNNVLIYRNPKLSQLSTVVTDGSAKDTSEAVVVTRVFRLYSVSPSAAVEIIQPLLSHDAIISASESTRHIIVSDIAGNIEKVRELIQALDSPGASIDMSEYEVQFANPAALVSYCQDVLGAMTEEEGFQIFIQPGTNKIFVISSPRLTTKAIQLLQSLDIPEMAHTLDDVTSPASALGSSGSANPKSMRFFMYKLKYQDGSAIAQAIQDIGYNLYVTTAMDEDFINTLNTIQWLPINNSIVVIGNQANVDKVVSLLNGLDLPPKQVYIEVLILETSLEKSWDFGVQWAALGDEQGKVAYASGLLSNTGVVDPLRNQTPPVAPNPGNISLPTPGQLAGISDMMYGSSAFGLGIIGNVLSHNGKSYLTLGGLLSALDQDGDTTVVLNPRIMAQDTQQASFFVGQTIPFQTTSTVIQETGSVTQNIEYEDIGVNLVVTSTIAPNNVVTLQIEQTISELHSAQGVLTPVTDKTFAATRLQVPDGCFLVMSGHIRDKLTKIVSGVPLLSSLPLIKGLFSRTIDQRQKRNIMIFIKPKVISSFEEGTVLSNSEGYRYNWESERGSLEVAPRHAPECQNAPKVQTESDFKMLEIEAE

SEQ ID NO: 11630 - protein, 734 aa, Bacteroides plebeius DSM 17135
MRNLLLLSTAAAAFGSVLIAQPACAEAADAPATEVDPVIVIGTRSERLASRTPATVSVISADQIETMLATDIKDLIRFEPGVSVPTSPARFNLALSGGGRDSNSGFTIRGMGGDRVLIINDGVRLPSGFSFGAQAVGRGDYNDLDMVKSVEILRGPASALYGSDGVAGAVAFTTKDPSDFLKSSQDLGARVRAAYSSADEGWTESLAVAGRTESVSGLLAYTRRDHQETENQGEVGGVGSARTQPNPQDFTSNAILAKLVWDVAPGHSLRLTYDHLDSEMDGDALTARSATVLAVTAHDETQRDSLKGEWRFQDFAGFESGSVSAYWQDATTRQYTYEDRSPAVDRVRDTTFDNTVYGLAAQGARVFGAGEAVEHRVTVGGDWSMTTQEGVRDGVTPPVGEIFPTRAFPKTDYQLAGLFVQDEIEMLGGALSIIPAVRYDWYDLSPEVDALFPASATSQSEDHISPKLGVVWWADRRFGLFANYAEGFRAPSPMQVNNYFENPVYGYTSIPNPDLKPETSDSIEGGLRFRDIAAFGGELRLQTTAFSTHYDNFIEQVVASGTGVPGVDPLIYQYVNLTNVDIWGLEARGDVAWSNGLSLIVSAAFADGEQETDGDKTQLSSVDPIKLVGGLNYAAPSGVWGGSAVVTWSDRKDAATYELSCGSACYTGDSFTLLDVTAYWNVTERATLRAGAFNLLDEKYGWWSDVRGLSAASSIKDAYTQPGRNFGLSLTLRL

SEQ ID NO: 11631 - protein, 731 aa, Bacteroides plebeius DSM 17135
MRAKNCQRSLPSKRLLATAVGLAVASLTLPALADDAVQLDNLTVKAKRDSGYKTESSASAKYVKPLLDTPQTINVVPAEVIREQQALSLRQVLSNVSGITFNAGEGGGGSGDSINIRGFSANANLQIDGLRDSAQTSRTDTFNIEQVEVIKGPNSVFGGAGTTGGSINIISKQPLQRDFTEIGAGLGTDNYHRLTLDTNQTLDGVGVGSAVRLNLMAHENDVPGRDQIDRERWGIAPSLALGLSEATRLTLSYFHQSDDNLPDYGVPALDGKKLAGVSREDYFGWKNLDKERIEQDAFTVNLEHDINDALRLQNLTRYSRVDRETVVSASHVNLTGVPAGNYRPAGPQGYGRDVTTEMWINQTNLRASFDTSGLAHELVTGVEVSRENLDLKTYNHGLGNAVYPGSGFDLSNPPGRWNGPINKTTTGYTENQLDNRALYVFDSIALSPQWDLNLGLRYDWFDAESESFSASHVRTGRFTSTDEELSSRAGLVYKPAENGRIYVAWGTSFNPSAENVASNGGGLNAATQSLNPEKNETWELGTKWELFDGRLMLDGALFRVDKTDAREQLADGSYILAGEQRVQGVELGATGKLSERWDVYANYTFLDSETLKSTIDPNREGQALGNTPPHSFNLWTTYEVAQGWTLGYGARYVSERNVSASTQAKLDAYWLHNAMIGYKVNRNLDLQLNVNNLFDKDYVERVRQNIGTTARSSAIEYGDARSAILSATYSF

SEQ ID NO: 11632 - protein, 785 aa, Bacteroides plebeius DSM 17135
MSLLASTAIAITTLPAGIASAQVADQANEPATRGGAADIVVTAQKREQRLNDVGLAVTAIGGEALQNRQIASLTDIASAVPGLVFSNSASNTPVYTLRGVGFNDTTLGSYPDVSVYLDEAPLPFPVMTKLVGFDLDRLEVLKGPQGTLFGNNATGGAINFIAAKPTKTFEAGGTVSYGRFNTIDGKAYVSGPISDTLGVRISGKATHSDDWQKSYTTDAKTGGSENYAGRIILAWEPTDRLRVNLNVNGWLEKGKPPALQLIGIRNAGPGNPVTGYPLAPENARSADFSTNIDPYLDNSMWQAIGRIDYDLTDDISVTSLTSYVDYKQKMAFDGDGTTLNNADFRFFGGGIKSFSQELRIANGGNNPFRYILGLNYSDDRAKDRSELDYRDSTINTGTAAFGGIFRSGFRANQNMKNYAAFANAEYDVGDLTFKGGIRYTKSKRDANSCFFGIAAEGSNLPFAPLYTFFANLLRSQNGLSPITVTPEQTLGCLTIDNTGLLGADPTFLPGQFVGKLNEDNVSWRAGIDYKPRPGILLYANVAKGYKAGSFPSVAASTTQQSQPVRQESLQSYEAGFKLSLIDRTLQANGAIFYYDYRNRQIRSKLLDPNFGPLDVLVNVPKSNVKGLELELTANPADWFSAYANFTYLDAKVKRYTGLNPETLAVGQNFDGAALPYTPKYQISTGFSVDFPVSDNLNGFGGADLNYRSQTNAFIGASNLFEIKDYGTLDLRAGIKSQDDRWSFQVWGKNVTNSYYWDNVAFFFDTVTRWPARPATYGATLSVKFR

SEQ ID NO: 11633 - protein, 243 aa, Bacteroides plebeius DSM 17135
MKTAKISALVLAIAGVFTTSANAQSAKANAWEGFYGQVGVGYGMFNPSVSNGTASIPAGVVAPSAVAATTTATNINNISTGLVNLAAGYNFAINSNYVLGLGVAYYPGASSSATSTMNIVAPSGTTFDSGQARYNVKNLYSVTLNPGYVIDNDRLVYAKVGYTGATIGLSTASVPYTITNLTGYTLGLGYKQMVTASIYAFGEVNYAFYGNKTASSTAYGVIPVTTTIKGTGTDFLVGAGYRF

SEQ ID NO: 11634 - protein, 363 aa, Bacteroides plebeius DSM 17135
MKSCVQRFARTARVSGPALAVGVAAGAVHAQSSVTLYGIMDAGIEYANHAAPDGGDSFKLKSGNKNTSRWGLRGVEDLGGGLKAVFRLESGIDLANGASDDGPDAIFARRATVGLKGKWGEVSLGRNFTVTYDYMLPFDPMGYAQNYSWATSSMATGARKDGLFTRASNAVRYDGEFGGFRFGALYGFGNVPGSVKTSSKYDFALGYEAGPFAAVVTFDRQNGAADSVTPADTVNYVQGIHAGVSYDFGSLKTMAGYRNYRRTYHTRAANQLSDMMWVGGTYQFTPTFSMIAAVYHQNIKGGSDADPTLVSVRANYALSKRTVLYAAGAFAIAQHGEKVGVSRDVSGYGTTQVGVTAGIQQRF

SEQ ID NO: 11635 - protein, 1794 aa, Bacteroides plebeius DSM 17135
MKADDTVKHKVSIAENKINNEGTIKISGTVENSIGMYLDIASNMTNKKEIEISSKASDGNLNVGMRADQVQDKYTDSNYDTSVINAGTGKISLIGENSIGMIAANTSKWGSAKAKNLGEISITAGKRNIGMLSANEASVINETTGKINIGTSPNSVGMASIIQGGKVSKAENKGKINVTGANSTGVYNTGEFLMNTATAEINVAGRQSIGLYAKGNTLQTKTELKAGTVTASNSGVGLYADKSTVRLGGGTDPLNLIANNGGLLFYNYESNNKNNVANGVFNLAGNVKAPVNNGGYAFYLKGTTINPDGTMTNLANFFNSMFDDKNSTGKLDVTLNSGGTLMVLDRPNGGNIRLSNVANTSSIVSSLGNRVNINSASTKYKVYAVYRGGLQIDQNVNLDNDSNSTNPDAFYKVDFRSSNMTLDSGKSMIGSKQGQVALFQGNYDEGTEKGNVGDITITNNGTIKLSGNSTVSETTTAMAGDFVTLTNNKDIEVTGDRAVGMFGAGGSKVLNNTNGTITVGKEGVALYGINKLGTSTLGDQTISLTNKGTLKGINGKTKAFGIFAENTLAVNKSTLINSGTVDFSNSQESIGIHSVDSTVSNTGKINMGLKGVAINAKNSDITSSGDITLAGNGIAFNLGGSFTGRTLNFSSKVTLNGDGNAIFNLKDMTFSSSGSSLTENLNIASNGKSFSYFSMDNSVLTYDKNKTFAGNKVTLVSAKNSTVDWKANLVLSGEESVAFYLNGRRAVATPELTIAAGKTITLLGNKSVGAYGVNGARIVNNGNITIGTNGAALYSTGATGTINNTGTLTLGKNSTGIYMKDGTGVNNSGEIVSTQEGAKGLVVSSNTAALYSNGGKIKLTGTGSIGIHAEGATHNIISSADVEVGDTTGTNQSVAIHLKDGGEVRVLSHTSVKAGNNSIGIYGSTILATIENDAKVEVGDGGIGIYAKNGNVNLESGSKMTIGKTLGTNKEAVGVYYVGNGGTVNNNLSSFNIGKGSIGIVDAGTGASTINNNLTSVVLPGDAVYTYTSNTNSNVIGNTKITSSGNGNYGYYVAGNLTNNAAASINFANGTGNVGIYSAYRAGGTGIARNAATITVGKTDLENELYSIGMAAGYTDSKDTSKNRVGHVINTGTINVGFDNSIGMYASGVGSIAENDGTINITGKKAIGMYLENGATGINTVNGKITIESSAEGAIAAYSTGKNTIFKNYGTITLKAPSSKGIVTANDGQGTNLGAGNIDVQNGSAEATKNIEGTAGGDKRFGDKTLSVPKGGRTKSTITDADGKVLNPAEIDVTKVGNLSVTDPGQVAKNMKALQGHNDFSSVSRIGMYVDTSGVNYTNPIQGLEHLRGLKKADLIIGAEAAEYTNAKTISIGPNILKRYNEALAKTGLEKYDIISGSLTWAAATNGLTGTGAIKSVILTKVDYKEYAKKSTTPYNFLDGLEQRYDKNALDSREKRLFNRINSIGKNEAILLTQAFDEMLGQQYANVQQRVQATGDILDKEFDYLRDEWRTASKDSNKIKTFGTNGEYKTSTAGIKDYKYHAYGVAYVHESEDIKLGRGTGWYTGIVHNTFKFKDIGKSKEQMLQAKVGLLKSVPFDDNNSLNWTISGDIFVGRNKMHRKFLVVDEIFNAKSKYYTYGIGIKNEIGKEFRLSESFILRPYAALKLEYGRTSKIREKSGEVRLEVKHNDYFSVRPEIGAELGFKHYFGMKALKTTLEVAYENELGRVANAKNKARVGYTSAGWYNLRGEKEDRRGNVKFDLNVGIDNTRVGVTANVGYDTKGENLRGGLGLRVIF

SEQ ID NO: 11636 - protein, 976 aa, Bacteroides plebeius DSM 17135
MAGLLFAVASFAQDLTVKGKVTDTTGETVIGANVTVKGTTNGIITDIDGNYTLSGVKPSSVLVFSFIGYKTQEIPCSGRKEINVVLSEDAQALDEVVVVGYGSLSKKELSSSIVQVDRSKFLQGSMNNPMEMLTGKVAGLTVNNTAAANPNASSSLQIRGATSISASNDPLVVIDGVAGGDIRNLAAQDIESMTVLKDAASAAIYGTRGANGVILITTRKGVGEAGRVQVTYDSWFGVNLAKSGPDILSADEFRRSRRATDYGYSTDWYDLLLRDFSYDNNQYLSIDGSTKNGYYGASFNYKKATGLDLNSSREEFGGRFVLNQRMMDGIIELNGSLNARRVNEVWGNDGMFDTALSMNPTMPLYNEDGTYFQPTSPTGARNPVQELKEIDNNGQRVYLLGTAEVKVNLIRSEKQMLNTSLSYSLHYNDLKQHYYTPSTAGESYWNGYNGRAEVTYQKWYTSRLEWLGNYSLDLGDHNFKAMVGYNYEQTTWERLQAGNSDFNFDDILWNNLGSGSYLAKGKASMGTGKSLAKLIGVFGRINYNWKNLLIASASIRYEGSTKFGADQKWGAFPSLSLAWEMANMGFLKDHQNIVQSLKPRVSYGVTGRSDFDCYQSLATYGSHKNAQLNVTDTYLMDGAWVTGYAPSVNANSKLGWEKSVSMNIGVDFALWNRLRGSVEWFDRQSRDLLYNYTAPQPPYIYSTILVNVGTTVNRGIEVSLEGDAFKGTPVEWTTGVNYSYGTTKLDKLSNSLYKASYVELYQKPGVGTSEYFFRVEEGSKIGQFYGYEYAGVENGDMMIYTDEGEKVPVSKADVKYKRHIGNGTPTSYLSWSNTLRYKNFDLSLMFNGAFGFEIFNMRRYGMGLKGCGTDNVLRDAYGKDADITTGGGVISSFFLEKGDYFKLDNLTLGYTITPKENKFIRGMRVYLTAKNLFTLTGYSGNDPSAVAINGLTPGVDTNSAYPSATQLSVGLNIRFK

SEQ ID NO: 11637 - protein, 729 aa, Geobacter bemidjiensis
MGTATSSVRRAIAIAAGGTLCVAAAGGAHAQASNAAAPPAADATATLPKIDVTGEAGRASLGLVGLRTATATRTDTPVAEIPQTTNVVTAQQIEMTGATDLNQALRYVPGFATFGSDTRTDWYAALRGFTPTLYVDGLAAPNTAVIANWRVDPYTIDSIAVLRGPTSVLYGAGEPGAIIDAHTKLADGERVREAGVQIGNDARKQTMLDIGDTLDPDRRYAYRFVGVARDGNAVTGPNTDRRVAVAPSFRWRPTADTSLTVSASFLQDHGDISSNFLPASGTVLPNRNGRLSQDIYMGDPTFNDYRKKQWSLGYALEHRVNPIWTLQQDVRWSRLSLDDATVFGNGFLPGSTTNMMRFAGLFQLNYSRLDIDNRAQARFATGPLEHTLLLGLQFDRQTTTNSVWLALAPSLNLYHPVYRPVTAAIFSGRTSLGHVDQYTAMNSLGAYVQDQIRWNRWTLTLGGREDRVNARFDDRAAGIGTQQDVSAFSGRVGLTYQGDAGWSPYVSYSTSFDPVIGVRMYGGGLPKPTRGKQTEAGLRWQPAGGNLMLTAAVYRIDQTNVVTPTPPNLDPTGTSSVQTGKVRSRGIELSAVGNVTRELSIVASYVYQDVKNVQANGASLNNWPVSVPLPRQMASLWTDWTWHTGALSGLGIGAGVRYQSASAGAPDNSLTVPSATLYDLAMHYELRHWRFALNVANVFDRRYVSGCQSYAVCVFGNERTVLASAKYNW

SEQ ID NO: 11638 - protein, 660 aa, Geobacter bemidjiensis
MLDSISSEMAHYSKVATATKQNEHYQPYIISVFKGKELEKLGVSNLREALALVPGVDMATDNFNNQTPVFRGSNPLAYGQSKLFIDDVLVNSVFFDAYFEYLSFPIEMIKRIEVTRGPGSKTDGVNAYAGSIHVVTYAEDFKDFENNDKLVFKYGSYDYMMGGFVKNFKSEDLKVFTDFYYQQDDKKLYAGPDGLSQGALGAVNIPRSQTGDAPVWLKEYSLGLNIQYKDFSIKARLHEHTQGSAYGVNLSLPQHDDRVKLPNYYLELGYNKEIKDYAVDIKAGIKYNAFDSKAKLAPDNTILSGPTLFSQGVYSEHFAGQRELYQSSYLKYKGLSKHLISAGYRFTNDETIDMSSKLSNRTTGDPALFDYTDTLPFFDKNAKRNTIIVSLQDEFQYSNSLSFIYGFNYEENTYKTAGLEPRVSMVYQHNSNNIFKAIYSRSHRDASWQEMYTMNNLARVGNKNLDPEKVDAFELAYIKKLSTDSYLQSNAFYLINKDQIYNTASDPTYRNVVDTDIYGFELEYKGNLSSSDQVYINYSYVSGTSYIKDEDKSSSLPNVANHLAKGYYIYNFTSSLSLSGIAKYVGAKERVDGDTRDKVEAYSTLDSALSYRNKKYDYTLALSLKNIFDATVKFPSPPKTYSEDYEQEGRNFLIALTKKF

SEQ ID NO: 11639 - protein, 354 aa, Geobacter bemidjiensis
MKKYLPIAGAMLAAAVTHAHAQSSVTLYGVADIGIEYLNHVPDATRQSSNLFRMTSGNIAGSRWGMRGVEDLGGGLKGVFVLEGGMVLDTGMASQGGRLFGRKAYVGLDSNAFGQFTMGRHHNLMFDLIITYDPMYFAPKYSAFSHDPWLAGRVDNAAKYTGKFGGLTISGLYSFGVDSTVANGSEVPGNSRVGRDMSAGFSYQAGKFRFGGVYDQLNGNSASKASLTERRYVGAAAVDVGPVTAYLGYRRLVSQLVTTMSRTDLMWAGANWNLAPNFALTGAVYKTNDRTSARDPISFVVSADYRLSKRTDAYVTASYTKNKSGSALSANGYDGSVLPGENQIGAVIGMRHSF

SEQ ID NO: 11640 - protein, 1040 aa, Geobacter bemidjiensis
MKQKISKFFSDARIRMLLLFLISTVYIQAQSGRIVTGVVKDATGETVIGVNVTVKGNAALGTITDLDGKYSLSVPAQKSTLVFSFIGYQTQEKTIDANTKTLNVTLVEDSKLLDEVVVVGYGTMKRKDVTGAVAHVGDEVTKNRAATNALDFLVGTVPGVHITPSTEAGGGASGLLIRGKQSLKASTSPLIVLDGVVFYGNIGDINPNDIESMDILKDASSTAIYGSKGSAGVILINTKRGTSEKPIINVSTKIGVAQATFMPEMPTAEQYMQRRSDYYKTIDYFKPGDQQKGLGYYDNPDHLPEGVSRDQWAAYDPSFSGDYIETWMQRLEFNPIEVTNYKAGKFVDWMDLVYQNGLRQDYSASVSGKTARTNYYVSLGYTNNDGIVVGDQFRASRSRVNLDTEITKWLNIGLNAQFVHKGSDDIKADTGAAKAASPFGDVYEADGSIKVRPWDDNRVANPLLNRSVDDKYYRTQTFNSSVYGKLTLPFGFTWQTTFNVRYGWRKDYYFDSDIKPGVVAGGKAKRVDYSDYEWSIDNMLKWNRTFAKIHNFDFTFVYTAEKYQNWQSTGNNEGFQPNGALSYHGIQAGITPTVSANDEMQTGNGLLWRLNYSLMDRYLLTGSVRRDGFSAFGQNNPFGVFSTVAAGWRMSEEKFLKDVKWINNLKLRLSWGQTGNRDIGRYAAFSRLTITNVIQNGVNYKGVYPSSLANRDLKWETTTGFNLGVDFGLFNNRLSGSVELYKNKTNDLLMDRAMPEISGYGKIASNLGELANQGAELTLSSVNVNTRNVRWGTTFTYSTNKNEIKHLYGDMIDVLDAEGNVIGQREDDDVQNGWYIGHAIDEIYDYKWIGVWQLGEELEAAKYGKQPGDPRLLDVNNDGKINDDDKLWLGTKTPKHRMTLSSDLNLFKCINFSFVLRGEFGWMDIDNLPRNETNRFYNTSNSVWTEYWTPWNPNSKYARLGANIDSPGVNIYEKRNYVRMQNMALSYTFPKKLINKFMIDNLRFSINVDNAFVISKWRTSDPLTKAITPRIWTFGVDITL

SEQ ID NO: 11641 - protein, 715 aa, Geobacter bemidjiensis
MNFKFNLIYTALFSGLAFSSYATETNQEVNTELEQINVATELEKAKAAGNKQKDIVNLSLLGRQPAFTSPISVVNYDEKAFEDKQPRNVVDAIAKTDASVMNFGGETNTLSGIYVRGLQLDARQISVNGLAGLYSTYNSPTAAVSSAQLIKGASTATTGMDPEGSAGSAMNIETKHATDNPINKIGFGWFSNNRLQESFDFGRRFGENNAWGVRVNGKYRDGDTARHGYDEINKEFAVAADYRGDKFRAAIDYMYAKRATNGGRARVQDIQNLDFAMPKAPDGKINLIPSWSGQTTEDQTVMGTFEYDLPYNMMLSGGLGHMESKYYGAFGQIRMTNTEGDYSIRQMRAIDYRIRTTSANLKLQGELETGSLYHMWNTSFDFVQRQRDFDQSPVLSNFSTNIYNPVFPSVTAYSALQQSTDEKSRSYSWALADTVGFFDNSLRLTLGGRFQWIKQHNYKNDSKGDKNRFSPMVTLAYVPNPDLVFYGNYLEDLEPGYVDEDGNMAKPVVSRQIELGVRKNWGDLFTTTASIYQIRRPGIVTTNLAKNNADFTVGEEQGEERNRGIEFNIYASLFNNTVRPSLGITYNKGELIDYSTYAGAIKTGTQVASPRIISKANIDWDTPFIENLTLNAALQYYGKSYQDIDKKYKLPAYTTVDLGAKYLIKLNETQTLTLRAAVENVFDKNYWQVQRGKYDRSFAVVGMPRTYWLTAEYTF

SEQ ID NO: 11642 - protein, 66 aa, Geobacter bemidjiensis
MQKAAPGYVIANATLFSAAILPSLDFSLSVRNFPDRRYEDPATTDHRQSLIAQDGRTFRGQATYRF

SEQ ID NO: 11643 - protein, 354 aa, Geobacter bemidjiensis
MKRSSLVLALTALLASTSVGAAEIYNSSGNKLDLNGRINAGRVLSNDDSNNVDASYARLGFKGETVLGESFTGYGQWQYQFQLNKSEGSDAVSGDKTRLGFAGLKYGKWGSIDYGRNYGLVYDVLAWTDMLPKFGGDSGNTDVFLSGRATGVATWRNNNFFGLVKGLNIALQYEGKNDRTGDVAVRRSNGDGYATSVSWTGDSGFGVSGTYANLGRTETQNRASYGKGERAEHWATAVKYDADQIYLAAMYGNTHNATPISGGFANKAVNFEAVAQYQFLNGLRPSLAYVSSRGKDIENKGEADIFKYISAGTYYYFNKNFMVYAEYKFNLLKKTNPLGLSSDDVTGLGVNYQF

SEQ ID NO: 11644 - protein, 727 aa, Geobacter bemidjiensis
MIRSTEMRLISVGARRHALPRALFAALCTLAAGQVLAEAPTADADVTTLDRMTVQGEQAKGYTVEKTSAGTRMNLALREIPQSVTVITRERMDDQNLQSITDVLNNVTGISASQNDSERLDFYARGFYIDNYQFDGIPAYMEQAWSYGDSALDVALYDRVEVVRGATGLLTGSGNPSASINLVRKHALSRDFTGTVSVGGGDFNKTRSVADLTVPLSPEGTVRARVVGVYQDGESDMDRYSLRKKIGSAIIDADLTDSTLLSVGYEYQKKESDDVTWGGFPLFYSDGTRTDYKRSFNPAADWTFWDTRLQRTFASLQQSFDNGWTLKANVSHENTEATNHLFYPFYTIFGFDRTTGGGVVPYSGNYQTERKADGADVYAQGPFQLFGREHQLVAGASYNRREYVNNGTFDFPAPLDSYLGWNGAYPEPNWSPRTVQSDGTIKQKAAYVAARFSLADPLTLLVGARYTDWQIDGRNADATQGLVPFSDTQTEVTPYAGLVYDIDDVWSTYVSYTEIFNPQTLRDANGGYLDPLSGKGYEAGVKAAWFDDQLNASLALFRIEQDNLGVATSTLVPGSSDFAYVAASGVVSEGFDFELSGRLTQGWNATLGASHYTARDDSGASINTQLPRTTIKLFSSYTPQGAWSDLTVGGGVNWQNRSYYVDPVYGTFQQSPYAVVSAFARYRLSPQFSVQLNIDNLLDKRYYAQFNNGYGAWGASRNGMLTFNYTF

SEQ ID NO: 11645 - protein, 421 aa, Geobacter bemidjiensis
MTKTLLSSVALAAIFASLVPKIAIGADFGSPDSVDNTLKTKPNPKLNWRESLEQNQNLTFGLDYQSLGLRASDTVTGGENNAAAGVFRFYGSWNLVGLDSGNVGGLVWKVEHRHKYTDLSPKEFSFIGNVTPSLPDGVGYVGMIGPAYSDQGSRLTNLYWKQKLNQGKTSLMLGYLDTTDYVDTYALASPWTGFTNLAFSTGGGAIGLPDDGVLGLAVGHMLTDNFYLIGGVADANGDSSDPFNSFFDDSKLFTTLEFGWTASQEQIYTDNVHVTAWNIDGGTRHNLSTITLPDGSTTYSDQNGRGINFSASYFATAQLMPFIRGGFSSGDVALYDTSISAGIGYFGLGNATSNLGFAVNWSEVNEAFGSGLDNQITSELYYNWAVNDYIQVTPDLQYIKNPAFSDKDSTWIIGLRLRVAI

SEQ ID NO: 11646 - protein, 426 aa, Geobacter bemidjiensis
MRQHTAVAVAGFLAAMAVGHDVQAKSLEDILKEKGVITEAEYKEASKAKPYDYKPGKGFVFTSPDQKFQVQLGGQIQVQYELDNYEASNKQDVSQFNLRRVKTLLSGYAFTKDLTYKATYNWANVVKDNTKAMEEVNMKYRVADELRVMLGQEKIQYSRQWLTSNTAQQFVDGSFVRNAFMQGYDTGINLHGDLWKGVVKYDAGLFGGAGQNTKNKTNDNAYNFRLAFNPLGDMKYGEGDLEHSVKPLVSMGSSYYLSTLKKTVSGTGTTATSAIDNSKSNFVTDSNGWLGQAVKGKYFGTAAAEKISVDSWEADFACKWLGASMQGEYFWGKAQGEASGKELIAKGAYVQAGYFVIPKRLELALRYAWMDPNRGLANDAVSEIQGGVNYFLYGNNLKIQGDVGNRHTYKNKSDDLVARAQVQLLF

SEQ ID NO: 11647 - protein, 903 aa, Geobacter bemidjiensis
MRRKVKSSVELPQLVRQTSRIAFVVATVGCFGLPSQALALQQEGGAEVEKVEQGERIVVTATKRDQTLEEVPIAVTVVGQEELISKGIEDITNLERAAPSYAVSTSDSATGGLVLRLRGVGTTGNNIGLESSVGAFIDGFYLPRPGAALSDLYDVQQIELLKGPQGTLFGRNTSAGAMVIKTNPPRTDIVEGFVNATIGNYDLYGVQAGFNVPLVQDKIGLRIAGAYRNRGGYITNVVGDESQTRDRISIRGQLLFDLEDAGELRLLAGYNRGKDDCCMAIWTQRSPFIEANSAPFSAFAPTAGAPNVGADAVDPYLANDNTNFVNPFHGWSIAAHYDVSLPFGELSYLGYYGDSFADSCRGDYTALNVYAVGDCPEIRALNPGIDLDPLNGTSIKSTSHELRLQGESFDGALDWIIGAYYSHEKIDQKYTFFFLDQMQEAVSVGAFGQPVFNELNFAAGGANSVLDYAAPRAQQKGESFSIFTHNVIELSDRLSLIVGARYVDESKNAKLSEQVPGQHNACFGTFNSLAGYLAPGGAYHPTDGFFGAGSPGRLAAAVQTNCWIFTSPFFDPSDPNSFFQQFVGDPVTSPFLQFIPQPFDQKFGDDRLTYTLNVRYEVADRTFLYGGYSQGFKSGGFNLDVSSASGGADPTFRSEKVDAFELALKSRFLGGRAWANIALFHTNLKDFQVLEFDGTRFNTFNTDKALSTGVEIESGFDLSDAVTLNLAGSYTDARYPSDCASFDPTDPNFTPAATSLCGTRLTNAPELVLIGGLDFNTEIGNAGMSVFGGATVRYESKRRTSTLPTELPATAGALTEDDVRAAVAAALPLPQDIQPGNTKVDLRFGFGAADGQFTIEAWARNVFDTRTRFVTFNIPLRGFGGSRARGAFVQEPRTYGVTARAKF

SEQ ID NO: 11648 - protein, 619 aa, Geobacter bemidjiensis
MRRNFINRLRFPCALLCAVLAAAPALGSGPDELSRSFGLSDPPPELARFPRPASRIAENVTVVTSEDIARINAHTVAEVLHTLPGIQMDQLQTPGSINFFTVLGASSRHVLVQIDGVAQNFIGSENIAQVGLIPVQMVERIEVVKGAASAAWGSALGGVINIVTKSPAADRAGMVSGSAGKSATRDLRAEATGSGERFGYYLTAGKLRSDGLVAGTDTDMNHGFGKLSYDFPNGGDLALSVDARHSINGTEESRLYDFHNTGAATHTTGNLLLHYPLAERLALEASAHTGRREAQNRRAVLTTGALFADFKAHEGFRGADAALSWGDASHALKAGVAYEETEVGLQEPVNLLPQMNYDLALRRESAYLSGTYTVGRLSILPGVRLDRLSLMEDPVSFTLGATLRLTDNTLLRGYAAYGYGMPIVSNIGMQNGEVRRDLQHVRTVQMGLESADLPFVWVKTTFFYAKVNIEDFDQPTPQLNQQVKQGAELELKSTPWYGFTLSGSYNFTDARDHRTGEKLSAIDSGPRQALKVGVRYDSEPAGLSATLLGDWAKLHNPGRFANTKGEFWDLHLTQKLSPDSDSSPELFLSWHNIFDSERYFYDFRANAPRWFEAGARWFF

SEQ ID NO: 11649 - protein, 351 aa, Geobacter bemidjiensis
MKKTVVAAVIGSVVASASVIVSTSAIAAEVYSGDELAVNVYGNLRARYETTDNNVMGADSTFTGEGTEIGLGMTYFLANDMYVNGDVLTEVNIIPESGDGDNFGDSVFLKFGSVALGGNFGEVRIGRMSAVQDTLAGQYDISWEYAGTANIKNDWSATDRLTNGIQYKYDMSDLGLTFMAQYHTGQEYDGINLKNEVEIDQAFAGGVAWASDFGLGLSGTYTYSERTKTDVKYGGDDDTSWTLNATYDIDALSLAAMYSDYDFAGDKQTGVGAMARYDLPMGLGLYGIYDYVDYDTDNNKLDQYTIGADYWLNDSVVSYAEYADMSYDKQSSNGNTFQDDSAFTIGMRVYF

SEQ ID NO: 11650 - protein, 189 aa, Geobacter bemidjiensis
MKKIVPLLVLWVGLLGAFEPKKSHIYFGAMVGLAPIEITPKPVSNSSYAAFLWGAKGGYQFAFFKALAIRGEFSYLMAIKPTAFHTTNTSLLSLNIDALSDFYTYKKYSFGVYGGVGIGYFYQNDRLEMGNGSFMGYNGLFNAGLFSTIDKHHCVELGAKIPFSKTRNSFKDPYFLESVFFHVAYSYAF

SEQ ID NO: 11651 - protein, 466 aa, Geobacter bemidjiensis
MKKLTSCICIMALAVMALAGIAQAGERAGAFSISPFIGGYMFDDNDQAYFRQNRPLGGLRLGYDFTDHFAAELVGTYMKAEYKATEHNVGVYSYRLDLVYNILADSPIVPYLAFGGGGTTIRQRGPNSHDGTVDAGGGLKFFMNDNLALRADARHLVDFQTNHLGRDHARNWEYSMGLSFLFGGRERAAAPAKTAAAPVEQPAAVTPAPEPPLEVPAAEPTPDHYKYCITLQGEFDIDKAIIRPEYKEEIAQVGNFMKKYPTTTAVIEGHTDNVGSYNHNQDLSQRRAEAVVNHLVEQYGIERSRLSAKGYGFTRPIADNATDEGKQKNRRIEAIIDCAFDVQQVTPPDRLCMSLVLDFDPGKAEVKQQYRNEIAKVADYMKRYNTTTAVIEGHTDNTGSPEKNMKLSQQRAQNVVNHLVDNFGIERSRLSAKGYGATRRISYNNTPEGRQKNRRINAVIDCVVTK

SEQ ID NO: 11652 - protein, 1042 aa, Acidithiobacillus ferrooxidans
MKKPIAYLKLNHVLLCSAIGFTSLNAMAESTNNAINETLSVLRTNQGNLTIKGTISDKTGPIIGANVIIKGTTNGVITDIDGNFTLENVKKGDILQVSFIGYSTKEIKISNNNNLHIQLDEDTQSLEEVVVVGYGSQRKSDLTGGVTAVGEDKLGLVSTNNLMDKLAGQIPGLNISTGNAQPGEDQTLRIRGNNSLTASNDPLIVMDGIPYSGSLGDIDPDIIESMSVLKDASSAAIYGSRGSNGVILIQTKKGRQGKATVTYKGQVGMAETERRLDMMSGDEYLQYLYDYNHLKNGIPYDQLTPESVLGADELANYKAGRTIDWQDKMFRQALVTNHQISLTGGTESTTYMASISRLRQDGVVRNTGMKRTNISLNINQNLGKWLKIGMSMQAIQKEYGGELPYLEAGLKMSPFGTYSDEEGNLEYYPMSRNTLFYNPMSDCDAIEDKTNRNVFISTFADITLPVKGLSFRTNFGYNYRNNFVGTYYGRNTLTGSKVDGAASIENTHYWDYTWENILKYENTFGKHKIDATGLFSIQETSKQYSKQSAESFVNDEGGYHNMAGGEKNKSLSSSLTETALLSYMIRLNYAYAGKYLLTLTGRSDGYSAFGANNKYAFFPSAAAAWNISSEEFMENTRNWLDMMKLRVSYGANGNQGINAYQTLDRLSLTQYIWGDGGNTVNGVYLPTNGVGNPNLKWETTYTFNTGIDFGLFNGRLSGNIDFYIANTKDLLMNRTVPYMNGYRSILDNIGQTRNVGVEFALNSINIETKDFLWKTNVNFSLNRDKIIKLQENGKDDITNKWFIGEPTNVYYDYNVIGTWQTDDPRWKCLVEKDNAGNIISEKWGYYTDDWKEIQKGAEPGSAKLEDVDGDGVITADDKKIIGSKLPSFLMSMTNNFTYKDFYMSFVLNGVFGQWRQMHDQNFDRWMPEFNYLSGMNYWTESNPTNEMTSPSYVPYEKHSFYKKMNYVQLKNITIGYNIPKTFTQKLGITSARVDVSVNNVCTFSNIKNALNYDNAKANDDEKGVVVGYPTARSYMLGLNVTF

SEQ ID NO: 11653 - protein, 596 aa, Acidithiobacillus ferrooxidans
MRSNIVKKTYLLASSLGLLGVVAGANIATANEPVKLENLSAAEPQNLQVSEALPAPNTVADASSTIRSVNELLANEESMGQVTSVSQLSDVRPTDWAYQALASLVEKYGCIAGYPDGTFRGNRAATRYEMAAALNACLDVISDRFATKEDLATLQKLMDEFKAELATLRGRVDKLEARTAALEATQFSTTTKLTGTAVMSVQFGGRPSSPLPSVRPNDPITGVPLPLAPGRTNPTVIAGVLLNLNTSFTGTDLLQTTLSTGNGGLDAISTYGLGSQIISTLGTGDAFTAPLPYFSPSQYYWSNFGPGVTLYRLAYSFKPTKDITITAGPQFYPSDIIDTNSWANSPASDFGSYFFINNPFIVPYAMNYLGGAGAAIQWNPKEGPFTVRALYIAAGAGTAAAGIAPPNPGGGFAGDPFQASLELEYANTFGNGRNSYAVKLQGTYSKTYGIEAQAGGVNFELNLGRLGIFGRAGVAGIPSTYFPGVSPLPFSIGPFPAAGMMAYNFMAGIGYKDLLVPGSVLAVAAGAPFINSAPAVPPINNANQVNVEAFYKFPISDNISITPIFTAIINPNNTNGAGAISGQPILQGVIRTTFTF

SEQ ID NO: 11654 - protein, 196 aa, Acidithiobacillus ferrooxidans
MNRFLLPLLAMAFASPVAAQSSLPSSEGGWAGGHLGIQLGMPISSSLTFDSAPGIESELDGMSGGVQIGFRRQTNAFVYGGEAAFLVSEPVIEQMGAPDVDVRVTTTRLGAQAGYDLGRFLPYGTLGVARMTFQDTVGFGDTSSFGTFAGLGVEYQLGESTSVGLQAVRENFENFNEGADINVTQTNVSVQFNIRY

SEQ ID NO: 11655 - protein, 394 aa, Acidithiobacillus ferrooxidans
MNDKRTVFAFNPLCACIALLGAGVSMQAAAQSSVTLYGVVDTAFAYSSNQGGHSNTYMSQGNLLASKFGLSGTEDLGGGTQALFRLESGFNSATGAQAAAGYLFNRLAFVGLSDKTYGALTLGRQYTPYFQYVAALGPTNVLTGATGAHPGDVDALDTTLRFNNSVTYTLPVIGGLQAGVQYGMGEQPGSISGGSSFSAALRYDYQAFAWSAGYIHLKNIPTSNSVGTFANNSPVNSGYASADSAQLIATAARYTFGKLMVGLNYSNVQYKPGAGSLFTQAAMFNSYGLISTYALTPAITVAAGYSYTAEKARNGISSPARYHQFSMEQTYALSKRTAFYALEAYQKASGKTLRTVGGVSTIVDTVASVGDSQNGTPSSTGHQFVGMVGIRHLF

SEQ ID NO: 11656 - protein, 136 aa, Acidithiobacillus ferrooxidans
MSQLVYFSSSSENTQRFIERLGLPAVRIPLNERERIQVDEPYILIVPSYGGGGTAGAVPRQVIRFLNDEHNRALLRGVIASGNRNFGEAYGRAGDVIARKCGVPWLYRFELMGTQSDIENVRKGVTEFWQRQPQNA

SEQ ID NO: 11657 - protein, 738 aa, Acidithiobacillus ferrooxidans
MIYLMVFMLFCVLYFFSPAKAEQKEEVKLEEIVVTATRTETPIESAPASVSVITKEKIELKAPKTIDQALNDVSGVFVRRGKGLMDTLSAITLRGIPDQKRTLILMDGIVLNNPYTGNVRMGGYYPEDLERVEVVKGPFSSLYGGYAMGGVVNFITKMPEKREFTFKTGYGSSWNRGEAMDDLRRTYTSYGDKLWDKLSIFLSYGWQGTNGYPNDLNIRSSKPSGTYTGGEYVTYYSSTYGVSTGYLVGDKGDNRWWDDGITFKAQYEFTKDTKINLSFMRNRYEYNYDNPHTYLKDASGNPYYLGTSEYTFLNGAGGRTQNTYALGFETNLYKDMKMKLNLSYLDIEKDWYVTPSTSAKIWGCTTPGSTCSYVTNTPAESYMGDIQFTIPIFNNQILTFGGSFKHDYAKTKDEYLSNWKDEDSKTGVLRSESKGKGRIYSVFIQDEIMFLNNLTVYVGFREDWWKTYEGYAYDTTQTPTKIESYPSKSKSSFSPKFAIVYKPFDTTTLRGSIGKAFRPPTVYELYRTWRSSTGTIYLPNPYLDPETAVSWDLGIEQKLWKDAKASLTYFENHMNDLIYRKSTGTNRDYINVGKAESRGVEFEIEQRLEKWLRLFSNFTYTDSEIKENTAEPLSVGKRLTYNPLWKANIGAEFEKSGFSAYIVGRYVGKMYADDRNRDYANNVYGSYDPYFVVDGKIGYQFTKFAKLSFSVDNIFDRKYYQYYKAPGRSWFTELTLKF

SEQ ID NO: 11658 - protein, 278 aa, Acidithiobacillus ferrooxidans
MTKLYNKLFQSLMIVSTIKFGVVDAKAETFIRGGYGISISDRLNDYGKDGYVPASKPKNSWVYDVSVGYKLNNNILLDIGYKKFSKFKYSAIDPSKYSYKQDISSDTYTINTQYNFDNNSKIFPFLRMGVGISKNKLGKYNVINLDDNSKKYTLDSNKSNNFTFNIGAGLGYKISEKLYVDFRYEYTDLGKIKNSSKVLENTIQENIKPPVSSLKANSFHIEQQRKNEQLIQEHQKLQNYIIDAHKKMQDHLIDSHNQEIASKTLIQLILSGISIKIQ

SEQ ID NO: 11659 - protein, 203 aa, Acidithiobacillus ferrooxidans
MKHITALTLSALLASAAVPAFAQEKGDFLLGLGLGWIEPGDGSNTAAGKVSADGAFSPTITVEYFVADKIGIELLASWPFEHDIDLGGAGTVGETKHLPPTLSLQYHFTNSSAFTPFVGVGINYTYFFDEKGKGPLNGVSIDLDDSWGLALHAGADYAISEKSALRLDVRYIDIETDAKVGGVNIGKVKIDPWIFNAAYVMKF

SEQ ID NO: 11660 - protein, 1089 aa, Acidithiobacillus ferrooxidans
MLALFLKSNFVVMLKRFRLVHALVLLLGGSFGVNAPLFAESLTGIGQQQENCNGVVKDATGETVIGASIIVKGTTNGTVTDLDGNFTLPGVKVGDVIQISFIGFQTQEIKWNGKPLTVVLKEDSQALEEVVVVGYGTQKKVNLTGAVAMTEGDMLEDRPIANLAQGLQGAIPNLNITMPSGNPNATATFNVRGITSLNGGSALILVDGVETNDISLLNPQDIESVSVLKDASSAAVYGARAAFGVVLITTKKGKKGQKVTVNYNNNFSWSAPSRLPDGISSDKWIDAVQLANTNASGSGYFSQELVDAVHAYCQDPSRPSAFLDETGAFTAKGQWAYAGNTDWFDEFYKSAAFMQQHNASIQGGTDKNTYYASIGYKGQDGLLAYGTDTYKRINMSFNFTSQITKWLEIGFRAKYNRSESDEPNTQAYMGSSPYYEVYRSFPFIPIYLPDGKNFAAMEGSNFNYNYAGILAEAGRLKNVYDDIWYTGSFNITPLEGLSIKGDYTGNRYFRTQREHLKTIYQLNPDGSQTAKMPTNKAGLRKYDDTYEALNVWAEYKKQIKDHSFSIMAGYNQERKNTSNMYGVAANLYVNDFPIIDMAKDKETLSEEATVWAVQGAFFRLNYDYKGRYLVELNGRYDGSSKYASGSQWGFFPSASLGWRVSEEKFFEPARKIFDNFKLRASVGSLGNQVTNGNFDYIGTVGSETLNYVLSGAIPSGITPATLAYNNVTWEKVTTANFGLDLGLLNNRLTASFDYYIRYTTDMVVSKAYPNTMGTSGGKENLASMRTNGWELSLNWNDRIEDVAGSPLDYNVGIGLSDSYSTITKYDNPTGTLNDLYVGKRLGEIWGYTTDGFIMDAAEAAEQSKRQSYISNTWIPGDIRYADLNGDGVVNEGDSEKGPINTLSNHGDKSIIGNETPRYRFNINLGLSWKNFDVRALFEGVLKRDLWLGNEVFWGFSGVWNSAINDYHVDNSWSEDNPNAYYPVPLFNSDRSRKTQTKYLQNASYIRLRDLTIGYTLPKKWLEPVGISQLKIFFSGQNLWEATGLYKYVDPDMTGNTYQKSSDGMVGTLNSDMKSYPFCRSYSFGINLTF

SEQ ID NO: 11661 - protein, 730 aa, Acidithiobacillus ferrooxidans
  misc_feature (730)..(730): Xaa can be any naturally occurring amino acid
MPRLATLAAALAAALFASAAVAQSRVAIDIPAEPLDAALNALARRAGVQLVFASALTAGKTAPRVQGRYSIEETLHRLLAQTGLTARRQGDDTFTIEAAGSGAEVTLPATVATAAQAESANGPVRGYVARRSATGTKTDAPIEEIPQSISVVTRDRFEAQGAQSVNEALRYTASVSSYGAGTRSDWYTAVRGFVPATYLDGLQLPNTINLASWRVDPWQIERVELLRGPASVLYGQGDPGGTVNIVTKQPTTEPIREIEVQYGSHARKQVAGDFAGALDADGKLSYRLTALVRDGNLPLGPFNDQRLMIAPSLTWKPSADTTLTLLASTLRDKTNASDSFLPAQGTILPNPNGKIPATLFTGSPDFDAYEKTQYSLGYQFEHRLNDTWTVRQNARYMHLKLDDRMTYGVGLDPSDPAQRTLLRYAGIAQPSYGRLDIDTQAQARFATGAVRHTLLAGVDYQRQTAKDPENYALTSSLDLYNPVYRPTDLSIFSGAGASPQDIRQRQTLLGLYLQDQVKLGERWVFTVGGRHDWSETRTDDRLGGTTGSQRDSAFTGRVGVVYLAPYGISPYLSYATAFNPTIGTDRNGQAFRPTKGRQVEAGVKVQAGSKASVTASVFRIRQTNVLTPDLDDPSGTHSTQAGEVRSQGFELEATVQPMAGWNVIAGYTYQDVRNTRANDATLDKWPIAIPTPRQIVSLWMDYRIRTGVLQGVGIGAGVRYVSPVASTLVX

SEQ ID NO: 11662 - protein, 384 aa, Acidithiobacillus ferrooxidans
MKKSQLALLLPLLIGASSVNAMELYNDNKNSLGLTGWLGFNALYDGDETAVNDNLSQLRFTFEREERNGWRAYAVTEWGVNIVSGNEDLVMQGGKLNAEKSGDFLNNRLGYVGLSHDNYGSLTFGKQWGAYYDVAGTTDLPNVFAGYSVGAYGFGDGGLTGTGRADSAFLYRNSFGPVSIALQYAAKNNGDISVTDSDGNQIDDAELSFDNSYGASVTWAVTDKFSLLAGMNRGDIKGHIGSSEIDEANQIIGIGAMYGSYYHYADERKADGLYLGFNAHKSENNEQVNGDLYDATGAELMLAWQADNGFVPMAVLTYLDLDTDESTPITGNWTRRFAMVGLHYRYSLDTVMFFEAKLDFSDMDDKSLEALEDNQFAVGINYFF

SEQ ID NO: 11663 - protein, 1011 aa, Acidithiobacillus ferrooxidans
MKKNLNLPKKKTGRLRNLFLTVCLLASVAASAQEKTVTGTVTDALGDPLIGATVLVQGTSNGVITDIDGRYSIQATPENTLDFSYVGMVKQAVKVGSQSVINVQMKDDSQMLAETVVIGYGSAKKRDLTGSITNIKGDEIANKPVVNPVSALQGKIAGVQVINSGKAGSDPEIRVRGTNSINGYKPLYVVDGLFNDNINFLNPQDIESMEILKDPSSLAIFGVRGANGVIIITTKKAKEGQTRVNINGSFGFKSITDKIALTDAEGFKLLYNEQLRNEGNPEYNFSDWTGNTNWQDEIFQTGFITNNNISITGASDKNSFYLGAGYAYEQGNIKHEKYSKITLNISNDYKMTDNLKVGFQFNGARMLPADTKSVATALRAAPVAHVFNSEYGLYTSLPGFQKAQMNNPMVDVDLKANTTKAENYRGSGNVYGQWDFLKHFQFKAMFSLDYASNSTRTYTPVIQVYDASVEGDIATLGNGKTGVSQAKETEMKVQSDYLLTYTNSWGDHSVTATAGFTTYYNKLENLNGARTQGVGLVIPDNPDKWYVSIGDAATATNGSTQWERSTVSVLARVLYNYKGKYLFNGSYRRDGSSAFSYTGNQWQNFYSVGLGWLMSEEAWMKDITWLDMLKLKGSWGTLGNQNLDRAYPAEPLLTNAYSAVFGTPSAIYPGYQLAYLPNPKLRWEKVEAWEAGAEANFLRNRLHFEGVYYKKKTKDLLAEVPGISGTVPGIGNLGSIENSGVELALSWRDRIGDWNYNIGMNLATIKNKVLSLVQEGYSIIAGDKQQSYTMAGYPIGYFYGYKVEGVYQTQEEIEHSPKNTLATVTPGDLKFRDVNGDGEITTADRTMIGNPTPDVTYGFTLGLGYKNWELAVDMMGQGGNQIYRTWDNYNWSQFNFMEQRMDRWHGEGTSNTQPLLNTKHTINNLNSEYYIEDGSFFRIRNVSLAYNFDKALISKIGMQALKLYVNIQNLKTWKHNTGYTPELGGSAIAFGVDDGSYPMPAIYTFGFNLTF

SEQ ID NO: 11664 - protein, 179 aa, Acidithiobacillus ferrooxidans
MNKSMLAGIGIGVAAALGVAAVASLNVFERGPQYAQVVSATPIKETVKTPRQECRNVTVTHRRPVQDENRITGSVLGAVAGGVIGHQFGGGRGKDVATVVGALGGGYAGNQIQGSLQESDTYTTTQQRCKTVYDKSEKMLGYDVTYKIGDQQGKIRMDRDPGTQIPLDSNGQLILNNKV

SEQ ID NO: 11665 - protein, 689 aa, Acidithiobacillus ferrooxidans
MALATAASAQSTADLYDLGTLVVDGSADPSDPVPGYVATTAATATKTGTPILETQQSISVITGEQIEDQGATTLGDTLGYTAGLTAQPYGTDPRFDAPTIRGFDGSDAQYLNGLRLIRDLGAPAFEIYSLERVEVLKGPSSALYGAGIPGGVINQIQKRAQFLSFGELGVGVGDPKATEGFVDYNHAFSDTFAARITAVARDSEEDVEELTNERKYIGLATRWAPTAATQIEFLGSWLKDSPITPAGVPYGLVDKVDDDDLRSFYAGDPSDDDSEREMLNLGFSAHQEINADWSVDANFRYQKFDWDYTGFYVNSVDADRDTISRGANDTSEDSYTQNLDLRLNGHFDTGAVAHRVVVGLDARRYGVESETGFRYADPISYSDPSYDGANLSDAWYVSADDLTLEQIGLYAQDEMSFGNWRASLALRHDWTSQTGSTYTNFAGTSPVDQEDEATTGRAGISYVFDNGLAPYLSYATSFDPEIGTDNSGSAFEPTRGRQWEAGVKYQPLGFDGFFSAAVYNLRQENVLSAYTDANGIGDYRQEGEVLSRGIELEGSADLAQGWNIRGQYSWNDTKVLSGDNDGKLLANAPAHNASLWLNYQFASASALDGLQLGGGVRYIGERYGDAANSYDLEDVTLVDLQASYAITEDLGMSVNVSNLFDEAYVANCGSFGCYYGDGRTVQARLTWKW

SEQ ID NO: 11666 - protein, 1492 aa, Acidithiobacillus ferrooxidans
MNKRNLSIILLLAVISDKSADGAVFTVSNSGDSGYGTFNQAILELNSAGAGANAIEFTAADPEITLFLTPEFIKKPAVIMTNNGGAPLQVTHVTSTANARTLKVTTNVQVSLADELLTLGMQSSSTGSVTLYSADNLIISGNLGSNLLNTSTGSSAYGVYAGGSLSLSGAVSRGSTISSQATGSVYALYSVGNISVSGELSGSVSAKATSGGTAYGIRSGMSKTTTLNLGGGVTSSATITATAVNTVNNSDSTVYGIYSGGAITIGQRGQTTGISGVVSATAGYDTAYGVRGNTVTVHGGVTRTGRISVSAGRNNAFALDATTTLDMVGDLCGDISATAMTGGTAYALYAGSALTITGDIAASSTVTASAGSSKAYAIFAEDGPVVINGSVIGRLSATTGTTSAYGISSGTSLDITGDISEGSTVTASAGTGIAYGLHGAAGLTIGGGIGGEVIAKTTKSGGRVYGLYGGSDEGSSLTITGGIAESGNITAEGVSGSTACGIYSAGSVTIGRSGGTTGVSGSIVADAGLDDAYGISGNAVTLYGGVGATGSIRADAAESGAWGIYSASTLEVNGDIAVSSSISASTGTTKAAALYAEGGDLTIRGSVGGELLAIAGTSGAYGIYSGSSLTLAGDLSGRIDVSSRKGSKAHALHAGSSLIITGSIAESAKIIASAATTEAYALYAGSGAISVRGVVSGEVSATTGSNNAAGIYAKAGIYGATESDALTVSGMVSAVAKGAAAGIMSEGPMNIFVSGTLSGVDNKNGTLGYAIYSGGFAGSGEFSDSIASDDRIVVAESGMLVGNIALGAGSDMMTMRDSGSVTGDLDFGENDDALLMSGFSSVTGSIVMGSGSDSLIMTGGSMVNGAINFGADRDLLHLMENARVTGDIDFGTGDDTLRLDNGTVLASTVRFDKGDDRIELSGDVDISRSPLIDGGSGDESAGDRIVLSSWNGVITDAFKGWERIEVAGASCVNLDLDDLLRLAPSYGQQLTFMIEAGSTVMATGNSPGRYEIAGNLENSGLLDLRDGEANDRVTVSATYTGGGGSLGLDLALGGGSQNNQDALDLLSVGRVSVAGSGTVLGSTALLVRNISEKGKIKMTTGGNGILIAKVYGTSSSNAFSVDGSSPVFRGANVRVVKVGRDWYLQILSAPNVDTTTDLSDEEVSDYSIDTSVEAIESSGIPEEHRVLQTILPMLERHGAESVPRFRHRQLYYWSRGDHGGQESWWIRTTGSRFLFRAESGGQPAETGGYRSAMQIGSDLKAFRFSNGMMRHGLYAGTGYVKSDIMEEGGVSAGRVDAFTMNIGGYSSVELSGTTFLEGVVQATRYDVDASFKGGAKSSGRFWGFSASLESGLRIGIAGSFFLEPQAQLIWMRLGGFEMHTPSGGVQLHEESSLLARAGMAGKFEPEGLSFSPFFEINTERDSGASSQVTYKESGRSLRVDAERVHVGGAVGIISRNAKRSGIEYSVKTGMMAGIGNTGSREYQLNVALRKSW

SEQ ID NO: 11667 - protein, 768 aa, Acidithiobacillus ferrooxidans
MPSIVSARSFLLLLGCTTALADSAFAQSVTPSVTSSQAAAATAETQTDDESTAARASFGHADDQHGTTTTESSRTGEDDITVNAHLERARAALQPSTGATTYNFSRQAIETNPGGDNAGLNTLLLQAPGVAQDSYGQIHIRGDHNEVQFRLDGVALPEGMSVFGQTLMTRFAHSMSLTTGALPSEYGFLQAGVIDINTKNGYSDAGGDVSIYGGSRDYFFPSAQFGGHHGKWDWFATGDFVHNRVGIENTTPSFNAIHDLTNQYHFLGHARYTVDENTRISLTAGVSNAEYQLPNNPGQQRQFANPSFANSDLSQKLYGNGDSSSLTEHQKEITDFGILSLQKDMGKLSFQTSAVLRYSSLRYSPDPLGDLVYNGIAQRAARSVFSTGTQSDATWQAAKDHTVRFGYQIYVERNVSKSDSTVYPQSGEDSDGNAVYSDNPLTIHDGTGRTGWMYGLYAQDEWRPLKNLTINYGLRFDGVDEYTHAKQVSPRLNIVYKPWHGGTFHAGYSRYFTPPPFELVGGTSLNKFANTSAAPGTFLNSNVKAERDHYFDAGFSQTILPGWHASFDAYVKLAKNMIDEGQFGSPVILSAFNYRRGQVHGYEFATDYTRGAFSVYGNFSWSRAIGKDITTAQWNFDPDDLAYTSKHWIHLDHDQRWTASAGASYSFFHRTGHPLRLSATMVYGSGLRADGATPNGDSVPQYATFNLSLVQSFKDLFQVPFLKRTQLRLDVTNLFDRTYLLRDGSGIGVGAPQYGLRRTILTGIDQRF

SEQ ID NO: 11668 - protein, 712 aa, Acidithiobacillus ferrooxidans
MQHEASRNNSLAASRAVLLRSLGVGAALCISGGVATAQEATPQVEETVVIKAKGLRDSEKAKERLKNVAGTASVVNNAEVERGRAQNAEDVLAYQAGVFAAATSGTGANKISIRGSGLNSFYQGYSLGIKYLFDGLPITGPGGTQEDFLTLTGVDYTEILNGANAFAYSALSLGGAINFVTHTGRSAPGNTISVEAGSFGYRKYQASTGGVSSSGDTDYYFQYSHNERDGFQRNTPNSGEEYIFNLGHRFNDRLETRLVIRHRGEELRNGSTLTLAQLEADPRNSTSTASARRKKGTTLVTSKTTLTLDDKSKFELGFAYNDYPLDNGWIYSDQPGIWRSKDFSTSLRYLRTGDTLFGKPSDTTVSFSDTRLRDGDVTGYNQVNGVYTSERQYTKYSGSRDTVLSVSNALHLSDQFTLSSGLSLVEVGRNVRIERTTLPASPLPFPREVEYTDRSLAPRLGFLYQAAPDLQLFGNVSRSIDPPVTWQMASTGVSYVRPLKPQKANTAEIGLRASSENHEGSVTLYRSYVSDELLSSIASPAVGATPALIANTNGSKTIHQGIEAALTSKLWRNTGGDRLSYRQAYTLNDFYYRNDQRYGKNELPSLPRHVYQGELLFQQAGGFYSGVNVRAMSGYYVDYANTLKAPSAVIWGAKFGYEEPGKKWKAYLDFRNLGDKHYAAAANTVDNARGLDSPNFYPGDGFSVYSGVTYRF

SEQ ID NO: 11669 - protein, 749 aa, Acidithiobacillus ferrooxidans
MSGTFRRGARQSFQFFRFSTFAFIGLPVSAFAQNAPVTNIAPITIEASPDNSPFGRADLKPDNTGNLARVAASSRPHTETFTRADIDALKPVDVYDLLSHATGVMPTFQGRKLSNNLQIRGDSNYGFIIDGAYMPLATAGRVLRTLPVSLIEQVDIIRDPTALTLGPMTNLDTASGALNSGFIVIRTRRPSKTEGESRSRIENFGTFSSSGYAGTTFVGAPGEPNAYVSGLLSYRKTNGPSGYNAWENTQSSQVAGGVIAGGFRTDFTVFQDHARYGFQRATDGQNVSSLVAQQWSFTPIDTLVATSNSLFTWDAINSTMLILSYNLVSANNVQASYANSAITSNYDRTYTFNVHMRHNIHLGDTLLQLGTQYVTYDSPTGQMFSAGYAHSESILSGYGNLEHKFFNDALTLDASARVDDRTINQGIDLYNLGSGSGGGNAGSGTGSNSGTSQAGSGTGGGKSGSGSGSGTGSGTGSSSTLYSYFYNRQLPIALNYAAGGTWKILPQLLATARYSHTEQSGLPMAILTTTGTSLAPETQNKWEVGIAAPIAPYFQPGFNYFDINVANDKTPTSYQTINGYQTPIWSQSNTHRSGFELLANGTVLPVDWLGHGNPDLVNTDLGDLGPTTYRASWMHLGQASSSSIAVYGATLARDIVNFTLTQNWNRFNGTVALSYFSPFLSNFNSADGGYHQIGNAVVVDLSVGYGFKLGLSDTRISVYGRNITNRKYETVYGYPAWGATYGSELVISF

SEQ ID NO: 11670 - protein, 671 aa, Acidithiobacillus ferrooxidans
MQKNIHKKVYARTFFLGLAIAAGELSVNATPITSLNSGQQNSPIVAESGNFPKSKFFQPIQIANAEELTINELLGSGSNKTYQGDRSLHDLEDNSQAQVTAVGQLSDVDPTDWAFQAIQSLVERYGCVAGYPNGTFRPSRAISRREAAALVNACLDNLSNRFATKEDLDALKALQDEFAAELATLRGRVDGLEARVATVEAQQFSTTTKLQGEVVMAAQFGDFVSNAQNTFPVPRAIPNGNAPGLVATNSLNPLQPTNLTTISDSRPSAIARVRLNFNTSFYGDDLLQTQFEFGNGGLDFFSAAGLNSPVSNGIGGPLGNPGPFVGGDPNPFPVPRVVGGTSPGNNLGVSLVDLGAVDYAGLRNGVVLRRLAYSFKPIGQDVTLTVGTNMFPSDFIDSNSYANNSAQDFNSGFFINNPLIIANSTGFSAGNWVPGGAGAAVDWNVNGGPVSFRALYIARDGKIAGRNPGSALCDPAFPCTGGLFGDPYQASAELEYADTWGEEAQNNFAVRLQYTHSETNNVRQNALGANVEATFNRRFGIFGRIGYSIDPQIVVNTVTGQRGDLFNPDPNNAFGTGIGNTGISNYILTWMGGLGIRDLGAPGSLLAVAIGQPFVVAGDGQPSQTNFEAFYRFSINDNITLTPTVMFISNPFNLSGNNDVIQGLLRATFSF

SEQ ID NO: 11671 - protein, 689 aa, Acidithiobacillus ferrooxidans
MIDALDPTIRYIPAPDGMTVGPLEGYRPRNPGRYDDGPGAQAFYESVLNHPDALEADAINAQERFSLYSLSDFDIDILGGVNWQFEALYTERETTADGIRQFFPLVGGAEVQSVFGVYGYANDPGYSNPFFLSQPILIYQANSQAEVKYLSVSSELNGEFGGTGYFSDWGWTALTTFSRSDGKYGTDTAIFADQSGDVRFDDDAPQFDYQSAEILSGNYPDNFYDTLGGPIVGRTTYEQFVASTYVTGDLFALPAGDVLLALGAEYRGFSIDDQPDEQAQAGNLWGSSSALVTKGEDNVTEIFAEAEFPLLKGAPLVEELTFTASGRAFDYESSGSGDVYKVALDWQVVPAVRFRGTRGTSFRAPALYELFLGQQTGFLDQADIDPCILWEDSTDDDIRANCAAEGIPGDYGGGTSSATIISGGGAGFLEPETSDALTFGTVITPEFFPVSLALDYFEIEVNNQIAQLGAGTILGGCYGGDNFPNDFCDLFTRGTATEPLAVNEVTDTFININSQVTRGLDATLRYERDFDFGTLLVDAQATWTFEDTLDLFDTDSESGFATEDFNRTIGDPDVVGDAQVRFTRGDYTFSWFLDFVGHTSNEVFDPVDTTYFGAPAQRIVETEAVWYHDASVRWTGDLLTITGGITNLFGEEPPIVSDGVTFRRGNVPIFGTQYDLRGRQAFIRVTKEF

SEQ ID NO: 11672 - protein, 224 aa, Vibrio fischeri
MRNSVFALSLVTLALAASCATAHERGDIVLRAGAVVVDPHEDSEDIRLAGAGKLPGTKATLDSDVQLGLNYLYMLTDHVGIEYLAATPFTHEVKAKGLPGDLNGRLGDFKQLPPTVSLVYYPFSPHATIQPYVGVGLNYTYIFETKLGKAAEGKGFSGLDMQDSIGLAAQVGVDYMLTDTLMLNAQVRYIDIESKATTYLNDSKVTVDVDVNPWVYMVALGYKF

SEQ ID NO: 11673 - protein, 340 aa, Vibrio fischeri
MKLVKSCIAITLCSLLSMPTFAADKASEKTQKQEEVINFYGKLNISLQASEEKGESFNELKSNASRVGVKGKYELDHDLTAIYKLEWQVNVNDDSKDTLTARNQWVGVRGGFGELTVGRSDTTLKVSQGKFDLFNDYEADLKHLFIGENRVADSITYKSPVFSNVQLLTSYIISDDIEADDPYSVGIFFGDLSLKKTDFFLSVAHDENMPVKFKPVDSGESSRTEALANTRVTGMYKFGDLRLGAMFVDTEVVNTGKSETGYAANVSYKIGKVLAKVQYQEFSGADSISVGADYKLGKNTKVYAWFTDREGNEVTAGDDGVDYILATKGQYFALGMEQKF

SEQ ID NO: 11674 - protein, 397 aa, Vibrio fischeri
MNNTPCVALGLTLLSQPLLAAEGGFFEDSKATLSARNYYFSRDFSDIVGANKQSKAEEWAQGFILDFKSGYTPGTVGFGMDALGLLGIKLDSSPDRTNTGLLPVHGDGRAADEYSRLAPTFKARLSKTELRVGELQPNLPVLTFSDIRLLPPTYQGASVSSSEIDGLTVQAGHLKSTHLRNEGGDGKMNAMLGHVPMRQAESDAFNYVGGDYAFNANQSSVSLWYGQLEDIYEQGFVGLKHSKPVGDWVLSANLGYFTAREDGEALLGNIDNQAFFSMFTARHGGHSFHAGYQGIYGDSPFPRVFANISPLGNEVPTYEFAYTDERSYQVRYDYNFAAMGVPGLTATVRYITGNNVDTGLGYEGRDRERDLDIGYAVQSGVLKGLGIRVRNAMARSN

SEQ ID NO: 11675 - protein, 727 aa, Vibrio fischeri
MSMLSRAPFLYALCIFVSSPVIANIDNEFDDLDALLNMPLESLADTKVVTATKTSLSLSDVPASVHVITSKEIERSSARSIADVLILAPGLHVAKFSDYDWTVSARSKNQGENNTLLVMIDGRSAVNPMYSGVNWDTLPVSLDSIDRIEVVLGPVGTMWGGNAVNGVINIITKDAESAPKAQLSASTGNFDYKEFKAHHSGQISENTHLSGYIESLQHSPFTDTDEHFKELRHLKVLTERFGMRADYQNLQNTVSVQFGGIQSREDYQWLTYTPAFLDPTTHKNDYDVFLTEMNSQELFAGFQYLHEKLNGNQWENQLWVTHSESDSTNEPASFTRIDLDTRYTFNTQDWGILTLGANARIIDEEYAQFSEKEQYFSPYIRTIDDHKFLNQSYGFYANWAVDVTDSTEITLGNRIQYANITEEWYSQPQVRALQKLTDNQRLWMGWGRAVITPSRLELDTQFQKNSYCSSCAYTVNPDGSVNYYDYMMSYHYLGNRDLDMESVDTYEIGYRYWQDNQFQVSLSLFYSQHDNVRAYRGLGGSRYFTPDSSQHSSGTIIDDMFAQLVDPLSQETMGGEVSIQWQPIDVLQINANYSYKTIEGDCNGSICGSNELPILDLENTPHHYATLHVMWDIHPTVWVSSVVNYVSASEPDEALIQAYQSYGDDYTIWPEVVTIDMSINWQHKPTWPSIKLSAENLGSDQLKEYPEQFGPFANGTQYYAELSWNFI

SEQ ID NO: 11676 - protein, 1455 aa, Vibrio fischeri
MNVKFAYTSCSRFSYFFVALVLVLAISTSLSPVLAQTFSGSETTNGPFSNGNQEFLDSSSLNASSANTISGGAQNFRDNSSLNITAGNAISDGWQQFWGNSVLNASVANALNGGSQTFWDNSILNANTADAISENAWLVFMDNSILNVNVANAISGGMLQFFDNSVLNASEANALNGGSQYFYKNSILNASVANAINNGFQDFYGGSSLNASAANAISGGQQNFRGDSRSGRLNASVSNAISGGKQFFYGESMLNATAANAISGGYQQFNDKSALNASAEYAIGGGSQFFMGDATLNASVANAIRGGEQMFLSSWFNDKGSGRLNASASNAISGGKQFFYDGSMLNATAVNAISGGRQEFFDNAKLNASAANVISGGEQIFRNNSILNATAANAISDHPLTRFYYQTFYDSSTLNASAAYAVSGGRQQFFGKSVLNATAGYAVSGGYQMFQDDSTLNAFARNAVSGGDQSFYGRSVLNASVANAVIGGGQGFWGNSVLNATATDAISGGKQSFYGNSVLNASASNAISGGSYFFAEGGTLNVLADNALGNKVKINFGAEDGVVGWGILRLNAYNTVIGGINNTVTKCIGIGSDCADTYLGVIRNDGAMDAVLTVDTSIKGDSDFSGFVQDGSGSGKLGLRKTGDNVLVLSGITTYSGDTTVDGGTLQFGNGTSAGRHNLGGKINVLAGELVIKAPAAVSVAQGVRFSDKTTLSIAANTNTPSLQADHLSLGKDVTFNLRGIYDASQLDKVLISTNKGIDGDFAKILIGGFNGTVDYLTLNTRKSDDGRQYLASYGLSWTAANNLAHGTFTINNADDNFDIGIVLRDQAPNAALGWDGKSLSKAGAGTLILSANNTYTGGTTISAGTLQIGDSGTTGSIIGDVTNNGTLSFNRRDNATFAGRVTGSGTLRQIGKGTLNLNGDNSGFSGLTKVEAGTLIVGSGDAYARAVLGGSVEVLDGGTLGGVGAVGSGAGSKLRIADGGTLAAGNSIGTLTVDGDLIFEKGAKLKVEVDPQGKDADLVRVTGDATLNGGSVVHIGANGKYQLRSTYTILTAGGKLSGKFDKVKSDFAFLDPKLLYDYGVGKVDLELVRNSVDFDAMAGTPNQIATAYAIDSMGLAAGHAVYDAIAQLPANTELIRNSFDQLSGEIHASAKTTLIEDSRLLRDAATERIRAMARVAAPTSAWAQGMGTWSHINSDGNAGRLHYNTGGFVAGVDTVAADHWRLGVLAAYSNTSFKARARASSGSSNNYSLGLYGGRSWEIAGGKLGLRSGLAYTLHDMKTSRLAAIPGFKDTLSGDYRGTTLQAYADVGYGLENSWGNLEPFANLAYIRFRSNGFAEQGGAAALDAGSQNTSTSFTTIGLRTVNQLALGGKSATVRGALGWRHAFGDSAPLSTQAFSAGEAFTVAGAPIVKNSALLETSLDLRLSTSTTLSFAYQGQLGMDAKQHSVKANLLVRF

SEQ ID NO: 11677 - protein, 693 aa, Vibrio fischeri
MFSKSQLALVIGAVLSIPFAYAETDASTTDEHMVVTGRDYGYKADTNSTSMRMEATQLETPGQVTVIDEQIIDEQRASTLGEVLKNDSSISEGSKSTNRERFYLRGFKLSSSSSFLRDGVQHWSHYRQPIELLERVEVMKGPAGLLYGKSTPGGLVNMISKKPTYETQVTISQDIGSNNYTRSIADVSGSLNEDQTLRARVILSQENQDSWRTRFDGTAVETDRTVGGLFVDYDINEDIMLSAHYDRTNEIGDLDNGSKVDTTTGEVIDPNTVKDQNWAKTDNDVANYGVGLTANLTDSWSVKTGISRQYYERQRTESDINKDGSSYKSSDRHDEWTFDTAYVDFMGDVDALGVNHRLLVGGNGLNYDYKRQYDSSKSCITSTDTCSDGFNRPSDLNSSNDTVGPHSKSQHYGIYLQDLVTFNDSWQLLAGARFAVDKTEDSKGKKEDYTNILSKLGVIYHPAENGSIYAVYSESFEPVATINDADDVNDGQKQDPMKGNLYELGSKWELLDNSLYVSGALFQIVQSNMQVSEDINGGSNTRTSQVGEQVHTGIELAATGYLTEAFSLSASTTFLDAKYENDPALEGKTPADVPEFSASIWSQYDFNNGTGINLGVYHVGERYGDSKNEFKKDAYTRVDMGISHTLKYDDSLDFVARFNVENLLDTDYLAGGSASDVVVGEGRNYMATLQVKY

SEQ ID NO: 11678 - protein, 792 aa, Vibrio fischeri
MKTSYALIALLPLCTATLHAQQNASVSDPDTIIEYDQITVFSENVAQANTVLRNDLKEVAAPLTSALDHIDRLPGVIVQEGDAYGGDDWSTTVSIRGFATTRSSSQLGYTIDDLPNGNTNYGGGAKPNRFIDSENIGQVTVSQGAGDIASASTTALGGTIQYSLIEPSYNQGGTLEYSTGDNNMQRYFFRYNTGLIGEDTRAFVSFSDSFHNRWTEEGENGIADRIHSDMRLITKWGNVEVDARLSYDDIHEDNYNGVSLAQFAENPNWDRLTGDWSGMPNPDQYFVEGWSTVRENSLLGVKFTIPFSDDATLELQPYFHNQTGEGHWIPPYQRRGFRSDGTPESEAAFADFETRVFFQDAAGNDLHIPVNGLEGAPDSLVDQLVIPTGDVFDINSYPEAVRAGAIPVSSFRTSHYGNDRIGLRGHYTHYLESQTIQLGFWHENQERFNGRDWHQILDARLGMQYDHQPYWTDFDQTFDTETTMLYAQDTIELGDSGAKAQVGLKQYYVDISGYDNMIQEPIGSQNSDSDILPSLGLTYELNEGDDQVFFNYSQNYAAITDNILQRDASPNLEPEQSDNIDLGYRFNRNGLSFSSSLYFIEFDNKISFIPPYDEDDGINYDIGTGGGYVNVGGIESKGLEIAADYTFNSNLSAFATLTYNDSEYTENVPETGVIAGNEVVGAPSEILSASLFYRSDNGFYSSLSAKHTGERQGTLDNSEQMDAFTRVDLSLGYRSEINSNADEPKHFKAELHVYNLFDASYLATPDGDARSSNGYYFIGAPRAVSATVGIEF

SEQ ID NO: 11679 - protein, 711 aa, Vibrio fischeri
MKLSPITAAVLSVLTANFVHANSEVTQFDEVVVTANKVEQPLSKVAGSITVINGDDLETKGTTELYDSLNKEAGVSVTGGAGRPQNITIRGMTGNRIVIVKDGIKSSDGYGASDINDKVGRNSFDLSNVKSIEVVKGASSSVHGSGAIGGVVIIETKQPEDYLKGNDFYSDVSGTYTGISNKYKGSSNLAFRSGNTESLINLSYWQGEETRNYQQDLYNRNVDGVNAAYTVNHYIGEELMLTAKIEYYTEDMLREEGSASIQKDGIWHISTYNHKENTQDINAYIGAEYTPYDAFFEKLNSKLYWRDTTTSSDINRLMSRERNNIVEKRREIKAQSFTDQLIGFDNDFISSATLLNQVHNLAYGLSLTSNQYERPNSKSTIDWNGNNVNHTQPFAPARAYSLGIYLRDMVEVNNWIITGGLRFDAHSLTPSDSDSIAGFSVKKINSSELSPSVSATYQFTDTLNAYLSYNHGYRAPAYDKAYGYNNHDFVPLTPFLIIPNMDLEAETSDSIEHGIKYDSGKTQIYGAVFYQKFENFIDVIQVGMDPSTGNYLKQYQNISGVETYGAELTLAHQFTQEWGINSKIGYVDGKDGDGEYIRTITPLEGNVGITYDLEKLSAYSSLNWASSMDRVPQCATNIGMATECATTSSWATVDLGVNYAVTTDFNISANIINLFDKEYIRYQDVAGIMDSAKGYSTEPGRYFTVNAKYVF

SEQ ID NO: 11680 - protein, 340 aa, Vibrio fischeri
MNKKLLALAIIAASSNAVAVELYNEEGTTFDIGGHVSVALEGSDEGNTDVTSVSPRINFNATHDLGNGFVADAKGEWALNYLDGGENAFTTRLGYIGLTHEEFGRAVAGTQWSPYYSVGGVADLPIAFANEFLYEDQGNLGTARADKMLSYGKAFELGDAGKLALAAGWQGRKTDTPDNSIVENDYGNRAQIALNYNVAGFSANYAYNTGDVDYGLKSETSESHILSATYGQYGSGLYVAGVYAMNENMNSDANGILIEDGSAYEALVAYALDNSLNLSLNYESVVDNDASKTVYSTTAIQAEYNFTDKFVGFTGYQLDLGNDYNETEDNKWMLGARYYL

SEQ ID NO: 11681 - protein, 207 aa, Vibrio fischeri
MKKIYLAAFVFGVFSVSSSAEMMPYVGGNIGIGGITSPDADIDNMNYSQESGKFAWSLNTGLLFNSEMNNKFQYGAEVSYSTYATNENRFENLKFDYDGYNIAALGVAKYNFNNKWSIFGKAGAAYTVQELTSNVNVFNKKESKVLPKIGLGASYNITDNFAINASFEHIFGDDLAEFTNKPNNHQLSDYTNVGSVSTMYIGMGYSF

SEQ ID NO: 11682 - protein, 307 aa, Vibrio fischeri
MKKLLLSTAIVSSFVSTPLLAATVYDQDDTQLKVGGRAEARANISDNNESATESSFQDKSRARINLKGKTKINEDLGAFGTYEVEIADGKNNLVNTRYLFAGLSTAFGNFSYGQQDSAQVMLTDYTDILATFGGDAADLTDGNKDKRENNFVYSGEFDALTVQANYIASNTKKSDSFGLSGMYALPIGLDLGLGYASGEQAGLDADQINLALRYTLDAFMVSGLFTTGEIDKIDAAGYELAAAYKMDKWVFQGVYNYQEVDSKDTEINVAIEAIYKLNKSFRTYAGYKFEQIDDLDDQIQFGLRYDF

SEQ ID NO: 11683 - protein, 186 aa, Vibrio fischeri
MNVSKYVAIFSFVFIQLISVGRVFANADEWMTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 11684 - protein, 383 aa, Vibrio fischeri
MKPFFSYSLTASAVLLSFNAFSSGLFLQEATVANAGTTGAGDGVYTESAAAMWTNPATMSYMGESKTTINAMAFDLEMKFNDNNGSEDGKAHSILPSAGAFHTQAITDKLHFGLALGAVGGSSLDYGSDWAGSKLLEDISLTAMQLNPALSYQVNERLSLGAGLQFSWASFEQSMSGITAEKDSDWAYGYNLGVMYQVSEQASMGLSYRSKLEHEFNNNISLDNFNPTLSSGMIMPDIVDLSTSYALSKDVNLLSSIQLHRWSHWDSTILDANLGNGGAEIKRDWDDAWKFAIGADYRLNSDWRLKAGFSYETSPQDDPSMQWVDLPVGEQYRYSVGASTSWDGITMDMFYEYADLGSVDMDRLNVNGTFDGRIHFVGVNFTF

SEQ ID NO: 11685 - protein, 672 aa, Vibrio fischeri
MLLGAAASALLAGAASAQTAPTQTAPKPVDLDDIIVTGAPYGISQRATTIATDVIDAQTLATAPAVSLGDLVSTRPGIRSTDFAPGASRPVIRGLSGPRVQVLTNGIGLIDASSVSPDHAVATDPAEASRIEIIRGPATLVYGGSAIGGVVNVIDERIPTSIPEGGMSGVVSTQASSVDDGRSAFGRVTLGSGNFAFNIDGVKRKSDDYDIPAPALSARKAAADGVERGEGGSQPNSYSDLEAWGVGGSYIGDKGFLGASYKNTDSEYGTVAEETVFIKLNQERYDVRGEYRFDDGPFSALRGSYGHADYTHTEFEDVGEPGTVFNSDGWEGRADLVQRTRGDWNGAVGVQSLSRNFQAIGEEAFVPTTDIDELGVYTVQRLDRQGYGFEGGLRYDRRELSATPIGEDRQVDRTFDNWSASAAAFLRPAPGLFLGLSLAHNERAPSEVELFADGVHIATAAYETGDVNLNSEKVNTLEATAHYDRGRFTGDLHVYHSWYDGFIDERATGETFLFEEENEEFPVYQFVQTDARFYGFEAEGSYTAWQNGDRKLSLEAAADFVHAQTDLGPAARIPPYSLTGRVAWTSTPFDASVEVRHVGEQDRVANEYELPTDDYTLLNLAAAWRPLTDRNVTVFAEARNLTDEEAREHVSFLKDIAPLPGRNLRVGVAYRF

SEQ ID NO: 11686 - protein, 242 aa, Vibrio fischeri
MKQSYKVIIASGLAIFAAQALANDYKTTVEYRHEYKDGNNKHADRVKMFLDTGKNIGFELDARYNNKDQDQMYDEMSMNGSELSIFYYDKIAENTTGLLGSSLDFNPDGLVYVPYVRVNHSFDNGFRAQARYKWKIWDYSQTNAAGEKYTSKIQELDTWLGYNTGKWDFQYEFQIWNETDDDAKPQFDNESYDYLHNFRIMYSFVNPDGTKWRPFVEVGNVRQDSYSDNRQTRYRVGIKYTW

SEQ ID NO: 11687 - protein, 324 aa, Vibrio fischeri
MLIISNGTIASESKEEQSHVYLGGQVGVSHFLGACSSNAIECKNYVTGGGLYGGYQFNSWFALEGSWHDYGSPKTFYGVGDGYYSNATGVDLSVKLSLPVTDNLDLYAKGGAAYNYLSVSGNDNVHLGMFESDSSIDDIWEIGAEYALAPNWSLRFGTSIIDGIGNAKTGKSDLYFTSLGLTYKFKAKPEPELKPETIVKLVPEATYYPEQVTLHFEFGESRFVVESKQWHSWNELALSVKQGQGKVSITGYTDAKGTDSANDIESLRRATYAADMLIKAGVDEERILINSKGSADPLVNEDLMRNESALNRRVVIQFNRRVGS

SEQ ID NO: 11688 - protein, 698 aa, Salmonella agona
MFMFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGRKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11689 - protein, 1015 aa, Salmonella agona
MKNNTWKFKRSMTALAVASCLLSLPNAYANNAFGSAYGKAQAGVVVTIKNDNTGLSRKVSVGEDGRFDIKNLPVGQYTVIDSLGNTDSVIINVGTGSIINLEGTERITVVGARVSSIDTTSVESTSVFSASDFELLPVGRDLTSVALLAPGTVQGDSGFGNLASFGGSSVAENGYYLNGFDITDSRKLLSFANIPFDAIASQQVKTGGYGAEYGRSLGGVVNQVTKSGTNEWQFSASVHTNLDALRAEPKDVKTLNQDTLSDPYGAHYLKYRKANTQDATSYVLTAGGPLIEDKLFVFAALEGFYNQYDDYFQNESRNIKRTSPQGLVKVDWYLSDEHIFEFTGVYNKKTEKRTIYDNPKSAVDPEYRVPYTGEHGEHRSTFDRESGGHIAIAKYTGILTDNLSLSVMLGDLKSVNDKDSPEVPDGVDTSCNRIWDSSENARGLVHRGCWNEGTVDILDPDTPEEYSARTAIRIDGEYQLGDHSIRFGFDEERLTNVDRGWVYVGDDRKYYRYFEVGSLNHAFTKVNGVELEPGTKYVRIWDGAKLSAEYKSVNSAIYIEDSWQVSDDLLLYAGLRWESFKNENSEGAAFVDAKNELAPRFGFSWDVDGNSEKKLFASLGRYFIPVPGNTNERLSGVEYRDVSYHYYDGYDERTWVPNITGDIGDANIENKQAPNPASIVSQDLRPMFQDEFILGYQQEIFENWTVGIKGIYRKIKNGMDDFCSPGDIYKWALDQGYNQMDWHDIPSCIVLNPGEDLNFQVDTNDDGTVEDVTVPNSYLGLPEYQRDYKAIELSFNRGFVDGWNLGGSYVWSKSQGNVEGYVNSGLGQDDPGITQDFDHRLFQENTYGYTPNDRRHAFKAYGSYELTQEIIVSLSFNATSGQAKNCLGFVPYEQFENFPSNSPEDITYDRLARYSASSFYCRNEAGERELTTKGQYGRTPWTFNTDLSFKYTPTWADDKLSLRARLLNVFNAQKTVSVEPQGDFGRDSTAKNPDFLVPLNFQTPRRLYLSLSYKF

SEQ ID NO: 11690 - protein, 377 aa, Salmonella agona
MTIKITALAASIGAAVAFMPFATQAEIIVLKQDPQAGNPLSRLNFTVGGSIRPQFQNMTGNDGANGYKRNGFDGGTRFRFAADYYLFDDISWISYYELGVNIPAVFDWDNHYAKGATDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNSNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11691 - protein, 950 aa, Salmonella agona
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTNIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVIPDPVDPDPVDPVIPDPVIPDPVDPDPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQVGGDLAQWSTDGLDRWHIGAMAGYANSQNRTQSSVSDYHSRGQVTGYSVGLYGTWYANNIDRSGAYVDTWMLYNWFDNKVMGQDQAAEKYKSKGITASVEAGYSFRLGESVHQSYWLQPKAQVVWMGVQADDNREANGTLVKDDTAGNLLTRMGVKAYINGHNAIDDNKSREFQPFVEANWIHNTQPASVKMDDVSSDMRGTKNIGELKVGIEGQITSRLNVWGNVAQQVGDQGYSNTQGLLGVKYSF

SEQ ID NO: 11692 - protein, 656 aa, Salmonella agona
MTQKRTLLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIARPAMAQQIAGNSATSAAEQVGLLLDAGAGLVVAPNVPDISATPMLLEAVITAGLGAAAPPALKAALEALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGQLWGARLTSGYDFVMMPWLTTGPMLQYAWDYSHVNGYSEKLNTSTSMRFGDQNAHSQVGGAGWRLDLRHSIIHSWAQINYRRQFGDDTYVANGGLKSTALTFSRDGKAQDKNWVDIAIGADFPLSATVSAFAGLAQTAGLSDGNQTRYNVGFSAQF

SEQ ID NO: 11693 - protein, 378 aa, Salmonella agona
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTADARLYGNGDRATVYTGGLKYDANNIYLAAQYSQTYNATRFGTSNGNNKSDSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 11694 - protein, 2865 aa, Salmonella agona
MNKTYNIIWNAARGMYIVTSELARSGSRAIVSVSASCAVTLLAMDAAPAVAEETRVSIPSQTTTYTLSGATPFVVETGNTVATDIATSAAIVGDNSNDWDLLIESGAVVGSSLTDSQAMNLDSLTGATSVHNQGTITGSNEDGTILLQNGGSVINDGRIENSATYEHDPQDIPQEYAGVYMLNGGSYVSSESGVLEGVSGVIVQSGEAHITNGGMINSDGSWRSYGVEFRDGTYGTIVNTGTIITTASDGSGKIEDAAIYVHTLNDMAVSGSVSVDNSGLMQSDFITVALYHGSHFEVVNRVGGVITAGNSSLVGIKSTAMELKVGVDNLVTNDGTISAYGTANTYGIHYGESTSGGVITNTGSITTTGGGAGDASVYVHGNGDGTVVNNSGTMSSTVYGVYLDSARSKGHTLNNQAGSAISANTAVAINGNGNTITNQGKMTGVSDGLLISGNNNIVTTSGGEISGKNGIRVSKGSGNQITAKSGSKITATSTGISIASGNNQVTTESGSAIVAKDNGILINSGANNVTNGGSITATGSSNSYGIQYNSGASGTITNTGTITTTGKGVGDASVYAHGGAVTINNSGTMDSSVFGVYVTTGHTLNNLAGGSISANTAVQFHGNNNKLANAGAISGDTNGVTISGSGNTLTNQGKITGGTNAILINSGSKNNTLTLNTGTEISGSITDDNNSASANNNLILDGEGTLGSSISGLNSVTSSGDWTLSGATMNLSGTTNSALWVKSGTLILNGAMTAKGATVDSGTTLQIGNGGTLGAFNGDIVDNGTLTFNRSDAAAYGSVISGSGNVVKQGGGELTLSNNNSYSGGTTIAEGTLTATAGGALGSGNIDNRAYLKLDAASASDPFIVADLTTHSGATVEIGAGSTLQANTLTQQDGSTLTADLTATSGPAIRAKNVNLDGTLNVASPASQEPIRSTDDLISLALIESDNAISGDFDGITINGNAMNPDAFITVVGQKNVNDTHYDLVETLTWYADRYNAAIDAHGTFNLADADDSFTVNTVLENVDANSGWNGQSLTKTGAGTLILNAENTYTGGTLISDGTLVASNVEALGTGDITDNAVLELNTGGDFDNAISGSGQVVKSGDETLTLSGSNTYTGGTIISGGTLVATNVEALGTGDVTDNATLELNTGGDFDNAIGGTGSVVKSGDKTLTLSGANSYTGGTTISGGTLVASNVEALGSGDVTDNATLELNTGGDFANNIGGTGSVVKSGDKTLTLSGTNSYTGGTTISGGTLVANNVEALGTGDVTNNATLELNTGGDFDNAISGSGQVVKSGDKTLTLSGANSYSGATTISGGTLIATHVNALGTGAIDNRASLLLDASGQFTVTDLTTESGGNTEIGAGSTLQATTLTQKSDSTLTINLNGNTVDPVIHAASQVSLAGTLDITGVGDVLDSDPASTDDLDTFTLIASDKTIAGDFEKLTVAGMDADLADFITVDGRIDDTGKQYELTTALTWYADRDDAVTDAHGTFNLTNADGSFAVNTVLENVDATLDPASATGWDGTSLIKQGAGTLILNAENTYTGGTTISGGTLVATNVDALGSGDVTDDATLELNTGGTFDNAIGGSGNVVKSGADTLTLSGSNSYTGGTTISGGTLVASNVEALGTGDVTNNATLELNTGGDFINNIGGTGRVEKSGDDTLTLSGSNTYTGGTLINGGTLVASNVEALGTGDVTDNATLALNTGGTFDNAISGSGQVVKSGDETLTLSGTNSYTGGTTISGGTLVATNVEALGSGDVTDDATLELNTGGTFDNAISGSGQVVKSGDKMLTLSGANSYSGGTLISDGTLVASNVEALGTGDVTNNATLALNTGGDFTNNISGSGQVVKSGDDTLTLSGANSYTGGTTISGGTLVATNVDALGTGDVTNSSTLELNTGGTFDNAISGSGQVVKSGDETLTLSGSNTYTGGTLISGGTLVATNVDALGTGDVTDNATLELNTGGTFDNVISGSGQVVKSGDDTLTLSGANSYTGGTLISGGTLVATSVEALGSGDVTDNAVLELNTGGTFDNAISGSGQVVKSGDKTLTLSGANSYTGGTTISGGTLVASNVEALGSGDIDNYASLQLNASGQFVTANLTTHDNAITAIGAGSALRANTLTQEANSTLAVHLTDSNSGAIVTADRANLGGTLDITGIGNVAKSWTRDAYAYTLIDSDSAIDSDFAQFTVAGMDAKQVDFLTVDGRVNADDDTRYDVTASLSWYADSDNAATDAHGTFTLSEQGHSFTLNTALTDVDATLNPDSATYWDGKSLIKRGAGTLILGAQNTYSGDTDVQEGALWLAETATIGSAGSAQAVNIAANAAFGGHNATVNGHVNNLGNLYFVDTFTVNGDVVNSSAMISGSDQPNNTLTIAGNYTGNDGHLYLNTQLGDDSSPTDKLIVTGDTAGSTTLHITNVNGLGAQTVNGIEVIEVGGQSDGDFRLYKGHVDINAWTYTLKQDGGDWYLRSESDDVPDDGGEVTPPDDGGEVTPPDDGGEVTPPDDGGEVTPPDDGGEVTPPDDDGEVTPPDDGGDITPPDDGGDITPPDGGDVTPVAPQYRADIGVYLGNQWMARNLQMQTLYDREGSQYRSADGSIWMRFKAGKAESQAVNGNVDIDSDYSQFQLGGDILTWSDGAQSVTVGLMGSYINASTDSTGNRGADGSQFSANGSVDGYNLGLYATWFADAQSHRGAYIDSWYQYGAYNNSVDNDGLSASRYDSAAHAVSLETGYRYDIALSNRNTVSLTPQAQVTWQRYSADTVIDDGGTRISGQNDDSWTTRLGMRVDGKLYKESGRIQPFMEVNWLHASDNASATFGDTKVSQDLPNDRVEVKVGIQANVSERLSVYAQAAGQKGKNDYGDASFSLNMRYNW

SEQ ID NO: 11695 - protein, 444 aa, Salmonella agona
MSQKTLFKKTALAVAVAIVSTSAWSAGFQLNEFSSSGLGRAYSGEGAIADDAGNVSRNPALITMFDRPTFSIGAVYIDPDVNVTGKSSLTGKSANQDNIAPVAWVPNMHFVMPINDQFGWGASVTSNYGLATEFNDSYGAGIYGGKTDLTTMNLNLSGAYRLDSNWSFGLGFDAVYAKAKIERYAGDLGPLLASRLPPAYRDGISSPDDQIAYLKGDEWGFGWNAGILYELDKNNRWGLTYRSEVKIDFEGDYKSSINPALNSIFANMGMTSLPTGTGGRTQNGALTLNLPEMWEVSGYNRVAPQWAVHYSLTYTSWSQFQELKATGDNGQTLFQKDESFKDAYRIALGTTYYYDKNWTFRTGIAFDDSPVPADKRSISIPDQDRFWLSAGMTYAFNDDASVDVGASYMHGQNVSFTEGEGVSAYEFKSAGKAWLFGTNFNYAF

SEQ ID NO: 11696 - protein, 312 aa, Salmonella agona
MKKHAIAVMMIAVFSESVYAESTLFIPDVSPDSVTTSLSVGVLNGKSRELVYDTDTGRKISQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAYDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11697 - protein, 358 aa, Salmonella agona
MNRTTAVRGMSACALGLTFALAGWTAPALAQTSVTLYGRVASGIDYQNNVAPTATAPGGSLWRAADNQWGTSMFGFMGKEDLGGGLQAVFRLESGFGAAQGKTNGDALFNRRSYVGLSSPTWGTLTAGKNLFISNDVWFLDPTGQQFIGSATLVRGRNWPGANNIVEYQSPTWGGFQIGLQTGLGEQPGSFTNSRRDGVSAVYSAGPLEVRAIYDVIRDGNGKFSDIFNFSKEATFGGTYTIGKAKLFAVYENLSAPDAAAGAPTKANHYWLGINYELTPALTLIGAAYRVNVNHGGGNANLFMAGANYNLSKRTMLYASVGTVQNSATANFSVEATNNNPAPGKNQLGAYTGIVHSF

SEQ ID NO: 11698 - protein, 392 aa, Salmonella agona
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNENGGAGEGTGNGGSRKLARENGDGFGMSASYDFDFGLSLGAAYSSSDRTDNQVARGYGDGMNERNNYAGGETAEAWTVGAKYDAYNVYLAAMYAETRNMTYYGGGNGEDNGGIANKTQNFEVVAQYQFDFGLRPSIAYLQSKGKDLGGQEVHRGNWRYTNKDLVKYVDVGMTYYFNKNMSTYVDYKINLLDEDDDFYASNGIATDDIVGVGLVYQF

SEQ ID NO: 11699 - protein, 724 aa, Salmonella agona
MRVKKFIWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11700 - protein, 212 aa, Salmonella agona
MKKFTVAALALTTLLSGSAFAHEAGEFFMRAGPATVRPTEGAGGTLGHLNGFDVSNNTQLGLTFIYMATDNIGVELLAATPFRHKVGTGATGDIATVHLLPPTLMAQWYFGDSSSKVRPYVGVGVNYTTFFDNDFNDNGKKTGLSDLSFKDSWGAAGQVGVDYLINRDWLIGASVWYMDIDTTANYKMGGVQQHDSVRLDPWVFMFSAGYRF

SEQ ID NO: 11701 - protein, 706 aa, Salmonella agona
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQLGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPALGRNYGVGINLAWQFE

SEQ ID NO: 11702 - protein, 905 aa, Salmonella agona
MIFSKRRASTVLTACLASGLGASPNAIAVAQQADDVVVVTGTFIRRQDQSNLPSPLESVGAGDIEDVGAVNVSDITETLTINTGAENNPDAFTQNQTTGTSSINLRGLGLASTLVLLDGHRQVTTAAQSNDGVSFVDTASLVPLIAIERIEILKDGASALYGSDAVAGVVNFITRENYDGVLGSVNYLAHPQGGSYDETLVQGLFGKTFDTASVLGAVSYTRRNALTTEERRLSRVGMDDVSVIGNPGAFLAAPPTDPLGAAPAGAPVIDPTGCAEVGGVPLPASPTAPPPSSGIGFCGFDFGDYYSLVPEEEKLLFFGKAEFDVTDTIHFQAEVGYADNEATRNNSPTFPYLLTPIVPASNPFNVFAQDAVFIGRVLGNGGEAATNGFDSETFRTSLTLTGDAFRNGYWEMSYVYGQNEHVLMTPDVIADRFQCSLFGFDATTAALYGITSCGAVATDAAAAGVAGETFNPFATSFTVAPNSDELVDFLIGTQVRETKSELNVINALVSTDLAELAAGPVSIAIGTQYRKEELEGNFDEISLNDGFGFLIGEQPYSGTQNILAVFGELSVPVTDMLDLQFALRFEDYEDIGSTTDPKVAALFRPNDWLSLRASYSTSFRAPSTFQLQGQSTSLEQVSDPANGGATAFAAVRTLGNEDLKPEESDAFNIGFSLRPASGLELDVDYFNFDFTDVIVQENPQSLLLNDPLDPAIIRGPGGNVQQIFTDFVNASSLKTSGVDVSASYPIDIREGTLTPTFTGTYLLEYELEDPTLPGGSGTIDGAGRRNFNNFGTSAPEIRFNAGLLWESGPHAANVFARYIDEYVDDEDEFADTPVLRDIDSQTRVDIQYSLQLGELMERAKMTRFTAGVRNLLDEEPPQVFTNGGYDSKVHDPRGRMLYLAVDHEF

SEQ ID NO: 11703 - protein, 372 aa, Salmonella agona
MKKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVSLGLVYEF

SEQ ID NO: 11704 - protein, 383 aa, Salmonella agona
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGANENQVSHEQEGTNNGGDRNVKNANGDGFGISSTYDLGMGVSFGAAYTTSDRTNEQVNYSTAGGDKADAWTVGAKYDANNIYLATMYSETRNMTPYGNDDCSSCVANKTQNYEVTAQYQFDFGLRPEVSFLMSKGKDLNMPGTAASPAGTKDDKDLVKYVSVGTTYYFNKNFSTYVDYKINLLDDDDQFYKDAGISTDDIVALGMVYQF

SEQ ID NO: 11705 - protein, 747 aa, Salmonella agona
MARLKTAQPNSSLRKIAVVVATAVSGMSVYAQAAVQPKEETITVTAAPAAQESAWGPAATIAARQSATATKTDTPIQKVPQSISVVTAEEMALHQPKSVKEALSYTPGVAVGTRGASNTYDYLIIRGFAADGQSQNNYLNGLKMQGNFYNDAVIDPYMLERAEVMRGPVSVLYGKSSPGGLLNMVSKRPTTEPLKEIQFKMGTDSLFQTGFDFSDALDEEGVYSYRLTGLARSANAQQDRAEEQRYAIAPAFTWRPDDKTNFTFLSYFQNEPETGYYGWLPKEGTVEPLPNGKRLPTDFNEGAKNNTYSRNEKMVGYSFDHEFNDIFTVRQNLRYAENKVSQNSVYGYGVCSDPANGYSKQCAALAPADKGHYLARKYVVDDEKLQNFSVDTQLQSKFATGEVDHTLLTGVDFMRMRNDINAWFGYDDSVPLLDLYNPVYTDFDFASRDPATSGPYQILNKQKQTGLYVQDQAQWDKVLVTLGGRYDWADQESLNRTTGITSKRDDKQFTWRGGVNYLFDNGITPYFSYSESFEPASQTGENGKIFAPSKGKQYEAGVKYVPNDRPIVITGAVYQLTKTNNLMADPAGSFFSVEGGEIRARGVELEAKAALSASINVVGSYTYTDAEYTTDTTYKGNTPAQVPKHMASLWGDYTFFDGPLSGLTLGTGGRFTGSSYGDPANSFKVGSYTVVDALVRYDLARVGMAGSNVALHVNNLFDREYVASCFQTYGCFWGAERQVVATATFRF

SEQ ID NO: 11706 - protein, 1984 aa, Salmonella agona
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDNFKLDNGSVLEGAVWNYSEQDNQWQLTTADGKTLNVTGWDVTDANAAVIEGTQENGLYWKYDSRGYLIIADDKTTVISGDDQAHNSDRGMDISGQDRTGVIISGDRTVNTLTGDSSVTDGATGMVISGDGTINTISGHSTVDNATGALISGNGTTTNFAGDIAVSGGGTAIIIDGDNATIKNTGTSDISGAGSTGTVINGNNARVNNDGDMTITDGGTGAHITGDDVVIDNAGSTTVSGADATALYIDGDNALVINEGNQTISGGAVGTRIDGDDAHITNTGDIAVDGADSAAVVINGDNGSLTQAGDLLVTDGAMGIITYGTGNEAKNTGNATVRDADSVGFVVAGEKNTFKNKGDLDVSLNGTGTQVSGDMSQVTLDGDINVTAVEDSDSVYRGATGIDITGDNNTLDIVGNVTVNGDYDNDSVMAGSTDTLQGMSVSGDNNQVDLTGTLNINVSDMSNVDGQYLNAVGLSVTGDGNSVDLTGGININYTQDADGIESPVVGININGDSSVTLSGQSTLDITSVTGGAVTLAYVQNGGNLTLDQSSTINVNSTLLPAGYYMENALLTATGQGSTINNQGMIVDNGAVSLLLANSGAQGGNSGDITAYATTGEDNRNAITAANGQGSTFNNETGGTITVVSSLTPVVDGGAFGFPLAWRNNTLYAMLAEGYGEVSNDAGAHIYLQGAGVYGVSASKGTASNAGDIYLDGLVPTLDDENHITDKTYWAPPQLYVTSSAMVAGSTDGGYGDATAINTGTITVNNAGFGMMALNGGTAINQGVITLTADDGVTGQANELVGMAALSGGTVINDTSGIINIDADYGQPFLTDGSGLIINYGQVCFGDDCQNSEEYNPTNGDVSIPYTDGATIADAGTSTTLENNAVVTGNVNNAGEVSGKPITVLDSGTLTNNDSGVINSDTKVSGNLVNDGTISGKLTQNGGDIVNNGTIDSRSLTTGGVLTNGTDGTMTSGAKVTGANSAIINDGTFQLGSATDATNASMLEINDYAQFFNTGTLILDNNKNAIHLNPNNGTLYNTGTMDLTATSNKGAINYWGAGATFINDGTVNATTATLAYAAGGASSAPDQHAFFWNQSNGVINYDADNGRAVDFSANSNYVAVNDGTMNISGNNAYGMYGGKNAQLVNNGTIELGTEGTTDTGMVAMALDKNATADAVIENNGTINIHANNSYAFSVAGAGHVVNNGTVVIDDNVTGSGLIKQGDSVNVEGTNGNNGNSDEAHYADYTLPGTPVEPDGNMTSGSTTDGTSNNLNGYVVGTNADGSAGKLKVSNASMNGVEINTGFTAGTADTTVSFDNVVEGSNLSDAGAIQSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 11707 - protein, 239 aa, Salmonella agona
MKNFFAVCIIPLVVTWSATASAKEGIYITGKAGTSVVNVYGINSTFSQDEIVNGHATLPDRTKGVFGGGVAIGYDFYDPFQLPVRLELDTTFRGETDAKGGQDIIAFGQPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 11708 - protein, 205 aa, Vibrio fischeri
MKKYLAVMALGLLASSAWGEAKPSGFMLGAGVSFDTSNFADEIEDQLDRTGPGYSVDDDGAATGKDIYLGYAFGGASSLRLGYKWFGSQEGEVHQYGVKTGEYEVDADGMYMAADLLFPLSETFFLGGTLGIQNWDGEVTARNPLSSMKSSSDGRDFFYGVRAKFLFNEKRGGVVIGYNRYSFEDENGDDLEYDSLQIGLEGYFY

SEQ ID NO: 11709 - protein, 661 aa, Vibrio fischeri
MMNKKTILTIPVVTLGLISAPAFAETTTKNKSEPVERIIVTGELMKDPTKTYTDPKKPRLPLPAYDGAGFLKTIPGFSIGRKGGAGGDPSLRGLGGSRLSIVDDGQHVYGTCGGRMDPPTAYIYPEAYDNITVIKGPQTVKYGPVGSAGTVLFEKDRHSFDEPDLDGRASMTAGSFGRKDYLVELKAGDENHYFDMDVNQSSSDHYKDGDGNKVQSSYDRSNYNFALGWTPSEETVLELAYGSSSGEAEYADRANKAREISNENLTVLLQHEFDSRWIDAIEFQAYTNENDHIMDQFDQGINSGTNVRRGTQGGHLWADFTLATDWTLTAGADYMDSTHKGRSINPAVDNGLDDLLNKPFKDNMRYQASGLFLESTYNLSSGKLLAGMRYDHWKTELMVAQKGERTDDLFSGYGRYELTSGNSQYYAGVGHAQRMPDYWEIMKSDINNPSQKAFDLAPEKTTQLDIGWIYEADIAVSTSLFYGEIRDYILIDANHGPAATAYNIDATVYGGEIAATFPLTEHFSSQTSVSYSHGENDTAGTPLGQIPPLEGRITLDYQYNQWTAGLLWRLVAAQDRVAIGEGNISGQDLAESSGFGTLAFNASWKHNEALLVSFGVENLFDITYAEHISRSGAGNDIPGSSPMFQVNEPGRTAWVKVDYTF

SEQ ID NO: 11710 - protein, 993 aa, Vibrio fischeri
MKRIFLFLTIICCIPSIWGQDLTISGTVLDASYNEPLPGVSIIVKNTVKGTTTDFDGNFTIQDMTIGDIISFSYLGFVTQEVTVSNSNPITINLQEDVSALDEVVVVGYGTQKKSNVVGSVTSVEVDDATSVPTTNVSEMLRGRAAGVQVNLGDARPGGSSNIVIRGNVSVAPNGNSPLVIVDGLPFDSLNDVSPDDIANIEILKDASATAIYGSRASNGVILVTTKTGKTGKVSIDYHGYTTVQSLSKNFNQYTGQQYIDLKREANRNRFTGEYLRDENIFSPFEIDAIGNNDFVDWEDLVLQDAVIQSHALSFSSGTEKTRVFSSVNYFSQEGIIPNSSFDRGTLKLNLEQELTDKLLFRGIFNYQNSTQNQETGGLNFTTITPLAKPLDEEGELLKFYLGPSNTAVNPLWDQRESTDETKTNLTDVNLSLVYNFTPNLSYTLKTFLRNRNTNRGIYRTSLHSAGDEGVDGLAVISNQLFKQVLVENILNYTPQINENHSLDFTAVQAFDEQRNEYTQIDKSGFTNDALGFNGNATVLLNSVRGVSQRKLLSFLGRVRYGYLDRYLLEATARADGASVFAENNKWGFFPAVSLAWKMQNEAFLENVDAINEMKLRVSYGTTGNQGINSLESLGVADDIPYVFGDQTVAGATASSRLPNPDLRWETTTTLNTGLDFKLFKNRFEGTFEYYKANTTDLLLDRSIAGTTGFNVIRFNAGEIENRGIEASLTSHIIRNENLRWSLGMVFSRNRTEVLALTGELDENGNEIDITDIASGRRLSVGQPINNIWLPKYDGIYQVGDDIAGSGNPLANPGDVRVIDQDGNGQIDNRDNVFTSTDPNWYGSITNSITFKNFDLFADIYIVEGATKLNPVLANGELWKGSINGIRTKYYTPEFPSTDYPRPKPDTHLHLFPFAVRDASYVRLRTLSLGYNIPKETLSKIGFQNAKVYVTGTNLFTLTDFRSYSPEQNPLNNSGGTAFPETKNITLGVKVGF

SEQ ID NO: 11711 - protein, 281 aa, Vibrio fischeri
MRKSLLALSLLAATSAPVMAADYSDGDIHKNDYRWMQFNYMYSIDEMPRVKGADDNAHDYLEMEFGGRSGIFDLYGYVDVFNLATKDNQDKSIENGAPDKMFMKFAPRMSLDAVTGKDLSFGPVQELYIASLMEWGGNNGGVNNQKIGLGSDVMVPWLGKIGLNLYSTYDGNNKGWNGFQISTNWFKPFYFFDNGSFISYQGYIDYQFGMDDDAGNKFGTTASNGGAMFNGIYWHSDRFAVGYGLKAYKEVYGVKDGLQVAPGVELESTGVSHYIAVTYKF

SEQ ID NO: 11712 - protein, 618 aa, Vibrio fischeri
MKKTALATAIVSLLSHAYTSPAFAKDSVSETDEVMVVTANRFEQSAKDVIAPMSVVTKEDIVQIQAKTITDILRLQPGIEVASNGGIGQNASIFMRGTNSDHVLVLIDGFRMNSSIKSGMNINKIPVNQIERIEIIRGSGAVMYGSDAVGGVINIITRTATNDLSKSATIGAGSNKYKEGNFAANTNVGDKGHLKIAAGFTQTEGYNVNPQPGLNDGDKHGFENNQFMLNYEHQFSSNLSLFTGIRWFNSTSEYNHYTNTKSQSESESMAYSAKVSYKKDALLSDLSFSYQDNETLEYLENGSLDSEQKIDQLNAQWTNQYKLMDSWFVNAGIDWTNEQVKADITNFSHQVIIDEGESRMSTGVYLGTEYQLEKLTLEANTRFDKHDKHDKYDEYVTWGVGASYQINEIYRISSAYNTAFKAPSFYDLSTAPDLEPETSDNIDVGLAAEYALVSVNLSLYKNKVDNLIIYYDAPNYMGYSANVDADIKGAELELLFDTGIVSHTVIAEYKDHEDTQGQQLARRAKQNYKWISNVSFGDLDMNLSYIYTGKRSDLPSAPGVATNYLDPYSLWTLAGAYWVTTELAVRGRVENLLDEEYETAGGYKPAERSYYVSLDYQF

SEQ ID NO: 11713 - protein, 410 aa, Vibrio fischeri
MNQKKGLLVALLTPILAFSGAAAVHASGYAVFTHGASALGQGNAVTAHSSDPSTIFYNPALMNKLEGTQVQVGTTGVFSSRQYEPAGAGNGTSSDSAFFPSHFYATHKLNNQVSVGLGIFNPFGLGTEWGEQWDGRYIATKSTLKTFNINPAVSVQVTPKLALAAGVDVVLLDASLEKKVPSGALGLTPDFDVNQKFKGDGKGVGFNVGVAYDVCDHFSLGASYRSEVKIDVSGDAALTAGGASIASFGGNTDLTLPPQFTASAAFKGIDKLVLEAGVRWEGWSKFKELAIHVDNGQPAVTPRNWKDSWGGNAGGRYQMNDTVALLAGYVYGDTPVPDSTFDPSIPDAKTHVFCAGTDLNFNPVTVAFSYGYQLLENRHKDNGIPAGAALANGKYKTDAHLVALSVGYKF

SEQ ID NO: 11714 - protein, 204 aa, Vibrio fischeri
MKKIALLLVLFSAFSNANDNISGFYLGAGLGATTFDDGGAFDYTGASINADDSTLKFMGGYQFNRIVAVELQYTKYGDINVNHPTAKAAGFKGIDIESTSISLAANLGYTFDSGWRPFGIVGLGSLESSTNVLGHSLSENNTSFHYGVGVEYAPKALSGLAFRVAYEGDMFIEENVYQDYGYYSYSDDYAMNIGTFYAGATYKF

SEQ ID NO: 11715 - protein, 748 aa, Vibrio fischeri
MSNKKSTKSSTFSLSLTRAPLALAISAALSTAAWAQTDAIDKPDPSNDMEIMVVTADFRSASLEKMPSSITVIDAQQIQDESAQHFEDVMNSIANFNWSGGSSRPKYFQIRGVGEQEQYQGAPNSSVGYIIDDIDLSGIGMVSSMYDLQQVEVLRGPQGTRYGANALAGLIYLKSNDPTDVFEHGAEVSLGNDDLQTFSGFSSGPLTDSGKLLYRVSLQQHQQNGYRDNLYINKEDTNGRDEFTGRAKLRWYATDNLQLDLTLLHADFDNGYDAWSLTNDPKHTISDQPGVDSQRTTGAGFKATYSGAESFELTSLTSFANTDHHYSYDGDWANPEYWASKQCDIYDADWNSIGKLPCVYDATWSKVGQRKTFTQELRLTSSDAGRIFNESTDWLIGVYFSSLQEDNSLIDYAKYSNGGLNPSFKERTKYLDSTYDAQNYAIFGQLDIDMSNDYLLSLGLRLENRSSDYSDTNLDDFSPSETMWGGHLALSKALSEQHNAYIRVARGYKAGGFNMTLPADFSDKKEFNTETLYNYELGLKSSWLSGALSTNVALFYMDRQDQQVSASQQNPEDLSEFVLFIDNAGSSKNYGLEIDANWYIDSNWHLYSSVGYLNTAYGDYQYEVAEDQFVDLTGRDLAHSPHLTYSLGGTYRANSGWFANVNMSGKSEFYYSDSNDSRSEPYTIVNARLGYEASAWSAYLWGRNLFDEEYGVRGFYFGNEPDNGWAEKQYIRYGDPRQIGVTLNVKFM

SEQ ID NO: 11716 - protein, 332 aa, Vibrio fischeri
MKKTLLALAIASISTSAFAVDTSSQNSRNEDMFAFDSMHKDQFSVSGSVGVGGYYDTGSKAFYDHWATGLTLAVNYRNNRIVGYFETDFMLNYTTDSETKSASSTEKNSSPATDVDKAWLGFDTGYGIASYGWENDTALDAVDGAGDFTYEFGASAGDASDAFNVVKFQGSTSGFAYGVSYFETDDVHVDAEKGVNGYVGIEQETFNVYAGYETRDSDYDVYTVTGNVTLGEVKLGANFWIEETDTTAKDMTNTGYYVSAGYAVSEDLTLAAGYAANTEEEKKVDTDYSYVNVAAMYTLAKNMNMGIDVRQDLDAGTKDEETYVFAAGYYYF

SEQ ID NO: 11717 - protein, 447 aa, Vibrio fischeri
MNTTFSRTLLATSTLFISATSIAGGFQVNEHSATGLGRAFAGEAVIADNASVLSRNAAAMTMFDSTSISMGLTMVKPDVSVENVEYQQLKINENMGIPTGIGFNSMTVSNTDGIAGTEFVPNFYVIHPLNDKWAFGFASYSNFGTGTEFEDNYDASIFGGKTEVKSANIGFSLAYKLNEQWSFGAGIDVIYGIGNLYRDLDSTICNKPFAGAKDCSIKKTKALDISATGVGIGGNVGVVYQVNERNRFGLSYKYSPEVEAEGDVDYLENHVHGVTSDSVYLPLPDIAEFSGYHLLTDKVAIHYSYQWIGWSAFDSVDINDVNSDQRISVKEYNWKNSYHIAVGTTYYLNKKWTLRAGYMFDKTPVDEITSISIPDSDRQWFSTGFTYNWSNQTSVDFGFTYLIGEDVEVSEVQDIPDMMGITTPNPSLTATTHANAVLAAIQLSHSF

SEQ ID NO: 11718 - protein, 322 aa, Vibrio fischeri
MKKTLLALAVMTAAGSANAAIEIYNQDGVSVDLKGDIEVVYSNEYKKGSSMEQKIEDADFGFDIKYMVNEEWKVGAYWEFNGSENANAEKTRNGDTYVAAYNDTLGSIKFGRLCTAVDDLGIGKDEAYGISTLLDNATNECADEAVRYDYDNGALYATLGYVQDKVSGANNKEEKGKDTEYFDARMGYRFADFDISAFVADFDTNVAKGDHQGYGAELVFSGIENVYLSTAYYGVNSDTANDDNATIAFAAGYTMGLWGFNTGYSIGDHDVALKDEDRWFVNSTYAIAPNTKVYAEVGGIDSDDKATYKADNGLAIGVEASF

SEQ ID NO: 11719 - protein, 408 aa, Vibrio fischeri
MNKKRLFSKTLLAATITLATQQATAAGFQLNAQSATGLGRAFAGDAVIADNASVMSRNAAAMALFDSSQFSAGLNYIDTDIKVSDIQYGGQDIDDANNGSGTPVPNIYYIHRLNDKWAFGAGIYSNFGTENNFENDFGTSHTTVGASALGGTTEIKSVNFALTTSYRINEQWSVGGGLDVIYGAGTLKREVSVKNPMTGDITTAATLVDIDATGTGLGFNLGTVYELDERNRFGFSYHYSPEIEAEDGNQKVTLPLPDMLEFSGYHEIKDTKFAVHYSVQYIGWSDFDKIEFTNNPSGLSESVYDWQNGMHYAIGGTYFLNDAWTLRAGYMYDTAAQDELTSISVPDSDRQWFSAGFSYHFEKKHTVDFGFTYLMGDDVEVEESSIQTLKATTHADAILAGVQYSYSF

SEQ ID NO: 11720 - protein, 438 aa, Vibrio fischeri
MNNNKNRLSIAVALGLLGSVASSHTMAAGFQLAEYSATGLGRAYAGEAAIADGADAQWRNVAMLTYLEGTQVSVGGIYVNPNIDVEGVSTQRSGTTSTKSEDFAHDAFIPNLYVSHRVNEQVAIGFAVGTNYGMETDLGSDFSATNFGNEASVITKEINVNMAYKINQQFSVGGGVRYVIAEGSFGATIPNQSPTHIPTPIGNIPLPPAGTTLKYMEGTDEAWGWQVGTAWQINDANRIGFSYKSEVKLDLAGHAKGAAFNPKNPTQHFAGSMALDLPATAELASYHQLTDKVAIHASFNWTDWSSFEKLEANIPTLGGKDLIKEENWEDNYRLAFGGTYQLNQKVTLRSGVAYDTSAVSDEDRTATIPETDRLWLSTGVGYAWSNNLTLDAGFTYIFAKDAKMSEDQGDEAALFGGTFDGETTGNVWLVGVQANYRF

SEQ ID NO: 11721 - protein, 436 aa, Vibrio fischeri
MFKKTKLVAGISIATATLISQQISAAGFAVNEQSATASGSALAGNAASDTDISYSYWNPALFANATETTLYINGSYISPSVEMKNQTATNNASTTIGGSGYSSTQGSSDPSDAATIPAIYLAVPVNEKTVLGVSLNVPYAIASDYDDDWAGQYHATKTEISDISLSLSAAYRFNDWVDVGASIQAHSTSMTLEAEVIDADDDGYGVQELEDDLSFGWSVGVAMEPQPGTRIGIGYRSEVDVNQEGEVDFSDISAVGQSTAVGLVDSDITADNTLPDLLTLSLEQELTDDLTLGLTAMRTGWSSVQELNIDYDDDTTSLSNSVVTFNYKDVWFYSVGLTYDYSEDLVLRTGYAIDNSPSDPDNLSARAPGSDRQWITFGGTYDVSESTQVMFSYIHLSSDPASVDKDGTGEDSSRGSFSADYDISANIFAVALNTTF

SEQ ID NO: 11722 - protein, 762 aa, Vibrio fischeri
MENIPAGDYIVRVTAEGMYLDEQKVSISGRAAVVLDFVLKPYTSDLSEVNIYDSKRNKFAVKQSDAVAKMPLSQLENPQSYTVIPKELLQEQQVFNVEDGLRNVAGIQKLWDATGRSGSGAGLFSLRGFSTSIRLRNGIVGNVASGMDAANLERVEVIKGPSATLFGSALTSYGGLINRVTKKPYDTFGGTVSYTAGSFGMNRVALDANAPLNQEKSVLLRINSAYQSAQDFRDNGFNKSFSFAPSLSYIANDRLDFHVDAEIFSGKGTGFSEFYLYPVPEALYGLNGADQLNINRKSAYKNNSLVNNTQTLNLFGQMNLKLNAKWKLQTNVSLNSSSSNGRMTYFYLMPNAMIPESGQTTGADYLARMVWTPVTSDHGFEIQPNLTGDFRIAGLRNRLTVGLDYYSYQNNTNYERFGNSFTSTAGVIPLGDLFDIIPLKGPSPRYNEFNEGRVAALYASQPTAPYYTKTNTNTYSAYAVDVLNITDQLLAMASLRIDRFVSRPLYDAVSDTRTTGYNQTSLSPKFGLVYQIIDKQLSLFGNYQNGFANYQGKDAYGNDFKAEQANQTEGGIKTDLFDGRLTATVSYYHIKVKDIIRASPEPINGVPNARVQDGTQRSKGFESELMVNPFEGLNIIAGFAYNDSKMLNVRKDIDGRRPTTAGPAKLANAYISYTIPYGKLHGLGLGVGGNYGSESAVVNSESRGKFVLPSYTVLNSSVFYDLPKFRFSFGVNNLTDEKYWIGYVSLVPQSPRNVLGTATFKF

SEQ ID NO: 11723 - protein, 721 aa, Salmonella dublin
MSRFPLIRLHLSGIFMKIISVRQRLYPALLLPLTFSPVLQAASASNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGPPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCRGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11724 - protein, 387 aa, Salmonella dublin
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNASSTIAGRTIAGGDKADAWTAGLKYDANNIYLATMYSETRNMTPYGKTDTGYGGVANKTQNFEVTAQYQFDFGLRPAVSFLMSKGKDLTYNNVNGDDKDLVKYADVGATYYFNKNFSTYVDYKINLLDDDDPFYKDAGISTDDIVALGMVYQF

SEQ ID NO: 11725 - protein, 1961 aa, Salmonella dublin
MQKKKLISIAIALTLQSYYIPAIAAENNDDEKECPSNISSLPKEKRAKLSPTCLATPENDNHWGWVAGGVAALVAGVAIGVENNGGGDSNHSYTPPKPDNGGDVTPPDDGGNVTPPDDGGNVTPPDDGGDDNVTPPDDSGDDDVAPPDDSGDDDVTPPDDSGDDDVTPPDDSGDGDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSATGGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGNIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGKTKAIINNGEINLLCDSGCDIYAPGTTGTQNDHNGTADIVIPDATTAPTEGSIPTPPADPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNNTQYDMLALRQTLDLTASQNLTLEYGIARLDGDGSKTAGDNGLTGDYSQFFGLKHSMAFDEGLAWNNSLRYDVHNLDSSRSVAYGDVNKIADSDMRQQYLEFRSEGAKTFTMMGDALKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 11726 - protein, 696 aa, Salmonella dublin
MFATTRMALLIGGAIGGATFPLSAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11727 - protein, 681 aa, Salmonella dublin
MGDVVFTSNFNNADDANADSNGDGVISASDGFSPIGYDTNNDGVEDTNGGWSHDNDNVDELNLKLDNGSKWVGDAYFSYEYIAPADMYDLEDGTNSLEPSSTVDKWGNVVDDKTFQSGIFTVALDNGSEWDTVNASNVDTLTVNNGSQVNVADSSSLIADTITLTNGSTMNLSSYGEVDTDHLTVDSYSKVDLTNETAYLYANTITVSNGGEFSIGAGEFDADSFGTDTLELTNAGVFNINNSDYVLDADLVNGHTNTTDTSNATYGYGVIAMTSDGHLTVNGNGDYYNGDNTADTTYSANGEADNSYTDNVVAATGNYKVRIDNATGAGSVADYKGNELIRVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 11728 - protein, 185 aa, Salmonella dublin
MKNIILSTLAITTSVLVVNVAQADTNAFSVGYAQSKVQDFKNIRGVNVKYRYEDDSPVSFISSLSYLYGDRQASGSVEPEGIHYHDKFEVKYGSLMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 11729 - protein, 724 aa, Salmonella dublin
MSFIQYRRDKHLPSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIIDADLGATTSLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11730 - protein, 572 aa, Salmonella dublin
MIVRKQLAQRAYKDITDALRDVPGVTVTGGGYRQDISVRGLPAQYTTILVDGKKQTGRESQPNGSGGYEQDWLPPLDSIERIEIVRGPMSTLYGSDAMGGVINIITRKNYRKWSGNLRAEIKIQENSDSGADSQIQLAFSGPLIENLLSITASGLYQKREEDDIERGYAEKELRNMRTAFHLTPNTTDTLTFEYILQDQTRTSTPGKSLPERNSLSETESERHSYALTHEGKYKDLTSRSYVQQESVENVGRNITIDNLVANTQWSLILNESHMVTLGAEFLEESLDDFDTNSGDATNIENSQWSVYGEDEWRLTDKLAFTLGLRLDDNEQFSSQVSPRAYAVYNINDNWVLKGGVSTGYRTPELREMAEGWVQESRGGNIYGNPALSPETTVNKEIALYFSGDDGFEYSITAFHNDFDDKIAIATCELDVCLDDTDRYNINIDEVESYGAELAARYNIGNWSFNGAYSYTRSEQKTGANEGLPLVQQPKHLFTLNTTYRLSETGEIWSRWTVRGEETALTSVSSRSILSPGVGVFDIGYNTKLTRNIKLLALTRPIAKIISANVAGAFTAA

SEQ ID NO: 11731 - protein, 377 aa, Salmonella dublin
MTIKITALAASIGAAMAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGSTDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11732 - protein, 751 aa, Salmonella dublin
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDISLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 11733 - protein, 186 aa, Salmonella dublin
MIIRKYFLIIALLLMPWLAIPSVSAADKGWFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 11734 - protein, 650 aa, Salmonella dublin
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLAAVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDDRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 11735 - protein, 171 aa, Salmonella dublin
MKKIACLSALAAVLAFSAGTAVAATSTVTGGYAQSDAQGVANKMSGFNLKYRYEQDDNPLGVIGSFTYTEKDRTNGAGDYNKGQYYGITAGPAYRLNDWASIYGVVGVGYGKFQTTDYPTYKHDTSDYGFSYGAGLQFNPMENVALDFSYEQSRIRSVDVGTWIAGVGYRF

SEQ ID NO: 11736 - protein, 614 aa, Salmonella dublin
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGGYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 11737 - protein, 253 aa, Salmonella dublin
MKKILTLTLSSLLIIPALTHAEFKGGFADIGLHYLDWTSDTTEKTSKKSHKDDFGYLELEGGANFSWGEMYGFFDWENFYNGRHAKPGSEQRYTFKNTNRIYLGDTGLNLYLHAYGTYGSPHRANFHDDMLLYGLGYNFTGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 11738 - protein, 868 aa, Salmonella dublin
MLSRNKLNLATRAAVLASVAGGSLTSASAYAQLEEVIVTATKRSASTQDIPVSVQALGENTLNDMGVTNFEDYLVQLPGVTAGGSGPGQNTIYIRGVASTTPNLTTAGVAGLSPNVALYLDEQPLAQPGRNLDVYAADMNRIEVLAGPQGTLFGASSQAGTVRLITNKPDFSGTYGKMKLGTAFTKGGEMSNSVEGMLNMPVTEKLALRGVVYVDRMGGYIDNVAGTLNARESARFRPEGTMRANGVPVSAQREGFQAGADLSDVTFIDADNSTKTEDDFNDTTYSGFRLSGLYTINADWDLQVSHMQQQLDSDGVFFSDPELGDYNVTRFQPDSIDDEFSNTAWTLTGRIGELEVLYSGAFTDRQTDQLVDYADYLFVGQYLPYYICDSSVSYPGDAAPSGTCQAPDLFVGSTTKTEVSTHEIRLNTAEDRRIRATVGAFYSDLELKERNDFTYPGSTQIDGYGVQTGFSPNFPFTTGYRSDEGPFPDGVIFRNDVRRTDEQMGVFGEVTMDITDDLALTLGARWYDIEVGLEGSANASFCNLFQPDSNSFGTDISDLYNGDGQITFRGTCDPDAQITYTLDNIEDAPDQVAAALREAPTSAQTDGVIGKISLSYTPTQDQLWFVTLSEGFRPGLLNRPGGAAGPNGYQVPFALDTDDVTNYELGWKLDLLDQSLRFNGSLFFVDIERLQTTIFDPSITNLFFSDNAANAEVMGLEGSLDWAPASLPGLVVTGSFSMLDTEITEVLTPTNDVRKGDSLAFAPEFQATVRARYNWDLNNGLRAHVMPHLAYSDESFSDIIAINRQTVDSWLMLGFTAGVSNTQWTAEVYVDNLTNEAAELSNNFVNDRDRVTLARPMTGGVRFTWNFE

SEQ ID NO: 11739 - protein, 230 aa, Salmonella dublin
MKINKYLLGMVSFIAFSSYLQAATLDYRHEYADRTRINKDRIAIIEKLPNGIGFYVDASVKSGGVDGEQDKHLSDLVANAIELGVSYNYKVTDNFVLQPGFIFESGPDTSIYKPYLRGQYNFDSGVYMAGRYRYDYARKTANYSDDEKTNRFDTYIGYVFDELKLEYNFTWMDSDQIKFDNKKTNYEHNVALAWKLNKSFTPYVEVGNVAVRNNTDERQTRYRVGLQYHF

SEQ ID NO: 11740 - protein, 113 aa, Salmonella dublin
MYSETRNMTPYGNSANTIANKTQNFEVTAQYQFDFGLRPTASFLMSKGKDLTGTDGDKDLVKYADVGATYYFNKNMSTYVDYKINLLDDDDNFYSANSISTDDIVALGLVYQF

SEQ ID NO: 11741 - protein, 206 aa, Salmonella dublin
MKVNIGGNMKRVLVGAAMIMAGSVTAQAQDFKPYAGVGIGAFGLEMKDTSINFKQKNTVLGGFAKFGVDVNDYFGAELRVGTTAKGDKTYGVGGVAAGSPAGTIGQKADYFVSYLAKLQYPVSQDFRLYAMLGATTAKSKITMTPALGTGSSKTKTGFSYGAGGDFTVNDQLSVGAEWMQYWTNVTVTTNGKVKIWGAVGTLTMHF

SEQ ID NO: 11742 - protein, 165 aa, Salmonella dublin
MKKIVVAVLVGLALGSIGVANAAGYKNTVSIGYAYTDLSGWLSGNANGANIKYNWEDLDSGFGAMGSVTYTSADVNNYGYKVGDADYTSLLVGPSYRFNDYLNAYVMIGAANGHIKDNWGNSDNKTAFAYGAGIQLNPVENIAVNASYEHTSFSTDADSDVKAGT

SEQ ID NO: 11743 - protein, 1055 aa, Riemerella anatipestifer
MKLKLKLALLFVMLVSFCNYAQEAYTLKGKVTTEVGNEILPGVSIVVQGSTVGTETDFDGNYTIKVKQGDVLAFSYLGYATKTFTITNQQTLNVTLAEDSSALDEVVVVGYGSRKRSQITGAVAKIGGGEVAAVQAVRVDDALAGKLAGVLIQNQDGSPGAAPKIQIRAASSISGASNPLIVVDGYPISGGLETVNPNDIQSLEILKDAASAAIYGSRGANGVVLVTTKKGSSGKTTFNYNAYTSISNKYRENILMSGPEWAAHSRAQIAAGNWTSTVNLVDPAFLEYRLSAYENSPGAISPEDWLFQTGSTTAHDFSMSGGNEGTKYYASVGYQNAEGVVQTQGFERLNARLNVDATLGDKFKAGIAFNGFTSKRDILGHDMRDLLRAYGVHSIYHTAESIAFVQQLDQQAQALGLAAFDNGYRGSTYEASSIYDLEPGMAAQDWHYGRANNGIGGSGDAGPAAKLDNVDSWQKTFFGNVNTYLQYNILEGLNIKTVLGGDMRDTQTYAHRLLGYDSRARDSQTFMDQADLKVSTVLSETTLNFARTIGKHDISAVVGMEFQNTRFIGTRLDGANVPDEAVLNYNLFDPADITVTERDETRVRESVFGRVNYSYDDRFLLTASLRRDGDSRFGANNRYETFPAVSVGWNLHNESFLQDSETLSRLKLRFSTGSLGTTSFLGSYDSLSLLDPSATIFGTGYLIPSNSANPDLTWQTNTETNFGVDLGFLNNRFTVGLDYYTSDIEDILINQAQSEVLGNPTSILNVGDVRSSGFEFEFSGSIVSQEDFSWSASANLSTVDTEITDLGGLDELPQQIFGQSGRGPVFRNYVGGGIGEMWGLETIGEVEMEYLADGTRHPNNQSGESYVVDQNGDGIIDRTRTVEDGGDLVKIGQNTPDFYWGMSQNFRYKKFDMSFQLQGSHGAEVYNIDPLYYGSQWGGRLDYARLDANGDGIADHNGEYYERNRNQTDAMIQDASYVALRNLTIGYTLDDVASRIGLNSIRLYGAATNLLYIMASDYTSYNPEGVNTTDPTVYGAQVGASPVVRSFTIGLNVKF

SEQ ID NO: 11744 - protein, 1082 aa, Cyanobium sp. PCC 7001
MYYQQRIRNVVSLLIMSMLCLASFAQGLQVQGIVKDKNGEPMIGVNVVVKGTTNGTITGIDGDFSLSGVKKSDVIAFTYIGFKNKEVKYEGQKQLNVILEEDTETLEEVVVIGYGTVNKRDLTGSVASVSAEDIAAVPVSSATEALTGKLAGVNITTTEGSPDADVKIRVRGGGSLSQDNSPLYIVDGFPVSSISDIAPSEIQSIDVLKDASSTAIYGARGANGVIIVTTKSGTEGKTQVDFGASFGLKKVTKLTKVLSPYDYVAYQHELGSTDYGNYSDMDIWKSVEGYDYQDDIFGRTGNQAQYNVNVSGGSKQVKYNVSYAHNDEKSIMLGSGFNKNNINAKINAELSQWMTLDFNARMSYTTVDGLSGGADTNESSAANSIVANAARFRPVDPLTSNSDDEENNTSSQKNPLERLLATYKKRNTFNQNYNVGLNWKPFKNWTFRSEFGYGWKYDNTDQVWASDAVQNSKLGYNGQPQSVLTRDITKNWRNANTLTYDNKKLFDGRDKLNVLLGHEVSSSQKTSLENTSVAFPGTMTIDEVLANMGAGTALPTQTTISAKDNMLSFFGRVNYTLMDKYLLTVTVRADGSSKFAKGNQWGVFPSAALAWRLSDEAFMKGTQDWLSNLKVRLSYGTAGNNRISSGLMYTTYTMAGNTGKAPFFDETRGAMLEHGSNLYNPNLKWETTITRNIGFDYGFFNNRLSGSLDFYWNTTKDLLMKTEIPSNTGYSYQYQNFGKTSNKGVELTLNAVLADKAKWGLNFNFNISYNRNRIDELSTENPWQSSNWSGSTIAKYEDYRVEEGGRLGEIWGYKTNGFYTAYDPVTNPNGELVLNGTSWELREGIKDNSYSMAGGKPYPGQLKYECDENGNPIKQKLGNTVAPLTGGFGFDGFIGNFDFNIFFNYSVGNQIVNGTKLANSFCAGSAKGYNLVNDFALDNRYTWIDPETGLNLGKPSSSTVDYYGGAEGLIARLNALNTGANIYNPAAVTAMYLNDYAVEDASFLRVNNITIGYTFPKAWVKKAFMQNVRIYVTGYNLYCLTSYSGPDPEVDTSSKKNAMTPGIDYAAYPKSRSFVAGINVTF

SEQ ID NO: 11745 - protein, 541 aa, Cyanobium sp. PCC 7001
MKLFQQLLVAPAALGLLAPVAANAAELNINGVSDYASSSEQVTSITQFSDVYPTDWAYQALSNLIERYGCVAGYPNGTYRGQRAMTRFEAAALLNACLDRVTEVTDELKRLMKEFERELAILKGRVDGLEAKVGELEATQFSTTTKLKGKTTFVTGAVNAGGNNGSEYVYRNRNYKFNGKTGTASVKRYTDKGKTYKNSKSYSSNGFKGGANAYNANYGAFTFNYDQRLAFNTSFTGKDKLYARLRAGNFTKGKNAFGGAGVNLTALDIATDSGASGTINNAVQLDRLYYKFPVGKEFTVIAGALARNTEALAMWPSVYNKGAIKILDWTGLMGTSGVYNKETGQLIGAYWKQNTKKGANAFSVSVNYVADDGNGNITNPNDGGFMTDNSEASFLAQIGYGGPEWGLAFAYRYGQCDSGNGLRRGTTFAKFDGKWNNDCYQQQYNAAGLTGGSLFSDVEDNNGYAVRSGGSTNSYALNAYWQPKNAGWIPSFSVGWAINQNTTNDKLPGSPRFQESCHPCDQYTRGLEDMTNASLQRGCKG

SEQ ID NO: 11746 - protein, 517 aa, Cyanobium sp. PCC 7001
MKLFQQLLLAPAALGLLAPLAANAAEINIKDVAEYANSPKQAQAIKTTQFSDVVPGDWAYTALQNLSESYGCVDNAYTQNLKSGQALTRYEAAALVNACLDGGIASAEVTPDAARLANEFGTEMAILKGRVDGLEYKVKELSAGQFSTSTKLNGKVVFATGYVKPEKGSAAAYSDKLTSTYVAQYNLNTSFTGNDRLYTRIKAGNMDSTPWENTTYGTHLAAAHKGGSALSVDKLWYEFPVLDEFKVWFGPKIENYYMLASSPSIYKPVTKQFALGGNAATYGSSTDGGFGVAWTQSVDDRSEPRFAVSTNYVSKGASKSTEGLLTDGADSKWLSKVEYGSPKWQVSMAMAKNECSGSCKNWQEYYTTSSGSTHTGDSTAYALRGYWRPDTDSAIVPDLQVGYDWVNVDDDGATGSVEKASSWMVGMMWADAFIDGNRLGAAFGQPQKATEIVGGGDADGTEDGAFAWELYYDYKVTDGITITPSIFGSTDRYKGHQNMGLTRDDQFGGLVQTTFKF

SEQ ID NO: 11747 - protein, 493 aa, Cyanobium sp. PCC 7001
MKLFQQLLVAPAALGLLAAAAATASEIRTELNMDGVNQYASQEQVTSISQFSDVQPTDWAYQALSNLIERYGCVAGYPDGTYKGQRAMTRFEAAALLNACLDRVTEVTDELKRLMAEFEKELAILKGRVDGLEAKVGELEASQFSTTTKLKGEVSMILGGMPDFDNVDEGPNPDQTTFNYDVRLSFDTSFTGKDLLRTRLRAGNFESLPFGSSSQIFKLDKAEATDDSVIIDRLYYDFPVGDSFNVTVGALVRNTEMVAFIPSAYKSSILDYFQLSGASGTYNKATGAGAGFRWKQQVEKGRPYATFSANYVSSDGFADSSVGAFNEEGGINALAQLGVKAPNWGAAVAYRYGSEASRIRVPNFSGTVLSGESTNSVAVGAYWQPTDTGWIPSISLGYGYNDGSGGFPDSQSWMVGFQWDDAFAKGNAAGFAFGMPPFVDGDEGDEAWLYEIFYKFQVTDNISITPALFYGTNAASNDGDDAWGGVIQTTFKF

SEQ ID NO: 11748 - protein, 385 aa, Cyanobium sp. PCC 7001
MNRFGEEKTEMVRMKGGKAGAAGVGVAVAMLFAGAAHAQSTVTLYGIVDAGVTYTNNAKGHALWQFTGGNESGPRFGLIGTEDLGGGLKANFRLENGFNVANGALGQGGRMFGRSAWVGLSGANWGAVTLGRQYNSTQDILGSLQMSSFLAQYSTHPFDNDDINNTFRTNNAVKYVSPTIAGLQANLVYGFSNSTGFANDNSWSAGVTYVNGPLNAGAAYARVNHPAVSASGAVASDNYYPASESVFGASLGNAIRQQIWGAGGSYAIGPATLGLLYTGSNFGQATGGALRFNNYEGSLRYMITPALMAAAGYTYTQVARASDTGHYHQVSAGMQYLLSKRTDVYVNGFYQKASSGVGQAWIDGTDSASSTTSQVAVVVGIRQKF

SEQ ID NO: 11749 - protein, 709 aa, Octadecabacter antarcticus 307
MADLSNTPNTYLLTPLAFFIGSIFSSAAFADDTSLEVIEVHGHSQNTHLALGSAESLLNDLGVDFSAAGGVSNLPILNGLMGDRVKVLVDGADVTAACANHMNPPLSYVSANQITAYHVIAGISAVSAGGDNIAGVISVNTISPQYSQSNELNWHSGYVSAQYNSVNNARKVGVGARIASNTLSFNYQGAFSDAKSYDDGNGDLVLDTLYRVQNHALSAAIRDEKQQFVIKLTHQKIPYQGFANQYMDMTDNTSYGATVQYKRVLENSELEAQLNWHDVKHEMGFFSLEKTGMMPMNTDARDISSQIKWRLNLDSNSSLLLGQAFYDYRIDDWWSAVEGSAMMGPNDYININNGQRKRIAAFAEFESQINTKLWLNSGIRVEHVNTRADDVQPYNEGMAMMTMSAMPMQPSNASAAAAFNSKEHDKSDTVVDISVLLNYQLTHTDELQLGIARKNRAPNLYERYSWGVSNMATTMIGWYGDGNGYIGNQNLEVETAHTISSTYIKSAQNDDWQVSANIWYTNATDYIDADLVRSFNRFGLENTARNILKFTNTDAVLYGVKLDLAANIHQSKALGNWQLNANITNTRAKRDDTNQPLYQIKPLHTKLAINHQLGRFENTLSWQWNDAKTRVDNNRLENQTDSYNIVNLGSKASWGDLTLSAQVSNLFDEYYQLPLGGVSIAQLKKGESTGFEQLAGQGRSFNIGMSVAF

SEQ ID NO: 11750 - protein, 1700 aa, Octadecabacter antarcticus 307
MKRCIVLIFFFLVSVAGAKTVVCAETAPAETVKTAAGTREAAASGETTETHLPKDQALTPWLLDPSVFAEDQGDRTEKRRVAEKEVKTIKLANVVPPIRFRTGEADIPDEYVALLRGVLEKMRGRLNVRLHFVGHADPQSLSDPLKAKYGDNTGLSRERAGTTAEYCQRALGLPPEAISYEGVGESKPVAGNATEDGRALNRRVEVEVWYDEIGEKMVEKDVIVSRQVNRVKVCRTETVCKMRYKEGHSHRVRVKNLIAPMHYDAAMVTVPEEFLQQIRQALINLRGKENIVVKFIAYSDNAPLEGRDERIYGDQAGLSKAVARRVALAVHDGLKEANVAVESDGKGASQPVASNDTTQGRAMNRRVEVEFWHDDPLQELPDEPQLCPEDAGAETVTRVYDPPSGAIAPILFQNGNPSLHDGYTERLRQLMDEIKERTNVRLRFVGYISNERLDRRTAAIYGDDIGWSTARARRAMTAVSEKMGPGGKQAEFEGRGYVQSSDVVNTGFTESAVSRVEVQIIYDELVALNDYEGVDIVRMSREVNTANPFALNLMRISVDGRQVDDPNKSIPDVQRCTDVALDRAQIEFKYDNLRTEPRLNVTAWPRSIRYQDLTETEFAENLVRFRLYTNYHSFIKRAEVRVFDEARSVNDTAVAVIPMNGEGMAEWRAGFESFSAPVRELKYLVRVYDANGNFDETTPQPLWVIDQIDPSVAKADTGTELLAGYGGSRIAQRNIPLSGGTVQAYGSAIPAEHRVWLAGYPGPVDGKGRFIAEEILPKGMHTVEVAVLDKSGNGQLFLRDLALKKNDWFTVGIADLTLSANKTSGPAKLLAPDKPQYSNDFDAQGRLAFYTKGQFGNGWGLTASADTREGPLDEIFSNFLEKSPQALFRRIDPDYHFPTYGDDSTVVEDAPTSGKFYVKLKKDDSYGLWGNFRVGYTDNDLAHVDRGLYGGNLHYQPPGVTSFGEKRFMVDGFAADPGTVAGRDEFRGTGGSLYFLRRQDILQGSERVRIEVRDKDSGIVLGVKNLTPVLDYDVDYLQGRLLLTQPLDSTAADNLLVHSDSTGGNPVFLVVRYEFTPGVEDLDAMTFGGRAHYWIGDYVKVGVTGNQGNDGGNDESLVGADVTVRKSANTWVKLETGRSKGSDLFTTNSLDGGFNHSTIQTPADPRTAATAYRVDVSAGLQDFNKNWRGRFTLYNQVLGAGYSAPGQVADQDTSQIGGTAELPVTDRLGLHLKADKRTVDKGLDTQSAELNANYQMNEHWTLSLGARRDSREDHSPVVPLTQEEGDRTDVVGKVLYDSKARWNSYLFAQKSVQTTGNREENDRIGVGGAYRVTGRFKLNGEISEGNLGTAGRLGTEYLYSDRTTIYLNYALENERTDNGVQANKGTLTSGFRTRYSDSASVYGEERYTHGDVPTGLMHSYGVDLAPTDRLNLGAKTEFGTLQDNLTGAKIKRTAVGVNAGYGFAKLKITSALEFRVDDSEQPDTSTVERTTWLLKNSFKYQLTPDWRLIGKFDYSQSTSSQGQFYDGSYTEAVVGYAYRPVNNDRLNALFKYTFFYNVPAAQQINGTFTSAGVLQRSHIASVDVMYDLTPRWTVGGKYAYRLGQVSMDRVDPEYFDSRAHLYVVRADWHFLHKWDGLVEGRMLDLPDAHDRRSGVLLGLYRHLGDHVKVGAGYNFSDFSDDLTDLSYRHQGVFINIVGTI

SEQ ID NO: 11751 - protein, 1089 aa, Octadecabacter antarcticus 307
MFESKKILAKLPQQRFKKSLLAVSIVALSSPVIAQVSSGNENLEEVVVVGMRGSIETAQDLKRNADTVKDVITALDIGALPDKSVTEALQRVPGVTIERFASSDDPKHYADEGTGVLVRGLDRVRSEINGRDAFSANPWGGLSYEDFPAELLGAVEVVKNQTADKISGGIAGTVNLITRKPFDSNEQLISFSAKANYGDFREEVTPSFSALFADSWETSAGKFGFLIAGSKSEYQTRGDGVGMGNYHSRGKLDTFSYDEWGTPSPGVVAGMYSNPCIPGDPGWRACGPGFEDTVVYSDEDAAAYVPLYDGTELPGQPEGTTWYAPANFHVSTAENDRERTGFTTSLQWANADETIIATLEHINSKASLEWREYVIASGDRGFLAGNGNALQWSEDTENGYDFSVDANGFLTSGIGRNTDPNFPLQFRSRYNYNENTVEDTSFNVTIKPTERLTASFDYQHVDSEQIVHNYGLTSRINGNQTATYAPFYLDLRGSTPTIEFLNENVSYPADVAENTNPILRLASGMQQEIHNTAKSDSVKLDVQYDFDGVFTAIKAGVYYSDKDLNVADTEYEGWQALGTPWDAVDSYNASPQVAPHLFERVSFADQYNGKVIKGDYNSFLFPSMALTKNYIQTLRDGCGTWSALGNAMDGSGKCAQPYEDLADRVDSHFAARHMSSTNEERTEFYVRGDFDFAELPVPIKGNVGLRYVGYQLESSGSVTLPATSRRGTSPDQSLYQVMQAQYPSLFALASGEAVPSTVKGTDYNTVLPSLNLAFGVADDVVVRFGASKGLYFPSLLDTRNSMVVSLDYTEVLQDPTEGKDETTNPVVDLTDIEISANARNAFLEPEESVNLDLTAEWYFAPAGSVAVGVFHKKLSNIIRNKQFDLELEYAGTTYPVSAYGPDNTGSGTIRGVEFSYSQFYDMLPGAWSGLGLQFNYTYIDQSGLEDPNTNPAEGLRYDGSGTPITDNRNSFRVFTGLPLQGYSDENLNIVGMYEYNDIAFRLAYTWRSEYMLTMRESEEFVPAYAKAQGMMDASLYYTINENWKVGIEGSNLLNAETKTQYQLNQDGVKTDALSFTTDRRYALSVRATF

SEQ ID NO: 11752 - protein, 377 aa, Octadecabacter antarcticus 307
MKNLTKMVFAGSLFSCAAVQAGGVYLYETSTADIGLASAGMAARAQDASVMSANPAGLSNVAGQSFSGNLISLYGDTTLDTANGGDAGNIIGYVPLGSAFYSQQVNDKWTLGIGVYGNYGLGLEYENLFDHIDIPNAITQALTIQPSASFRINDQWSVGAALGIHYGTLDIDVKNASKSLSVGVEDTDVQVNGRIGLLYELNSGTRLGLSYSNETEFEFEDKDFLTDAVAPQQLVFSAYHELNDKLAVMGNLNWQDWSAYQTVMDVETQDTYQIALGTQYKVNSKVMWNTGFAFDSSLFADQSNGDLTIPSGNAYRLGTGIDYKIDEASTVSFAFEATLIESSEVQGPSGNSIASFDDPALYFLSVGYSWKNQSCYE

SEQ ID NO: 11753 - protein, 212 aa, Octadecabacter antarcticus 307
MTALFVKKTLALAVLGSLGSMAYAQSSVQLYGIVDAAVRHTTNEGKDKSGKTQMIGGGMSQSRWGINVTEDLGGGLAAIANLENRFTTDNGEQAAGQPYFAQSWVGLRSKSFGQLTMGRQYNMLFDLVTSTYSSFPYSPYMEAYKPEIGMSMGARANNMLKYVAEFGPVRGALQYSFDEGNTLADSKVKCNTCQPVRSADANHFLALSPASA

SEQ ID NO: 11754 - protein, 835 aa, Octadecabacter antarcticus 307
MASEFKTRLMAAAALTGVMAAAHGAQAQSAEPATLDEIIVTAQLRAQKTIEVPFALTAYSGQFLEDLGIQEFEQLSAFVPGFLVQNQSPNNPGFVMRGITSDSGAATAEPRVSVFQDGVSISKSRGSYVELFDLERVEIAKGPQSTLYGRGALIGAVNLVQNRAQPGETEAYANIEAGNEDYRMVEGALNLPVGETGGLRLATRLKTRGGSVENLLGGEDYNAIETKAVRLSGAWAPSDAMRFDVIGNYQNDHASGTSFKSIAYEPADPNTGAVLGGKEPWEGAALTPGGDFDGGKTLGLSREVWGVTGLARINLNSAWTLNSTTAYREFDNYETFDADGVSLPILTAAEETHGEQWSQDLRLGFDNGGRLTGFVGAGWFHEEGYQRAPAQFDERLVLAQLAGLLDGSPTAVGDNTLPLSVYPTVARNVLTSMLTPLGAGAYAAPITANLDSNHIETSTNSSELTSYDVFADATYAFTDKFEMSAGVRYTRDDKTTGYASSVDSRSALGALLAIQAGAIPAAQVPAFLAAMANPAFANLPASVFPLFGLTSQPTANNGDFSYYDSEDDGVTWRVTARYELTDDTNLYANYARGRRPEVISASGPSAPGGAARFSPVDAETVDSYEIGAKSALLDGRLRVDGAVFMYNYENFQTTIQQGTQFITTNAGEAKSYGFEGQANFAVASMLDLFATYAYNHSRFENGIYDGNQFRLSPDNAASIGATWRLPVTGGEIEVQPTYTWQSKVFFSDDNDIPALQTANFVADLIQDEYQDAYGLLNLRIRYTPDSTNWGVEAFGENILDEEYIKDAGNTGDALGMPTFIAGRPAAYGLVFKLKL

SEQ ID NO: 11755 - protein, 739 aa, Verrucomicrobiae bacterium DG1235
MDADDKTRAFPRMIPALTGLAAGLSLQAGAALAQSASPGAVIVLDQIEIRADTTARRFEATPGAVALIDRSDASGEAAPTLADTLSEVPGVVVQEFFGGNDQPRIQIRGSGLQQNPAERGLLILQDGMPVNRADGSYVVGLAAPGQAESIEVFRGASANRIGANVLGGAINFASPSGASAPGMRLSFGGGSFGRGEVAGSYGIDGERADVLLRFEHAQKDGYRDYNGSRRTGIGGNVTLQTGEAVTRLFLSHTDLEFDVAGPLTWDAIRNDPESNHAGPVIVGGVPEGPGPNVLRDRPRRETRQTLAGARTTLERGENIYDFGLSLSRTDDSFAFPISAGFRDTEGTDATLTARYSRLGEGALPLFETGLTWSFGKADRDYFHNLGGARGPAFGRNRLTADTVSVFAGANLPLGGFTLSPSIAFNHASRESDDRWGGATRPTVAYSPMNPGMRLPDGAVPAVSTSYDRSYSGFTPALALSWTPAEGQFAWISLARGFEPPTHDDLLGTVGGTPNSGPGRPNPADPAAPAAMFATPDLEAQTSTTLELGWRGTWQNLSWDATVYHARLKNELLSLRDVTGATLASVNAGRTRHSGVELGLSGDLAETLAARLAWTWQDFRFDDDPLRGDNRIAGAPRNVISLVLDWRPVERLTVTGKLHWVPGKTPVDNMNTVFNDPYALVDLGVEYALTPNALVHLQVTNLTDERYAASTLVVDQASAGQAAFIPGEGRAFYLGTRLRF

SEQ ID NO: 11756 - protein, 670 aa, Verrucomicrobiae bacterium DG1235
MLSPSLRMAQSGFFPRALYHSCFLSCLLTSSAFSEEALPALIVTADRVEEPISRTASSITIIPSEEIEKRGTFGLPNVLRGVPGLDLYETGGPGTATSVFLRGSAPGQTLVLIDGMRIGDPSSIDGSVDLGGLVATDLDQIEVLRGPQSALYGSAAMGGVINIVTRKGSGAPRASVLMEGGRYGTAHTRAALSGGTDRLSYAFSIDGLYTSAFPRYGYRITRPLTIGDGVTPLPPAPSSDPTRKGGFHGRLAYNFTNDISIEGGVIGYDSSIRFDNPYAYNTADIFNPYNHQHATFLQGYLLGKADLFDHFLHNRLSLFGNITDHSVWQAQSCYDTAYNAFDCRMGFRGARRGGEYQGDAVLGSLGLFTFGVRLEKEVADTSQDPAPPGAFDPIHASQTTYSGFAQHQLTLFDRFDITYGGRMDAIDKGPTFTTWRATGAYRIEETGTKLRASAGTGARIGSLYQRFSQYGNPALAPEYSIGYDAGIEQTLFGGHVSFSANYFENRFRNLIDFGMSASCFAIQVSGCYNNIGRAETKGVEFASEAVLIPDEWRLRASYTHLVATNLDTQQRVPRRPRDKGMLSIIYSAIPDFEFEARGLFVSATPDYDYTYGHAVMLPAYARIDLFASYKLNETVTCFARIENVNDARYEEVYNYGTPGRSLYGGLRVTW

SEQ ID NO: 11757 - protein, 900 aa, Verrucomicrobiae bacterium DG1235
MDTKKNKIELWKGNEMRTSNFKKSILATNIALMLGTAVSMSAVAAEADSAPTADENIEKIEVRGLRASNKANINEKRFSNAVVDAVTAEDIGKFPDSDVGQALGRVPGVSVGRTFGQGSSVSIRGTDPLMTLTTLNGQNVASTGWYDQMNVDRSFNYSMLPSELIGGMEVYKSSQANLVEGGIGGTVIVKTRKPLDMEANSVFGSVKGEYGTVNEEWAPELSGLYSWKNESETFGILLAGSYIDREYLRTGTEADLDWGGRSSIQPSSFLQEQERTAVDATIQFRPTDNLEFGAHILSMQLGADSIGANMYIETDTNWGAGDSNCQKFNAAGVCVLSVTPESAPTDVFYQNWARKGEMTSDTFELNAEYEGDGYTLSAVAGNTKAEGGTQMSANFGYGWWGDNFGQVKWAGTVDATGKQIDINGRDMSFTQDQLDTTVGTSQWTGVQGPNRDEENYVQFDADFDIDMGILTKFETGIRYTQHEFEKSENKAVYDPNKANSFNTSDLYSGTMKLGYDGWTIPKANLDAMIDSTVSLVDEFVYNRAAYGLIEEDNLSIYGMFSFQGDDFRGNFGVRYISTDVTSSGHVIDNSPADKLGVNAGWSEEVHSESDDYADVLPSFNLSYNVTQDVIIRFAAAQAITRPNYDNLFLSSVSGYPDDRRGNEEITYGNPGLKPMKSSQVDVSLEYYYGDGNLVSATYFTKDISDFIVATTKYNQQIGVINNDLETPADDWTVNNFENANDGQIDGIELQLIHAWDNGFGVNANYTFANGTAPSEVYTDSIGIFTESSEHTANLVGFWENDDFSARAAYNWRSEYMIREYGKYYGNRMHDDFGTLDVTLGWNITENIGLQLEVVNLTAEDDVQYGAAAAGTDVKPALQDDFPTWSFKGETTYKLGASFRF

SEQ ID NO: 11758 - protein, 212 aa, Verrucomicrobiae bacterium DG1235
MSLMKKIYKSIKLIALLVACLAIPSLAGAQVVKNMYFNVDWQINSPFSQDFSDKTSGWGAHAEAGYYVIPNFSVGAFISYHTNNKYIDRQTLPVSSTSAITSDQQHSIFQLPFGAAFRYNVAPESQFQPYAGVQLGASYSEMSTYMNVMKVYDRNWGFYVSPEIGMTMYFTPQKQIGLHVAAYYNYATNKGEVLSYSIDGLNNWGIRLGLAF

SEQ ID NO: 11759 - protein, 727 aa, Verrucomicrobiae bacterium DG1235
MLLAQLSRARRRAPFSFQPVVPDLRPVQARSLRPVAALMLAMSGLAEAADTTEASDITLPAVSVVGTASASYNPPDASGATRTDTPLREIPQSVRVVPRAMLDDIAATRFAQTFDYVSGIARQNNFGGLWDNFAMRGFTGHENTGAGYLVNGFAANRGYTAPMDAATIERVEVLKGPTSSLYGTSEPGGTFNVVTRQPQFRPAQRYGFELGTRDGYRATADVTGPLGENVAGRLIAVADHQGSTRDYINSQRYLVAPSFTWTLGNDTVLQYAAEFQRYTTPMDRGVVAVNGQLGRIPRSRFLGEPGDGDMRLDSQSHQLSVEHQFSQNWKGRLGLSYRGGALTGHSSEATSLAADGRTLWRQRRYRDFQSDDVSLQASVTGKFSTGPVGHELLMGVDAYRFGNTMAILRKNPSAAAPYAIDIYDPAYGQPAPPMPWNMDTYERQRNLGAYAQDQLSLGERWRVLAGVRFDAFDQSLDNHLRGTRTTQHQNAVSPRVGVSYLASQNVSLFANASQSFRPNAGADAAGLPFDPERGRAVEAGIKFDSEDRRSGATLAIFEIRKRNVLATDPSDPSFYIAAGEARSRGLELDVAGQLGTHWRVSGSFALTDAEITQDTRLAAGTPLSNVPRTSGSVLAVYEDAAPVGQRYGVGAGLRYVGRRPGDVQDSFSLPAYVLVDLHGYWQYSRNVRVSLNVGNLFDKTYYASSYSSLWIAPGAGRSVRLGVQLSY

SEQ ID NO: 11760 - protein, 707 aa, Verrucomicrobiae bacterium DG1235
MICRECRSDSFFIHRYNCKNISFMNVLNSRSCRILMVAAIIGSASSQAWAADTVPGWTADEIVITATRTENPVSKLPMAVEVITRQEIEESGSLNLADVLAEAEDVNALEPVNGRLGVAKLRGLGSSLTLVLIDGYRLQSGFQGYSDLREIPAGMIERIEIVRGSGSALYGSDAVGGVINIITRKPTKDLHGGLSISGGESRAGEAGTVETDGWVSGSAGKLGFAVAGTYYDRDRYDRDQSDLMTDGDDRRIASGSASLTCDLTPGVKLTGGIVYADNSLDGIRTQNSGDFDRWVDSDRLLVHAGAEIKTGEESNLSLKVARSTYDWRSDMDNHDGVPTVTSATASGTTTTTETTMASRTKVSQDYDQFDARWTGRIAEVHRLTTGVEYRTETRTDSGSTVTTKVVTKTGLVNSGPTTMVATDKTDISHDVDNLGLYLQDEFTGLKPLTIIAGVRYDDHSDFGSEYSPKVAVLLPVDSHLKLRASYGEGFRAPSIYELYTGSLTTRRSIVLSNPDLKAERSKTWEVGADFSRGGFNAGVTAFRNEVRNMISLVLADDTTTPDTYQYQNLSKAMTRGIEISASLALPHGFTLSDRVSFLDTENLDTGEALFFAPDVANVLRLDYANSRFGLKGNVRVVSTGTQYSSADEKISGYTLVNCYLSKSVSKHAELFAGVDNLFNDDANTGYGNNEGAGAMGTYFYGGLNFKL

SEQ ID NO: 11761 - protein, 796 aa, Verrucomicrobiae bacterium DG1235
MNHKRYLLALLSTTSLLGVASPALTQAGGETTAVEELIVTAQRREQSLLDVPLSVAVVGGDTLRDANLASVTELTQLAAGLTYNTNFGGGFLIRGVGTQSVLISSEQSVSIVIDDIVQGLPEISFAGPSYQALTDIERVEVLRGPQGTLFGKNSSAGVVQIITKKPSLGEYLGDATVSYATDNEMRVGANVNIPLGETAAFRLSGFVNRRDGFVENRFTGKDLSGYTMRGWRAKLLWKPTDRAELYLVGAHIENEDSGNGIWTLRSCGSGFSGTQGVIVPCNEVAKYGVTAGPKNLAGAWDGPTGVKTVNDSVSGRLTYDLGGGAVLKAITGYYEIDTNEDLEVDSSPRRILSTNVTQLRQRQFSQELRLEGTYGNLDYTVGGFYYKSRNLTIGLQAGTFALIPDSSPISLTTAFGPVRCCISAQDSTTESLAAFSQGTLRLLDDRLSITGGIRYTDDKVSLDSIAYDAGNVCQVAFALGGACKVPGMNEVATRSKSVDDVSGRVSVQYEVVPDVNVYATYSTGYKGPLISYARGQPLFEVDAETVTNYEVGLKGAFFDRRLVATVALFRSRYSNFQGQTTVVDPNNPAVRSLITTNAGGLKTKGLEADVVFQATPELTLRGAYAYVPTEYIDFAIQCNDRYANPATVPGQCTYISPRAPGVLQFNAGGYPLVFAPKHTFNVGLNYERPVLGEYLFGASLTYNWRDETYTGAADPNSIVPSYGLLGANVSFGPDDGRWRVSGFARNLLDEYFVTGIFKTPLDAGTAGSTPLSTVGYSNIPSIESSRTVGVKLEVNF

SEQ ID NO: 11762 - protein, 1261 aa, Verrucomicrobiae bacterium DG1235
MNISDGGSVTSQGSIVSEFATSNGAVTITGADSIWTVSGNIIIGRQEDATVTISDGGTLDTRGSNTIGLFNGTGSVVVTGAGSNWTAANNIVAGRSASAVITLSEGGVLEITGGNRRLVLGQESGARGTLNIGAATGEAAAAAGTFIGSQVRLTAGRDVIVFNHTSTDYTFSAGLFGDGDVLIENGTTTLTGNNSSYSGTNTITGGTLRVTDIDQLDDSSTVLNGGRFVYADTSNGSYSALTIGSSAGTIEVSENSATFTISSGLTGTGSITKDGAGVLRLTGANDFSGGITITDGSVQVDNISSLGTGTTTVNGGTLSYSGTASATYSNLVLSAAGGALEVTESSGVLEVSSSLSGTGSLTKDGSGTLVLSGTNTYSGGTFITGGVLQVDDLDRLGTGVTTLNGGSLNYTGTGAVTLSDLVLGGADNTLDISNSAASITVSSGLSGTGSLTKSGAGTLILTGTNTYSGGTTVSAGTLQGDSSNIQGDMLIASGAAVALTQATSGTYSGDLSGSGALTKTGSGILTLSGNNSGYSGVITVNGGGLSISAANQLGTGTTLLNGTSLSYTAGTDTTLTTVALGAGASTLEVANAAAAVTLSRDLSGTGSLTKTGAGTLILSGTNTYSDGTTVSAGTLQVSQVANLGTGTTTLNGATLAYSGVGTDSYGALAVGAAGATVEVLDRSGALQFTNTVTSTGTFTKTGAGSLAFNSSSNSFVAGLTVQEGTLLIGDATDFSAASVESTFTVDADARLGGHGTADGSVTLDGGTIAPGASFGTLTLGSLDATGAGGALEMEIGSDPVSGMVNTDQIQILAGGSVDLNGIALNLVNVMGPTPVKIGDEFVIIDNLSTPGTEPPTSTFSSVNHDMFMLDVNVIYGIPGDANDVAIQFIRSSNNFNFLADTRNEHAVTQALDTINESGDLFTQLASMNNAQIKALLNPLAGEINASTRAILLADSRFLRQAVNDRLYTAHSAFASKMDDDMVSRTVGDFAMWGQAYGSWGEFFSDGNARTSGRSVGGVLVGIDATYFNMVQLGVVAGFGRTSIDISSIDASSDSDSYSVGGYASANPIDNVKLRGGVAGTWYNIATDRNVALFPEETLSADQFAGSVQVFGELGYTLESTYGNLEPFAGIAYAYLSGPGFNETGGAAALKADGQSNGLTFLTLGTRGEFDLSNYLYGETSFVGLAAWQYSSADTLDYTQSFIDSGIPFTVASVPIARNVALIEAGLQSNLSDHIQLNINYYGLLADEAVDHGANARLFVLF

SEQ ID NO: 11763 - protein, 1097 aa, Verrucomicrobiae bacterium DG1235
MQTSYDLMAYCTGAPLDGFSNQLECRYFMVTNGETQVRAPGAERKRRRPSPFLVIQPVLRAYGRGRMLLCATAMIAATPALASAQTAAPATTTTPTHHHKTTARHTTAKAKTSTPTRAAPAAAVPAAAIPPAAAPATTSSTRNASIIAGAGAAAAAEPAPPAETENVVVTGTLFHDPNAASAAPIEELTSRDMQRRGIKTVTDALQQLSSNGSGNLTNAFGANGAFAAGASAPSLHGLTTDSTLILMDGQRLSYYPLADDGERDFVDTNWMPQSIMERIDVKEDGGSATYGADAVGGVINFITRKEIQGFEGNAEGGLSQLGIAGHQRLYATYGHGDLARDGYNFYINSEYQQDDAVYNRDVGYPYNTANLTGIGGTNWINNSSNPSATKGSPEAMVAPVVNGQAVGAYQLLNPSASCGKYGSKSSGTLGASNNYYGQGNAFSGCSQDTTAAYGVISPSIQRINATAHFTANVTPRSQFTAMFTYSQTETDFLSYTPAYLQSLSQSKQASSYNLLIPARLPNGQLNPNDPFAAQGEPASMIYQFGDIVPYTSEYNQNFRGSMRYNGTAASNWGSDWNYDFNFVGMNSVLTQTYTGYPTINGITNAVNNGTYNFVNPSQNSQSVLNSIAPKDVVQDRTQEYSYEMTGSKGLFRLPGGMVNLAIGGNIRWEALNAPNGNPYNPADPGAQYWQINPVNAQGSRWVESGFWELGLPFHKMLNVDLAGRYDNYSTSTGVGYGHYTPQATAIFKPVDQFALRGSFSRGFRVPSFSETGGDTVGYIGNIISNPAWLAAHNNDAYTKSYYVGLNSIGNPNLKPEIATNFSGGAVIKPLPWISLSADYYYIKKSNYIMGNPLGQDAGDISEAYVSGQPLPSGITVTPDVADPAAPGAPARPGLINYSYINAPWMRTDGVQLGFTASHRLPGVLHEVNWYSKGEMTYVRRLSVGLPGGGVEEYAGTIGPYNTVSASGTPRWKANWANTFTWRKLAVTPTVYYTSGYKLVAEDVNGPGASSCATSSVAGFGWNQEPSTQCHVRNYWDVDLTVNYQIDRRWSVYANVYNLLGFRSPYDYATYGSYLYNSSWSQKGIVYRSFQFGVNVKL

SEQ ID NO: 11764 - protein, 203 aa, Verrucomicrobiae bacterium DG1235
MSKVSFFKRSRRDLLRSAHNIVSPLVYLMGMGNAILSFQYTFPVDDKLRLNFAGSITAFHPLVPTLKPYIDDLDGGKGSISEFGQRNPIYAASGGGTGLMLNYKFTDGLKLSAGYLADGLTAGNPRQGNGLFNGGYGALGQLTWDITDGFSIAGVYVNEYAPPGRFGFNYNGLGVSGTAVANSLAGQDIPFGGVFGVEQFPTI

SEQ ID NO: 11765 - protein, 1000 aa, Verrucomicrobiae bacterium DG1235
MKILTTRLTGAAWILVCLFWATGNLLWATPQQSVSGTVTDAQENPIPGVSIRLLNSNTGTQTDMQGIFSIQAQPGDTLSISYIGFKTIRLPVKNQTHFTIVLQQDITDLGEVTINAGYYNTTRREQTGSIARVSAAEIERQPVTNPLAALQGRMAGVNITQTTGVPGGGFDIEIRGRNSLRAGGNEPLYIIDGVPYNSQSLSNTNVSATLLPGANMSPLNTLNPYSISSIEILKDADATAIYGSRGANGVVLITTKQAKAGKTRFSLQAYTGSGKLTRTLELMNTEQYLEMRREAYANDGVTDYPANAYDINGTWDANKYTDWQETLIGGTATTAALQGAVTGGSETTRFRIGGGYQRETSVFPGAFTYHKLSVNSNLNHQSADQKFSINLTTSYSFDDNNQPGNDFTRDARMLPPNAPDLYTEDGALNWADSTWDNPLAQLEQDYRAKNHTLIANAVIGYQVTPHLKVSSSLGYNDRFLTEVKEVPSTFYNPAYGYGSDRSYRFTNDTRNQSWIIEPQLNYTLNMQNWKLDALLGATFQNQTTRSNVVYGQGYSNNSLISNLSAASFIFVLENGSTAYTYTAGFGRLNLKYKDRYILNLTGRRDGSSRFGPGKQFANFGAVGAAWIFSEEDVIQDSPWWSFGKLRGSYGITGSDAIGDYQFLDTYSITTNRYQGLTGITPTRLFNADFAWEENKKLELALELGFLKNRILLNTAYFKNRSGNQLVGIPLPGTTGFSSILANLDATVENSGWEFELSTVNFQNEKFNWSTSLNISFLRNELVSFPDLEGSTYANQYMVGEPLNIRKVYQYTGINPETGIYEFQDYDGDGSISFPNDRQAVLDLNPDFFGGLSNQVQWGAFELNFLLQFAKQQGSNYYATGSRPGIRSNQPVALLDRWQEPQDDAPFQKLTAGGDSEAVRAFSNYRNSSASVTDASYIRLKNASFSYNLPERLLQGVDARIYVQGQNLLTFTRYAGSDPETQRIDNLPPLRFLTLGLQANF

SEQ ID NO: 11766 - protein, 676 aa, Verrucomicrobiae bacterium DG1235
MPLFLLATFNGYAAETAADVHDHVKGAKTNDGDVITVTAPLYSPLAIVTSPKTPRQPVPASDGSDYLKTIPGFSQIRNGGTNGDPVFRGMFGSRIKLLTDGAEMLGACPGRMDAPSSYISPESYDLLTVIKGPQTVLWGAGASAGTVRFEREHPRFDEPGVKFNASGLTGSNERWDGNVDASIGNELGYLRLMANKSRSNDYKDGGGYRVPSRWDKWNSDLALGWTPDKDTLFEFTAGKGDGEARYAGRSMDGSQFKRESLGVRFEKSNLGEVLDKVEAQVYYNYTNHIMDNITLRSPNSAMSMGMSSAGCKHGCGMHMNMNHGMSMQLDRRVIGGRVMGTWLWQDFKLESGADTQTNTHRNKAGNVWQKDAQFYNYGLFSELTWYATEQSELITGARLDRSRVKKFAGNSEKERNDTLPSGFMRLEHTLAAMPMMFYAGIGYTERFPDYWELFSPTYGPTGSTSAFDGVKSEKTTQLDIGAQYTGERFNGWVSAYVGCVSDFILFRYSPTNARISQADNVNANIMGGEMGFGYQLTDHWKTDASLAYAWGENRTDNKPMPQIPPLEARFGLTYERGDWSSTGLWRLVSSQHRIAVGQGNVVGKDFQDSSGFGVLSANVAYKVNKDIKVSAGIDNILDKEYSEHLNLAGNSTFGYSANTSVNEPGRTVWAKVDIKF

SEQ ID NO: 11767 - protein, 438 aa, Verrucomicrobiae bacterium DG1235
MNTYFDIPHRLVGKALYESYYDHFGQMDILSDGSLYLIYRRATEHVGGSDGRVVFSKLEGGIWSAPTIVAQAGGQDFRDVAGGTMPSGRIVAASTVYETGEVKVYVSDDSGVTWVHKFTLARGGADYNFAHGKSFQVGARYVIPLYAATGVNYELKWLESSDGGETWGEGSTIYSGNTPYNETSYLPVGDGVILAVARVGSGAGGALRQFISLDDGGTWTDQGNVTAQNGDSTDILVAPSLSYIYSEGGTPHVVLLYTNRTTHFCYYRTILLAKAVAGSSGWTERVPVYSAPAASGYTSQVVLGGRRILGNLFRETSSTTSGAYQFEVYLGGVPDFESDWFSVSSNSLYTLSHGLQRSPRRVVVEFARSSSPSTWNIVMPSYFNDGGHKGSGAQVEVGSLNIRLGTGAAVWGTGYFGGIDNSATTRFATGYYRVRAWI

SEQ ID NO: 11768 - protein, 324 aa, Verrucomicrobiae bacterium DG1235
MKPMTKTLFCLLSPMFVYSSAAVAEGYYSDGDFYFGAKLGGALLDSQAKQEPEENKAVNLSSGLVFGYNLNRYLALESDLSYLGKGQDKQQSTLSADKHLFSIATYLSTRYRLSDEASLYFKLGPAWVNDDISISSGLGIKYRFSPRWELDTGYRWIKDTPSTDDDLYEFTLGFNYKFGVVSHPSVRPAIDPMHKPLDKQQVLITPTINVQSVSIRGNSVFGFDSSKLTDTSALDEVIKSALASKNASISVTAYTDSLGAERYNLALAKRRAEATQAYFITHGVAPSRIHIDWKGEENPVSSNMTAKGRALNRRVEIEIAAHTD

SEQ ID NO: 11769 - protein, 792 aa, Verrucomicrobiae bacterium DG1235
MKYLLLFTQLLFLSVVVAQDKPTISGTVKGMHNEVIPFANIYIPSLKKGTAADEQGVYTLSIKNDGNYKIQVSAVGFVTKTEDITFTSNKTVNYSFILDLDNSLEQVEVFGRRNSHPDKIEALTRLPLATHEQIQSISVISEKLIENQGALTIADATKNVAGVYTFATYGNKRESISSRGFRGIPILKNGVRVHSDFRGVGILTDMQGVDNIQVLKGAAAITQGVATDLGSPGGVVNIVTKTPKYSFGGQVSQRVGSFGLTRTTADVYGPLNQKETIAYRINGAIQRSDSYRSGISSQRFYINPSLEFKIDNKSKLTLELDHFYDSRTPDIGTVNLDENDTNAIYDLPYDQFLGFENDKAVTKNTTYAVRFDRILSDRLTLKTAYYASQLDLNDKGASLGGAVSLNNETQYNLRERGYSSAYRTDNNSTLQLDLIGKDVQTGSIKHTFQIGLDYRTSYASYGNETVNVVDTLNVFMANSNVLPNLDFEVENSTVSETNALGFVAQDVISWNKWLNTFIGLRYSTTETITGDEITSSNAFSPLVGVVVSPSSHLNVFASYTNSAYPRTGNRIDINGNALGNERFDQLETGIKTSWYNDRLRFNVTYFKINNRNINLPVYDDNFIATGFYEKGGNDQRQGVELELTGRILENLTAVAGYSYIDAQYKDHTSFVYGSSPLNTPSHTANLFLNYSFKNRLKGLSLGGGVYYTGERPVNDWSAGAVSHEGIVPNQEPFDIEAFTQVNLQASYVFNQNWSARLLINNLFDEIGYNAYRTRFINQTDPRTLSGVVSYNF

SEQ ID NO: 11770 - protein, 1126 aa, Verrucomicrobiae bacterium DG1235
MKIRMRKRCDIPHSASHFQKSLIIASWLLAFLFTGTAFAQESRTIKGIVRDVTGEPLIGASVIQKGTNNGVITDVDGNFTLTVPADATLSIAYMGYATREINLAKRKKQGDLKITLSEDTQQLKEVVVTAMGIKKDTKRVGYAISTISADELVKAGAPNFASAMYGKAPGVRITQTQGGSAGAVSINVRGLTSITGNNQPLIILDGVPIRNGGTGKGTDFAEFGNDGQIRSNGLVDINPEDIESLSILKGASATALYGSEAANGAVVITSKRAKSGKLTVDFNAQVMANLPAYLPKVQTVYGPGTYNTAYSDYEKQTGGFYQRTLNGQSYKSLRSTTLSFGPKYDGSEVLYWDGKMRPYQALTDNPWKELFRTGWTQTYNLAISQGTETTSNRFSYTFMDEIPNALTGSFTKHNFKLTGSYQLAKPLKLEYSLNYIVQNVEDRPQTSLNLYSGFGNMFSTFLDIPYLKQSYVTSLGYRNTFVGGNATLTPEESWAYDPSYATGVNNMLWNMYHHHSDETENRLIGMIRPTWQITNWLSLRAQVSTDITDVKQTLKYESEQPNSLYDPNGSFQSINRRYDIVYGDVMLNFNYNINRFDIAATVGWTGRYENMNNMRVSTNGGLVTENWFDLNASRYTPSSTLQRMELLKTGYMGTLSLGWDNYLFLELTGRQERSSTLKDQSFFYPSANLSFLFTQAFHMPSWWNYGKLRLSYGIVGNAPETYTANIVYEQGSDNGFTWNTIPSSWGNADIRPEKKYEYEIGLESKFLNNRLGIDISYYNNRVKDQILSTPQPSTSGVKNVLMNVGEVANHGWDISISATPILTRDFRWDLTANYGVYKNKVVKLADGVPYLEILNSGGSGIKIQAVEGQPMGDIYAQVPQVNENGEYLVSDKGLYLNQTELQKVGNINPAGVGGLFNSFSYKNVFLDFSIDFRIGGDVINEMNQYATAVGLTPESLKYRDTEHGGLSYYYPGDNNSSGIPVQVDPSTGAGPNGEIIYHDGIILPGVVASTGERNTRIIPAGYYYNTTYNWGTEAEQLTYRHSVFDNSYVKLRELTIGYQFPEKMISKLGLGRLSVSVFGRNLFYFYKALKNYDAESSVGTSWANQATVGSSTTATRSFGVSLRASF

SEQ ID NO: 11771 - protein, 1052 aa, Verrucomicrobiae bacterium DG1235
MMTYYKKCRIYGVVSVAFSVLFAFSEFAVAEPLSVFNGKTVVGVQQTKRTISGIVKDATGAIIGATVMEKGSNNGAVTNINGEFTLNVSPGATLVISYIGYKDHVITVDNQDFITISMVEDTQKLNEVVVVGYGTQKKVNLSGAVSSIAVDKITEGRPINNISNALAGMAAGVQVMSSSNQPGEDNAYIRVRGQGTLNSAAPLVLIDGVEASINSVNPQDVATISVLKDAASAAIYGSRAANGVILITTKQGKAGSIKINYNGYVAFESIRSTLTPISNYADYMELINEGLLNSNQQEPFSQPMIDAWKNDAGKNPLLYPNTNWVKETFRPSTATTHTLSVSGGTDKIRFYTSFGYNNDPGVMENTGHKSYNARINIDANVKKWIKIGLQASGWISDSGVSSVSDVFKTAVATTPGMVFRAPDGRYGAMNNVEDNAQSAGNNPLRKLNSLEGNKRSNRYKARFYGTITPFKGFSVTASYSAEFVHSLTEKKPIFVNGWNFQLDSETYTPKGKTSISNSQSNIERNFGDIVARYEAQLFNQQFTIKALVGASQDQYTSKSFSANKQDLLDISLNVLNAATGDASASGSISSWAMRSFFGRINLGWKDKYLAELNLRTDGSSRFARKKRWGYFPSLSAAWRLDQEAFMENIVSKGLNNLKLRVSYGSLGNNSIGNYDAISLYGKTVYVFNNKPAIGMAQSAISNASVTWESTYVTDIGLDFGLFNNRLSGTIDWFNKRTVDILINLPTPAVHGSTSIPKQNSATVTNKGIELSLGWQDQVSDFSYYINGNFTYVKNEVNKYKGTGVDGREINGAKVLWEGYPINAGYMLLVDRIIQTDEDLQLVQNMIDNAPLDKNGKKINPFATYGKPEKGDLLYKDTNNDGIIDKDDRQIVSDGPNPKFFYGLNAGVTYKGIDFSTIFQGIGGVKVYWQQEGYNTPTVRHGYQINKEIADGRWYEGRTDATYPRLLNYTDKRNTQISDFYLENKAFLKIKNIQLGYSLPKTFVARFGVEKFRIYGSLENFFTFTKYKGFDPEVSGMNYPTMKKAVIGIDLTF

SEQ ID NO: 11772 - protein, 373 aa, Verrucomicrobiae bacterium DG1235
MVCEYFHSLKALKLPASQRQDDTGPSTPAACQVGKSDTKGIRGEEAQAQDGGAVRKTRSAMKRVSIRSVAISCFLYGAPSFAAADNALFSSDDGNVVVFGDIGLANIKAQEFFYVGDHKISQLNWESKGVTLFTVGVDGQIDNDWSLKGSVKVGTGGNGHLVDYDWTIIEREDWSDRSIHPLTELDHYVAAAIELDRIIYGNDTSSIAVGAGMRYTDVKWTAYGGSGISTKKTFRDKRWELLDWERGASYRQKIPVGFLSLSGEHVLGDLTISGGLQTGLSFGIKSIDDHWLRNLRFSDDMSPAPTIGANVAVSYAVTPGASLYLSGSFERVFHSRGDKERHNFATGEIEFRKDYAGATFEAMSVSFGLKGTF

SEQ ID NO: 11773 - protein, 396 aa, Verrucomicrobiae bacterium DG1235
MNWRSVFVAIPALCAAPAFAFAQSSVTLYGLVDAGIDYTNNVGGHAAWQMASGFAQGSRWGLKGSEDLGGGYRALFQIENGFNVNSGTLAQGGRMFGRQAYVGLGSTRFGTVTLGRQYDSLVDYLAPTTANGSWGVYPFSHPLDNDNTGNTFRVNNTVKYASPEFAGFSFGGTYSFSNDTGFARNRQWSVGAQYEQGGLLIGAAFLNANDPGATSGGAIAGSGSVGADANFASTRLRIFGAGINYTAGPATVGFAYTNSNVTRPTANVGYLFGDETIQPVTGPLAGGTVTSIKYQNFEVNGKYQFTPAFFVGAQYVYTTVRYDATTGSAKPKIHSVGLMADYNLSKRTDVYVMGAYQRVAGDATGSSLDQAYIPGAADLSSTSKQVMVHAGIRHKF

SEQ ID NO: 11774 - protein, 437 aa, Verrucomicrobiae bacterium DG1235
MIQLKRQAAGLVVGTLLFAMSAPVYALGILDAYSLALEKDPTFRAAIKEKEAGDENENIGRAGLLPKISLNYQNSPRNWQTQKYPQSDFLGNVSEATRRQQYRSYSSSVTLTQPLFDYEAYARYKGGVAQAMMSDERYRGKLLDLAVRVSSAYIEVADAKDQIALAEAQKAAYKEQLTLNDRLLSAGEGTLTDVAETQARYSLAEAQAIEAHDALDAAQRELEAVIGVPLNQLDELQVLRPGKFRVAPLIPAKFEEWQKIALENNPALSASRHGVDAAKYEVESNRAGFMPNVQLYASHSENDSSSDNTVNQKYRTDSIGVQVSMPIYSGGGVAASTRQAVARYGQAMAEMDMQVGTTLNDLRKQFNLCNSSRVKLTAYELAVKSATTQVTATRQSVLAGQRVNVDVLNAEQQLYSARRDLAYRQIHLHQILDHPIE

SEQ ID NO: 11775 - protein, 419 aa, Verrucomicrobiae bacterium DG1235
MTFNKTLLTLSLTCSSFYSVGAAFQLAEHSAAGLGRAFAGEAAIADDASVIARNPALMAQFDQIELSFTGTYVIPDVSLTGIDAPTGINPVALNDSSIAPSAIIPAIYLVVPLNDKFALGFGTFSNFGLATEFDDDYAAGQLAGETSITTVNFNSSLSYKVNDNFAIAGGLNVIYADASLIRNFGDSPLPSPPETVAANLAGDDISYGWNLGLSYDFNENNRLGFSYRSEVELTLEGDYSNGLPANLGGLAGDVVMGTMDITLPAIMEFSGFHQLNSSLAVHYSAVWTGWSSFDELAGYAEGVEDPVFSKEENFADSMRYAIGATYQLSSNIKLRTGIAYDQTPTGEEHRSISIPDSNRIWISGGLNYSFDDQSSIDLGVSVIQGNSETFTEKDDLGQQWTFESQGDAYIVSAQYNHVF

SEQ ID NO: 11776 - protein, 756 aa, Verrucomicrobiae bacterium DG1235
MSYFKNNNNRWYVGVTTSVVSLGLFGAGASQSSAQTAASQDLPQIAVRAPKQAKPVARPAVRRAARVAPPPAAEAAREQTAPPTMGTTRTIGAPAPAYAGGQVAQGGTLGLLGSTSVMNVPFSAVNYTSKLIEDQQARTAADTLINDSSVRTTTGANGFDDTFIIRGFAVSASDIGFNGLYGLVSSQRVPAEVIERIELLKGPGALINGIAPSGSIGGGINIVTKRATDQDFARLTPFFMSTANYGLHLETSKRFGDRKEWGVRFNGVGRNGEASIDDGNVQSGLGALAIDYRGDRLRWTLDLFSQNDNTDNFRPQISLSALATAIPAPPDARSNWYPGTTLRQKDNTVASALEYDLTNALTAYAGVGYREGSNNQTFPVSTTAVDALGNFTVRNTYYDSYTKTVSGNVGLRSQFDTGFISHKLNVAYTGFFQEAGNAYIQGATTTASNIYNPSPLAAIAATRTAPRHSSDTTLTSAAIVDTMSLLNDAVLLTLGVRQQDVKVDSFSTSSGALTSGYDASATTPLAGIVVKPWRNVSLYANYAEGLTRGTIVGAGYANTGAVLAPYKSEQQEAGVKVDWGTITTTAAVFQIKRPSSITTASNELAYDGEQRNRGVEFSAYGLILPNLRGMASATFLKPELTNPSNPAQRGNDAAGVADKTFSAGLDWDTPWVSGLALNGRVIYTSGSYLTTANTVRFPDWTRVDVGARYTTAINGKPVTFRANIENLFDKDYWLTTGTYVTVGAPRTYIVSAAFDF

SEQ ID NO: 11777 - protein, 992 aa, Verrucomicrobiae bacterium DG1235
MKNLKILLLVAILTPFSLFAQANGSISGVIIDSENGEAVFGATIVVRSEKKFAKTDFDGKYSLSLPPGSYDVEFQMYGYGPQKRSVVITPGKNQSINVTFGAQTLETVEVKDRASNNTESALLALQRKSAAVSDGISQEAIKKSPDSNAGDVVRRVTGITLIGGKYVFVRGLGERYSNTVLNEVLIPTTEPDKRVVPLDIFPASILKNIRVIKTFVPEDPAEFSGGLVKVETQEYPDKFLLNVGLGIGRNMNSTGYEFKTFDAVDFLGRPNSAYQLPGIVNSLPGFLPLEPGNRFGGLPPNFVNLSSLTFNQQWTPDSGKGGYDKNINFTVGNTFKLTESGQRLGVLLGVVRSEEYRIRDEKSARYIPNYAGGIIAPETTYLIPIQKQDTKVYNKDTNFAANLNLSYEMTKGQQIYLKNLYTVASDTTVRDAFGQNFIDNFDFLSQTGIVTSRGLLNTVLGGDHALQFGSMNRPHKLEWNLAYSLANREEPNLIQQVWRRSNPANLSDGYFRLGNNPDGTRFFSSTADTVRQANLKYSIPFEQWNGLKSELKIGGMALDRFKSFTFREFGNKSNVGTQFPVDYYPVPGEVVYNPTEYVQRSTGVANKTFSERQIEPNAYDAQQKLHAQFAQVDMPLIPKLRFIGGVRFEDSFQKVKTFRTRDTSSLRNVDYGCTVNNEDIRVALVRSNICDVDNNGIGTLRNQDKLPSANMVWEMNKDMNLRFGLTQSITRPDLRELSPFGFTPYFGADRIFGNPNLKRTYIHNYDVRYEYYITNSDFFGIGAFYKNLSNPIEMVGLPQSGGISFNFSYTNAKEATIKGVELDYRKEFFDRFRVETNLFFIKSQVQVLSWLDSAFIKSGAIDKLNTAASFDPTNLSRPLQGQSEYVYNLKFDYFITPKKNQTIGVYYNFFGDRIYAVGANGTPDAIERGVGITDVVYTYKHDDRLDFKAAAKNIMDTRFKVYQKSEVTGEDLLFYSYRMGVTFTVAATYKFF

SEQ ID NO: 11778 - protein, 769 aa, Verrucomicrobiae bacterium DG1235
MIKNICTVILLLLSVLPAAGQNRVKVKISGNVITTDGAPAEYITVSLKNTVFGGMSDGDGNFEFAAPPGEYTMVVQSVTAHRKEFPVTIETGRENVFPNIEVKEDINQLEEVVVTGQFSPQSMKNSLYKVRSVNSDQIRQKAPLDVQSLLNTEIGIRLSNDMALGETDFELMGMSGNNVKILMDGIPMIDRGSTKQSLSQLDVNRIERVEIVEGPMSVVYGTDALAGVINIITKKGPGYSGESTWRVGARIQEETMGKEYQFFNGEGLHNESIDLGFNLKNGLYFNGGYTRNDNGGWQGDLTGREKRWHPKDQSLANGMIGFQRRNLNVWYRLDFLDEKIFGPLNGTAIEPEKVSDKDYLTKRYTHQLQADWRLDNRLSVNLALSYQDYKRRTQTTWTDLSTGEKWLSAEDASQDVTQYKAWIARATATWNIGPKISLQPGLEYQWTEGKGGRIDGTPTISDLAFFISAEYKPWSWMSVRPGVRAFLMADYEAPVAVPSILTKFDLTPDMDIRLSYAYGFRTPTLQELYFSFHNDNHDIDGNPDLKAEYSNNVTGSFTYRILHNARIRLTTTLSGFYNVFKDKISLAQNVDIPNYNTYYNIGRYKTLGGALETSLAWGGLRVNVNASLIGRYNKYASDDKSLPQFRYSPEVSTTISYHIAKSGTDISFFYKYTGQRKEYYYHEYTTPDNKKESEIYLRGLPSYHYGDITVTQKLTSFLSLNVGVKNLFNLTDIRTIVESANDTPSVSYLGCGRSYFIGLNLMLNGKFKK

SEQ ID NO: 11779 - protein, 1106 aa, Verrucomicrobiae bacterium DG1235
MNKHIILLFIILCIGLTRASAQHSITGKVLDATNQEPIPFASVTIKNVKSGTTTDNNGNFTLKVNNNDILIVSFMGYETKEVNIGTQKKVTILLSESSVLLDAVVVTGFQNLKKTTFTGSSVKIKADDINLPGETDISRMLEGKAAGVSIQNVSSTFGSAPKIRVRGATSINGENKPLWVVDGIVLEDVVNVSNDQLASGDPTTLLGSSVAGINTNDIETIDVLKDAAATALYGARAMNGVVVITTKRGKEGKPRIHYSGNYTVRTKPRYSEFNIMNSADQMSVYAEMERKGLLTSDIVNNQSSGIYGIMYNRINTWDESKQQYLLENTYAARHNFLMEHAAANTDWFDLLFTNSIMNEHTLSVSSGSQKSKSYISLGFLNDPGWTVADKVNRITMNFRNDYQLNDKIGFSFQTVGSVRMQNAPGSLSRSSDVVSGISSRNFDINPFNYALNTSRALRAYDSNGEREYYTLNFAPFNILEELDNNYIKLNVIDLKAQAEFNWQIFKGLKYNFTGAIRYVRSKQEHEIHENSNMANAYRAAGNSTIRENNPYLYKDPSDPSAEPIVVLSKGGFYNTAENLLLNYDIRNSVSFSKIWNEKHEFNALLGQQIKYSDRQTNSNTGYGFQYDMGGTVSMNYLIMKQMIEQNFDYYSRALTYDRFAAFYANVDYTYDRRYSISGTVRYDGSNTMANSSSARWLPTWNISGKWNIGNEAFMKDFVWLDALALRAGVGLTASMPPLSNATPIFINSNTTRPSTDIESGIEIYTLGNSDLTWEKSYQSNFGFDATFLKGRLDFSFDYFIRNSFDLLSVIKVSGIGGERYKWANSADLSASGFDITLSGKPIVTKDFMWSSSFTMGYSKNEIKNSMQQPQINTLVGITGGNKNGYPVNGLFSIPFAGLNPENGVPMFYDENGTITSDINFQSTSTDYLKYEGPTDPKYTGGFNNSFTWKGISLDIFFTFQAGNVIRLNPVFNSSYNDSQATPKEFFNRWEFRGDEKHTNIPAIADKDLISDLSSTYPYSAYNYSDIRVAKGDFIRLKSLSVGYTIPQKLFKSWKLFSDIRLRVTGKNLWLLYSDKKLNGQDPEFVNTGGVAQPIQKQVIFSLDVSF

SEQ ID NO: 11780 - protein, 784 aa, Verrucomicrobiae bacterium DG1235
MSVKYVFILLLCPFFLKAQEHVMLSGSVSDGTNPIPFATILVSGTTTGASANEDGNFQLQLQQEPVTLIVQAVGFKTQRQTVTPSAYKNSVLKITLQEDLLGLEEVVVSATRNRISKKEAPVIVKVLSPKLFKATQSISLADGLNYQPGVRVETNCQNCGFTQVRLNGLEGQYTQILVNSRPVFSALNGVYGLEQIPVSIIDRVEVVRSGGSALFGSNAIAGTVNIITKEPVNNSWEVNSNLALIDGKTADRSLNLNTSIVSEDLTTGVTLFGMYRDRNTYDANGDGFSEITKLTNHSFGTKAFYRPNDNSKIGLDLTAIKEYRRGGDRVDLAPQFTDITEELDHNTFFAGADYELYNDERTINFTAYASIQHTDRASYYGGLGGGRTAADSVAANNAFGNTKDLALVSGAKFSYTFANDDVLTSGLEYQLNDTEDAIPGYNRIVDQRVNSVGLYSQYEWKPIEAFTTLLGARLDHISVDGFYSIQDIERRSQVSETVLSPRITLLFDITEDLQFRGGYARGFRAPQAFNEDLHISSVGGEQRFAILSDDLESEFSNAYTASLNFTKDFNKTQTALLLEGFYTTLQNPFTLVSTGASLPNGAILDESRNGSGAYVAGTNIELTVSPSQDLYFQAGMTFQKSIYKEGQVLFESDGTVPGESDVIISEFTRSPNLYGFLNANWVMSEAFKLDLTASYTGSMIAPHIISDSGFMLLEKTPDFIDVTPKLTYHLDVKDTFHVELSTGVQNVFNSYQNDFDQGPLRDSDYIYGPNRPRTFFFGIRFGDF

SEQ ID NO: 11781 - protein, 1000 aa, Verrucomicrobiae bacterium DG1235
MKPVLGALLIGASVAILAAAATPTSATAAEPTIALNLPAGPMQKSLVALATQADVKILFEMDLVAGLTAPALQGQFTPRQAVERLLAGSGVAVDQVRPGVLVLRPARLGASAEAAAFPGGALGGEPAQADETLLSEVVVGSHIRGAQGASPIVTFDRNAIDQGGYATLADALTALPQAFGGSVSDDTGATGADTTGVNTARATAVNLRGLGADSTLVLVDGRRMAGAGLKGDFADVSSLPLVAVERVEVLLDGASALYGSDAVGGVVNIVMRKDYEGAETRLTAGGSTRGDLRQVSIAQTFGTRWASGHALISYEHQDREALAGRRRWYAGQTDLRPWGGTDQRRYYAKPGTVVSFDPVSGALAPAYAIPNSAPGTVLRASDFTAGQNLENWRAGYDVLPAQRRDSVFLAASQDLGAQVTVSGDLRYSDRRFHATGLASDSLIFVTPDNPWYASPTNAPSEIVAYSFLDELGGVRSRGSVRSLAASVGLEARLPHDWRLTTYVAHAEDLSHTRGDNVVNPTLLDEALGATPDDPATAFSAARDGYFNPFIGQGANSRTVLDFIRSGYETRRTLGETDSFSLQADGALATLPGGPLQAAVGVQFRRERLDTGGTSFVGGTAPRAGFSRKGERTVSAGFVELRVPLVGDANRRAGIERLELSAAGRIESYDDVGTSTVPKFGLVWKPIGDLTVRGTYGRAFRAPSLGELNDRFLITPVFLTRGADTVLSLLLFGGNPELKPETAKTWTAGFDWTPQALPGLKVSASTFETRFKDRIGQPANDNLGIVLTADEFAAFRRFVDPAGNASDLALVQGLIDDPASRAKGLFPAVAYGAIADARYVNTAALTVRGVDLSARYGLSLHGDPLDLDASLTWLTDFKRQTTAAARPVDLAGQTGSPADLRLRLTATWTHGPLAATGTVNRVGDLQAETGERVASWTTVDAQVRWTAAANSRLEGLTAALSVTNLFDRDPPFYNSPLGLGYDPANADPGGRRVSLQLTKAW

SEQ ID NO: 11782 - protein, 399 aa, Verrucomicrobiae bacterium DG1235
MGFGGEAFAQSGRWPLDWNSWETATGDWGGYRTKLNNMGIDPELNYTHDIMANPVGGERQSLAYAGALDASVDFDLETLLGLNGTSFSLGLYQGLGRDLSGEDINNFFDVAQIFIGDVFGISQMNFLQTLANDRIEIALGRLSAGTDFAFSEAFPLYVNTAVNGNPAQLLENVPSFTTPPFSQWGVRGTVKPEEFLYLSVAAYNADVNAQDNDTQGLNFKFNPEDGVLAIAEGGLLVGQESNGPYLPGRYMIGGYYDTSDYTSFVDPNDIIEGNWGLYFIANQMVYEEQEDQGLNIWGVFTLAPRQSINSFPYGVSGGAYYKGLFDSRDNDITAGAFYLGIYSEDLPGQTFELVFELNHRFQFNQWFYTTVDGQYVVNPNGQTNISDAWVVGLEMSVDF

SEQ ID NO: 11783 - protein, 254 aa, Verrucomicrobiae bacterium DG1235
MISLRTHAARSLLALGALAAATSAAAQSGAPDRAVVGIAAVYTPGYQGGDDYRLMPFPVIDVTYGRFFASGREGVGYTVLDGSAVKVSAGATFVPGYRRRDAPVGVGRLDGGAGLRVAADMRLGEVLVSMSATKVVSGDVDGALVDASLAYPVRLSERLSLMPSVSATWADSQYNRAYFGISAAQSAASKLPVYRPGGGVKDVSMSLSANYRLNDKVSLGATASLSRLTGDARKSPIVVEATQPSAVLSVAYRF

SEQ ID NO: 11784 - protein, 854 aa, Verrucomicrobiae bacterium DG1235
MVFVECGAALKLNQCIYIGIASTICLLITQKANAQEKPVNTKNIGLITNIPRLSDIERPPTSVKDWLSQSAPTPPKIKITGVRINRTDDNFEIILETPDGEISAPETLQEGNIFIADIPNAVLALPEGKEFREDTPVDGISYVTVTQQESNNTVRVTIASSGKLPPIQVVNQSNGLTIALTPTSPDIELIVTAQKRPEDAQDVPLSLTVIPQQEIEDAQIRSFQDIANNTPNFSFLPTTAGSADFSYYSVRGLNNFNFLANQDTVGFYIDDVPFDYGGFLDVGLIDLERVEVLRGPQSTLYGRSSPAGVVNVISRPPSNQPEMRISALYGSYNNRELQLSLSDAIIPDKLAFRLAGAYNARDGVFDNTFLNKPIGERSQLTGRAQILWTPTPEWNISFNAYASDNDNGNPTFSRQNAENPFQVSQEVDGFHRLSTNTQALKISYNGDGFRATSITTRRFSNQNTLVGDNFPGDLLQQIIGINSTLWSQEFRLQSPESADRLRWLLGGYYESRNFNVLDDTFKYSDAGAVFFGLPASGSDRVSAEQNRHTYAIFGQIDYKPIAPLTLFAGWRYETADAELDRRRVFVNPDGTANPPTAEVRNATLNSDAFIPRFGLQYRFNPNLMAYATIAKGYRPSGFNYRADTEDTRRFQEETTWTYEAGLKSSWLDDRLSANLSIFQSDVDNYQVLLTDDFGFFRNVTNANVKVTGLEFELKANPLQGLDLIAGIGYVDSKFKNYRNSFTNRDFSNNRVPFAPELTYNLAVQYRSPGGIFARAELRGYGITYFDDANQVKQDPYALVNARIGYEGEKYGIYLYANNLFDTRYITSGFLFPPPNVTAGFGDPVTYGVRVSASF

SEQ ID NO: 11785 - protein, 431 aa, Verrucomicrobiae bacterium DG1235
MKMNKTLLSTAVAVGLLSTSTVTQAAGFQLAEYSATGLGRAYAGEAAMADGADAQWRNPAMLTYLEGTQVSVGGIYVNPNIDVKGEVNHAHPAIGTSQASSDDFADDAIIPNLYISHRYNEKFAIGFAFGTNYGMETNLGDDFNASHFGNEASVITKEANLNFAYQIVEQVSIGGGIRYVMGEGSFGATTPAKNALGLPEGTTLKYMEGDDTAWGWQVGTAWQINESNRIGFAYKSEVELKLEGHAEGMGFGLNPGQRDNGHMMLALPATAELASFHQLTETLAVHASFNWTDWSSFEKLQAELNNYGSQTVKVENWEDNYRLALGATYQVDPKLALRTGVAYDTSAVSDKNRTITIPETDRTWLSIGAGYQWSEQLSLDAGFTYIIAKDAPITESRGYESDNVAEAVSGQFVGTTTGNVWLVGVQANYRF

SEQ ID NO: 11786 - protein, 255 aa, Verrucomicrobiae bacterium DG1235
MFAQFRSPRGWRLHSRGMFAGVSFMAFATVASAQEEGSAITLETVRVEGEREQATGPIEGYTAERSASGTKTDTALIETPQAISVVGREQMDAQQVQSVVEATRYTPGVRAGTFGADSRNDWFLVRGFSSQDSGYYLDGLQLFSSSFATWRIEPFGLERIEAVRGPSSVLYGGTNPGGLLNLVSKQPSARTLLHLEAGINEFGNGYGAVDAGGAIDHGEHWLYRVSALGRGGGTHVEHTNNDRLFVAPSVTWKPA

SEQ ID NO: 11787 - protein, 253 aa, Verrucomicrobiae bacterium DG1235
MKNKKYINSLLAACVLFSCFNSQAAELKRVYGKLSFGYGDWNKGFVNVDRGEVWKAVADFGAVFDRGEFASFYEMNVLNHPVEGRNHVTQFLGHYRVVEGSNFTAMMKLYMSMENKFGDELNMMYGVGYLGLTSPSGFIKPYFAVHNLSNDYTSKKYGQATGFNGYVLGWVAAYNFDMFNEKFVISNWNEVEMDRNDAYAEQQGGKTGLNGAVTFTWKFMPRWTASVSYRYFNNKLGYDGYGDRMNYLIGFEF

SEQ ID NO: 11788 - protein, 360 aa, Verrucomicrobiae bacterium DG1235
MKPVTLYDVAEYAGVSYQTVSRVVNQASHVSAKTREKVEAAMAELNYIPNRVAQQLAGKQSLLIGVATSSLALHAPSQIVAAIKSRADQLGASVVVSMVERSGVEACKAAVHNLLAQRVSGLIINYPLDDQDAIAVEAACTNVPALFLDVSDQTPINSIIFSHEDGTRLGVEHLVALGHQQIALLAGPLSSVSARLRLAGWHKYLTRNQIQPIAEREGDWSAMSGFQQTMQMLNEGIVPTAMLVANDQMALGAMRAITESGLRVGADISVVGYDDTEDSSCYIPPLTTIKQDFRLLGQTSVDRLLQLSQGQAVKGNQLLPVSLVKRKTTLAPNTQTASPRALADSLMQLARQVSRLESGQ

SEQ ID NO: 11789 - protein, 1071 aa, Verrucomicrobiae bacterium DG1235
MAIAASIMLWCATPQQAAADTYEKHEIASVQQQKVKTTGTVVDQNGEAMIGVSVKVKDNATMGAITDLEGKFSIDTPKGATLEISYIGYKTVTVKAEGTALNITMQEDAEVLDEVVIVGYGSQKKVNVTGAVSMVDSKVIESRPVSNVSQALQGVVPGLNLTVPTAGGALDAGMNISIRGAGTIGDGSSSSPLILIDGMEGDMNSINPNDIENISVLKDAAASSIYGSRAPFGVILITTKSGKAGRTSVNYSTNVRFKSPMSMPEMMDSWSFANYWNEAGINQNGNIKFTQDVMDKILAFQQGTLTGPDAAGISWQDGEWKKYAGAWANTDWFKEQYHSIVSNEHNISVNGGTDKVTYMVSAGYMGDKGLTRHGDDRLTHYNLSGKINATLSKYVKLMYNTKFIREDYDRPSYLTSNFYHNIARRWPTNPVKDANGYYLDHSEIIQMEEGGRDVTQKDQFYQQIQLVVEPLKDWLIHAEGNMKIVNNQNQWEVLPVYYHDGEGSPVAMAWFDGYTPGMSRVNQSYWKDNNYSLNLYTDYFKQIGDHYFKVMGGFNAELYKRTNLSGQRDELITPDVPTLNTGTTEQKANGGYSHWANAGFFGRINYNYKERYLLEINGRYDGSSRFIGDKRWGFFPSFSAGWNVSREPFWRDLEHIVNNFKIRGSWGELGNCNTTAFYPFYQTMPTGVENSGWLINGKKPNTASAPGIVSAEMTWETVRSWNIGFDFGLLNNRLTGSFDYFVRNTLDMIGPAPQLPATLGATVPKVNNADMKAWGFEVEVSWRDRIKDFNYGVKFVLSDDQRKVTRYPNEELNRNQWYAGRMDGLVWGYETVGIAKTDAEMEAHLASLPNGGQSQLGSKWAAGDIMYKDLNGDGKISSGDGTLNDLGDLKVVANTQLRFKYGLTLDASWKGFDFSAFFQGVGKRDVVVGGPYFWGANGQGMWQAAAFKDHMDYFRPEDTESVFGPNVDAYYPRVIFGGGSSEGGKNTLTQSRYVQNGAYIRLKNLQLGYTLPSTITKKFAVNSLRVYVSGDNLWTGTKMRVFDPEVLGSTGDAGKAYPLARVWSVGLNVNF

SEQ ID NO: 11790 - protein, 150 aa, Verrucomicrobiae bacterium DG1235
MKPFPAPLLPLACVALFGSAHAQTTPNVQTSPWSLAVGAVHLGFNTKADLYAGGPVPGAGVDASSDTIAGLEIAYSFNPNWTARLDLGTPVKTNLSGTGNLGALGRLGGVKGGPAILTLTYSPGMWGPIRPFFGGGMTYLKVFSTSNGAL

SEQ ID NO: 11791 - protein, 660 aa, Verrucomicrobiae bacterium DG1235
MMLRSRTCIVALCATSAVWCVGAAPVRAQSTVWDATISNTNWYVPTAQLLAYMSPKTGFTNPIPIGDQTLWTLGTATNGSFTGTSVAQLRIGPALLTDTSTIQGFVTTSGQITMLFTPTGGGTVTVGLGTMRLVNGVTSMEMQMITGDTLLVTHWAYMLPYDPATFTPPPSAPVPANSVPQWAWTAGTPWRIVSPALFGTQAPGRFVITNYQNGYFWGAGIAPAGSAAGGFTLLGSVTPEGRVLFNTLSRGSLTSLYGTASGSASGAQMIASMYDLAGNMTGDLATMSLVQPYGDTLRAAGGRVGLEAADALYRLSMTSAGCSGGMASGFAALDNLSGPSLGNAIKQTLPVLTGAASQATYVTQRDFRQTMTNRLDDMASMRIAAGQHVWMQPLGGTAQQSARDGVPGYNASGGGLAFGADAPLSPGAVIGGVAAYSRQTISGSDDAVPNRLTVSSYQLGLYGAYAVSPGLLLDYQLDGGTSDNGESRSLGFMSATAAGSYRSYAGHVGVGVKTRIALQDKLSLIPSLRLDYGAVRSNAYRENGADGFSLNVETQRYQELTATAGLKAVYAIAKQVRLSGEVGVGYNALNQRLQIGAAFSGGGDSFTTNGLALSPWIYSAGLGLIAARSDRLDLSIRYGVSATSSGLVEQSGHAVLKVRL

SEQ ID NO: 11792 - protein, 452 aa, Verrucomicrobiae bacterium DG1235
MTIVSPSRSGRSAALAGGLLAATALATVVSLPSGAHAAGFQIRENSSALLGTAFAGLASDPRDLSTAVNNPAGLTYIQRSGAEAALSLIVPSTKFKGTSSDAIGRPISGEAEGSKDPLPLPAAFLVYAPEGQDWRLALSATAPYGLETDYDDDWTGRYHAVKSTLETANVNLAGAYRLMPQLSVGGGISVQRAEAELTNAVDFGAILANLRVPGFLPQSADGMAKVQGDDWGWGWNLGLLFEPVPGTRFGLSYHSKIDHTLEGTGKFTVPTSVRTVFTAVGVQAFQPESDATADVTTPQSIDFSVSQDLGRLGLHATASWTDWSEFKEIRVVFANPAQPVSVDEQFYNDTWFFAVGATYAYRDDLTLRVGAAHDGRAAQGEYRTPRIPDEERTWLTAGLSWQPLESLTVDAGYAHLFVADATVNQTTGTGNRLTGHFESNVDIISVAARYRF

SEQ ID NO: 11793 - protein, 441 aa, Verrucomicrobiae bacterium DG1235
MFKTSLKISPLFIAIAATIPTLGQAAEETKAEGFVEGSSLKLNARNYYMNRNRLQQNKDNIEWGQGFLGVFESGYTQGTVGFGLDANAMLGLKLDGGGGTTKSSILPISDDGRHKAPGSFSTAGATLKMRAFDTELKAGDLFLNNPVIAGGMSRMLPQTFRGVSLTNHSFDGWLIEGGQASFTKPYNQSGHKRIGTSYGSLREGDESLHLNWAGVAWSGVPGLTSSLYASELKDIWNQYYYDLDYTYAVNELVSLNPGLHFYHTQDTGQALLGNIDNNTYSLHFTVGVGNHSVTAAYQRVNGNTPFDYIAQGDSIYLDNSQQYSDFNGPNERSWKLKYAYDFAGLGLPGLTSAISYSRGELDLTKVDPASRGYASWYSADGKNAKHWERDLDLKYVVQGGSAKDLAVRLQWATNRGGNGYGALDNDTDEYRVIVDYPINVF

SEQ ID NO: 11794 - protein, 775 aa, Verrucomicrobiae bacterium DG1235
MEGTSNAHEGDWVYDELHSVSEISREQLDSRPARHAADILEQTSGVYSSVSQQDPALSVNIRGMQDYGRVNMNIDGMRQNFMKSGHGQRNGVMYIDPEILNNVVIEKGVTSGIGGAGVIGGIATFNTINASNFLEPGKEIGGQIRVLTGDNGTNFIGSAALALGNEYGDILIAASERNLSDYWPGNKGNMGDIRFGTAAERFNYDLKNNKVEYTRYKMRSQLTKLGWNLPANQRLMLSYLQTQINSPNASMLTQIVDKADPYRIIKMGWKNSSVSDVLNRNIGLDYSLKPEHIAWLDVAVKVYYVDTDDETNTLCSDAIYCKKFWTQTRLTTRGLQLQNTSFFTYADHHQFHINYGLEWFSDRSRGNSTHETILGLTPPGKRTITSTFAQLNYDYDNWLRLEGGLRYDQFRLQGNTWMHSKNFRGNYTRENPCNQKTHEQYIINEGRRCSFNWPSKMTWEVDRREQQLSPTLAIGIKPGVQWLEFFGNYGKSWRPPAITEVLATGSAHGHSWTLPNPILAAEHSKAWEAGMNIQHSNLFIAEDRLVAKLAYFDTRVTDYINLELSKTKPLHGSGDFTNATYINNLLATHFRGLEYQLSYDAGVFYTNLNYTRMIGVNTICSKRAWLGGVNGIASNKNYEIYSIDRDDINNIVDCFAANNLFSSSAYLPGDRGSLTLGGRIFDKKLDLGTVIRYNKGRQDKSVLNNKGHVNTAYVADWPKYTIFDLYASYKMTNNLTLRSSIENITNRAYLISYGDSLSFAPNRGRTIQGGFEYKF

SEQ ID NO: 11795 - protein, 696 aa, Verrucomicrobiae bacterium DG1235
MFATTRMALLIGGAIGGATFPLSAQETTKNDTVIVTSTVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPQGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALIYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11796 - protein, 653 aa, Verrucomicrobiae bacterium DG1235
MKTSVKKPMFMPSVLTGALLTAFSGSALANDKDEVVEMERMVVTASLTQHSELTAPASVSVITADDISKMPVKDISEAIRSATGVSVLSSTAYGRNNIRIRGLDSKHTLVLINGRRINSQDALIRGNDFDLSSIPLSAIQRIEVVRGPVSSLYGSEAMGGVVNVILKAPTEELSGSVGLQYESILEGDGGDGLKGHAYASGSLSDNVEGSIIVESSARDPWRTDTNPDFDALEEKDTTNVFGELAWQLTEEQRLIADVIYTNDEREADWVHPRSGSQTNTQDSTRWNYGLTHEGAWDTVDSQVRLYGENMQLDDASTAYKNGAADVELQNNTLDFKLSGLWRDSHEWVFGGEYRTSELKNSRDVPSGDIDNYQGAVFVQGEFDLNKLAVTLGGRQDFHEVYGSHFSPRAYAVYSFTDEFVLKGGFGGGFRAPGMMESSDQVRVISCGNRCWLTGNEDLKPEESESYEAGLAYETTAMGVGLMYYHTDLKNKIERDLTKPVGSVGKMPIITYQNIGKAETKGIELEGWYDITDSINLKGNYTYTDAKDKSSGDKLTKTPEHLANLDVNWEVFDSFTTFARVNYIGKQVITNQSRENKTVDGYTLVGLGVGYDFQQFNLKAGLNNIFDVELDDEDDYYGYSEKGRSAYVSATYLF

SEQ ID NO: 11797 - protein, 417 aa, Verrucomicrobiae bacterium DG1235
MSRFLFRGATCGLLCGWLPVAGAAGFIEDSKLKLQLRNVYFNENFRDEQGMSARAAATAKSERVEWAQGFLLDYQSGFTQGTLGLGVDAMGLLGVRLDSGRVRSGTGLLPVHDDGRAADEFASAGITAKARLGSTVVKHGTLLPKTPVLVYNDARLLPQTYQGTQLTSTDIDNLTLTAGHLDRFKQRDSSNSTGLYLDGYGGPASGDFSFAGADYAVSKQLRLSYFHGELEHFYRQDFAGLVHDLPLGGGVLTTDLRYFKSRDSGTAYGGGIDNDMFSGQLSYAHSGHTVGAGYQVLDGEAGLPYISGATVYSFSNVGIGKFIEEEEKTWMASYAYNFAAAGVPGLTFMTRYLSGDNGRSGGEGIKEWERDAEIAYVVQGGPLKGLGVKLRNYVYRSDFARGRDSNRLYLTYDIAIW

SEQ ID NO: 11798 - protein, 636 aa, Verrucomicrobiae bacterium DG1235
MSLTTKRPRRMHRAAMGALAGALTGVAVGPVWAQSDTQAAAVPVGELNPTVVTASRSEQKLADALPHTTVITRADIERSQAPDAVSLLRREAGIEIAQAGGPGATASLFMRGAGSNQTLVLIDGVRVSSGTAGTTQIEQLMADQIDHIEIVRGNVSALYGSDAIGGVVQIFTRNGRGHAPLANAQIEYGARNTKRAQAGISGELDARGDTSFALSVSEFRTTGFSSINPQQAPNANPNDNAYTNKSVSAQLQHRFSADWQAGLTWFQTWSNVSYDNAFGSPTDDNYSHNQVRAMSIYVDGKLTPDWKTRLTLSQGDDRNLNFTNGQVQVPGRFNTQNQQASWQHDWTFLPDQMLKVGFEHLQQTIDTDAYAPPTRRVESGYVGYEGKFGPHQLQLNLRRDRYSDFGGATSYYAGYGFAFTPQWRAVASLSNAFRAPSFNELYYPFFGNPNLQPEKARSVEGGVEYQSTIGLVRVTAFETDYSNLITSVFDPVSGNFLAANVNRARVNGLETSWRGTLYGVDVRASFTMQNPQDLSANQLLLRHARHFGSVSAYKSFGPFSAGIEWNAAGERQDSARTLGGYGLLNLTGRYQITRDWALSARVENLLNKNYQLIAPYNTASRGVFFTLSWQQHAPQR

SEQ ID NO: 11799 - protein, 636 aa, Verrucomicrobiae bacterium DG1235
MKNTIILFLFILPLFAAFPPQSALPEDNISQQSILQNQFMEELKWLQEESVVSTASRREQKVSETPAAVFVISQEDIRRSGANSIPEVLRMAPGVHVARIDANKWAITMRGFNNRYADKLLVLIDGRTVYTPLFSGTYWDVQDTMLEDIERIEVIRGPGGALWGANAVNGIINIITKSAKDTQGGLFTGSAGSEERGMGGLRYGSKIGGNAYFRIYSKYFNHDDFVLESGDSANDSWESARAGFRVDWDYSSKDVLTFQGDIYTGDESERNNFRQSSDIYVSGGNLRANWKHAISDTSDMMLQIYYDRTNRITTSIEEERDTFDIDFQHSLRLTGWNEFIWGLGYRYTQNDTEDDDGLLLDPQNRENNLFSMFLQDEFSFFEDTVKVTFGTKFEHNDYTGFEIQPSLRVLWAFTYTQTVWAAVSRAVRTPSRVESDIIIDYSPYYYFTGNDDLDAENLLAYEIGYRIQFSKKLSLDIATFYNMYDSIINDVNDETFENIFDVESYGIETTLNWQITNQWRLVQSYTYFDIDSTNFTSTDPLSDPHSQFNIRSLLNLPHNMELDAALFYVDSFTSLDRNINDYVRFDVRLGWHITKYLEASLVGTNLLDDNHLEYNARSVAPTEIERAVYAKLTWRF

SEQ ID NO: 11800 - protein, 459 aa, Verrucomicrobiae bacterium DG1235
MKSKLVLASGFCMALFWSGSAHATEGFNFIGYGPTSIAMGGTGAAYDIGPAGMMINPATLALMPDGCDGQIGGDIITSNLKIRNTATGEVAHSNSEGTNNGPYYAPEVAFVCRKGRYTLGIGSFAAAGVGTQYAADSFLSRTVTNTTDTGLRNFSRMLTLRIPVSAAYQVTDRLAVGGSLDVVWTSMNVGLLLDTSQIGTLAAQQRLSGSLVPTLLGIPQLSGGYLNFTNHSIVGGAAEGWGIGGKLGATYQVSRRTRLGIVYSFKTSVSDLTGHSTLTAVSAVAGNIPLSGKVRVRDFQGPAQFTAGVFHEFSDRLSVAVDYRRVFWGSAMKNVSVGFKDDASGADINLSFPTNYRDTNVVGVGVQYRLTPRFAVRGGFHYADEPTPGHGVLAIIPSTPTTDITGGGSWALGKNSALDFALTYAFPKSVSNDGPPNTAAPIEATHSQIAASIAFRKHF

SEQ ID NO: 11801 - protein, 322 aa, Verrucomicrobiae bacterium DG1235
MNFRTAFALTLGAVALLPLAAHAQSSFNLSGRVDLGLRHDSAIDAATGSKIGTRMASGTNSNIALTGTEDLGGGMAAFFNVEHRFNASNGAVSDPASFWNEISVVGLRGSMGSVQLGRQDGPIFYGLSPDAFYGDYVGGRGERKAGADDKFNNGVLYMSPTVNGLQLILGATVDKGAPIGGLQPDRARAGALRYSNGAFTASTALAKRFNGDTAYGVGSTYNFGVATLLFVAGRNDGEGIVGLSDGKRTTLDIGTIVPVSAQGSVRAKYNTDKRGASTTRNLGLGYLHDLSKRTNLYVTGSQTKVTGASATEAMDMGIVHRF

SEQ ID NO: 11802 - protein, 703 aa, Verrucomicrobiae bacterium DG1235
MKTNTKGLKLTYLSTCLVGLFSSHVMAAEQNQQSKSVKDDAIEKVTVVASRQAYQGNFSPLETPQSELKIDLEALENAGAVSLDQALDLSASVARQNNFGGLWNSFSLRGFVGDENLPSNYLVNGFNAGRGFGGSRDLSGIESVEVLKGPRAALFGRGEPGGTVNLVTKRPTFDTQGEIKVSIDSFDTYRADVDYTTALNDDVAIRLVGFYEDAESFRDTIETTKQGFSPSIVWNINNNSQLIYELEYTDQEVPFDRGVLAIDGELGLIPESRFLGEPGDGPIEADVLGHQLEYIHDFDDNWSILFGANYRDTSLEGFATETGFGGVVNGEVNRFRRYRDYDSTYQVLRAEVSGNVNVAGFENRLIIGIDTDKFENDQFALRVRGDQYINVFNPVYGAYALPTPTSNTDRVEIQESVGVFIQDQISLTDKLDIRIGARFDDYEQRLNNRLANTKTKQTQSRVSPQFGVVYEASDYVSVYGAYGENFRPLSGADANGDGFEPNQSTSTEVGVNFTLNDGALFGTVAVFKVEQDNMLVVDDATAFTYAAIGEAQSKGIEIDLTGELTDTLEIWASYAYVDATIENSFFDANFGYTVEAGASLLNVPEQQLSLQLVQSAVLYGKAVKFGGGLLHVGKRNGFFGTDFELPSYTTARVFVNYDVTDKIGIAAEVNNLFDETYYTNSFADAWVQPGTPRNVKFSAAYRF

SEQ ID NO: 11803 - protein, 257 aa, Verrucomicrobiae bacterium DG1235
MAFCAGLLAPFSAQAADEELLDAPEITISPEATGGGRLYLRGDIGYAAWLDEGDPFYRSFGGTGEVSFDNARFDKPPSATIGLGYQFTDVIRADLTAEYFEGRFDGSSLSASPCAGEGAGTRCALSHSANFSALGLMANGYLDLATLAGFTPYLGAGIGATRIDWKTTHETSTCVGAGGACSGAAGGASYGGRDSWRFTYALMAGVSYDVTDRLKFDAGYRYSQIADGDMFGSGGAKGHDDGLSRHEFRVGLRFALW

SEQ ID NO: 11804 - protein, 689 aa, Verrucomicrobiae bacterium DG1235
MISVESTAGGPAQPDVLGRSMDAISLIGPTPGFRSDRAVSATKTDTRQLDVPQVVTVVPRELITDINATRVDRAFDYVPGLTQTNNFGGLGTFAYAIRGVTTAEIFRNGLAANRGGPPPLIDTQNIERIEVLKGAGGALFGRSDPGGLVNIVTKQPTTIRFVEMGGLWGSFEQFRGTIDSGGALNDEKTLLYRFNFAGGSQNSYRDFVGDDRLFIAPVLSWQITPDTKLTVEAAITRNNVVVDRGVVAVNKQLGFVPISRFLGEPGQVSRQSDAVLQVRLDHRFDADWQMRLATQFNTGTLNGESAEGRGLLSDNRTVIRDRNFRDYSYDSVIGQAELVGRFRTGEVGHTLLLGFDCEDFDNRQLYLRSNFNTFPYAIDIYNPRYGQPLPPLTRASNTLESVTDTGFYAQDLIGLAPQWKALAGVRFDLFERSFKQRIGGNSAEQTRAAASPRAGLVYQPIPGLALYANVSTSFRPNIGTDAGLGAGSRAFEPETGLGYEGGAKVELYGGALLLTGAAFRIDRENVLTADPSNSGFQITAGGVRSQGFEFTAAGQLTPELRIIGGYTFTDAFITKDNVLPVGAPLLNIPEHSGTMLAVYEVQSGPLRGLGIGGGVRAAGERAGDSSNSGFKLPTYVVADALGYYEYESFRFGLNVENVFDTTYYVGSVSQFRVDTGSPRRITGSLLVRF

SEQ ID NO: 11805 - protein, 726 aa, Verrucomicrobiae bacterium DG1235
MNYHKYCIATMAAPLAMYAAPSFAQGQAVEPPQEQATSDTQVEEIIVTAQRRGENLQNVPIAITALSASRLQATGVLTAQDLSTVTPSLQMPAQAGYLLPRLRGIGTSVIGPGIENTVALYVDGVYQASSPASIFSLTGIERIEVLKGPQGTLFGRNATGGLIQIVTREPEPGFSGNGAISYGNYDTVSADAYIAGGSDTVRVSLAGRYAHQGDGFGYNFARGEDANTVRDDLALRGKMVFLPADGTKVTFSADYARTRGSYPEARMFPGAPARNDPNPPSGPFDTNNNTQSIKSLDAGGASLRVDQDVGAIGLTSISAYRRSTFHSVVDLDRTPANLVFIDNTQQDRQFSQELQLHSTRGSTIDWLVGGYYFWSKSGFEPSILTNYPPTAPAPRTVTVDGNQSTESLAAFGQLTVPLTDQLRATAGLRYTTEKRSIDTGSIVALISGPTLATAAQDDSRRYNKLTWRAALDYQPTPDVLLYLSYNRGFKSGGFNVTTPGAAPYEPEVLDAFEFGAKLDLFDRRLRINSAVFYYDYSNIQVAYFIGASGGTLGIRNGSSATVYGADVDLSLILAPGLTLQGGASLIHDRFGDFPNAVINTPLPGGGNASGVFQAKGNRLPFTSDFSGNIGLDYARELSSGKLTANVTLYYNDGYYPEADNIRRVDGYAKLNASLGWRFGESGVGVRIWGRNLTNKAIPTFIGSVAAGTGITYEPPRTYGASLTVDF

SEQ ID NO: 11806 - protein, 461 aa, Gamma proteobacterium HTCC5015
MCAATGAMAQTSLNPSVRVATPLNQVNFGATSVPPLPQPEALWPDPFGWNTWLRDRGVAFLLDNVNEFAGNVGSVTPGYGLRKGSSNAGQYAFENDTDWERLAGLTGFSTHAIVVGRYGIPASRMFGDNVAPSQEIYGAGGNVVVHFVYGYGEETLWQGRFDVAAGRIPFLNDFSSNPLYCNFMNNAFCGNPKASSDNTAHSSYPDSNWAVRFRVRPTTDTYFQTGVYFDQAGIYGNTQYRTGFKLNGADINGESMPIEFGWEPVFGHGTLPGHYKIGYARDTVDHQDVYYDGYGDAWALTGLPRRRDHGANAAWFLADQMLYHFKGGAKDAGVTFLGGFYYNDEDISMRSQQYQAGFLARGFWKARPLDGAGINFAYIRESALAAKTQELQLQQGILPGNLLNGAYGPQSYGMNLEVDYQIHVYRGMTIAPDFQYYFNPGGQRVLRDTAVLGFKTHIELF

SEQ ID NO: 11807 - protein, 1081 aa, Gamma proteobacterium HTCC5015
MKQVEQQTRYTFVYRNHVLNDQTKVTISCTKKPISEALSQVFTPLNISYSFTNNTIVLVKQETEQRSNEKRAIKGTVLDESGIPIIGANVMQGKGTGVITDINGNFTIVADPNQPLTVSYIGFDSQQVKAGNKNNLKIYLKESSIALNEIVVVGYGSQSEKLVTTSISSLKVDDLDQGSDYNVAKMLQGRTPGVNVASASGTPGEQPSVRVRGIASITGNSTPLYVVDGVPSESMPMLNPNDIERMDVLKDASAAAIYGSRANNGVVIITTKSGNTNSKTRVNASVRHSLGWIANDIPMANVAEYTRTMQAAVDNWNVQKKDTKSFFIPDRITETDWLGLIQRDIAHSTMASINLSGGNEKTTFFTSVGFNDQQGIIRTSGFQQTNLRAKFTHQLNKWFKLNLNLTGSYSRFDKVEESSTSLKVIRTAREEQPWIGAYREDGGYTVMSTELCRHNPVMLINEEDWTVHKKQGVAALSFDITPIKGLKYTPSFSIYGILDEEKKTISEKHDARSKNAGWGALSEQKNVSYRYVIDNVISYENSWDKLTYSAMLGHSYEEYNYETFGAYSDNYANGAYPSSSFGLINSGSNIYAGSIGYNAYALESYFGRAALNWDNRYILNVTMRRDGSSRFSKDKRYGTFPSASFAWRIINEPFFPKGTPLNDLKLRASWGKTGSMDGISNWAAMSLVTSGGNSYNGSSGFKIGADAADLIWEKANQVNVGINAELFNGRLALSVDGYYQKTSGLLYNISTLATTGYTTRTANIGSLENKGLEVMVSGKIFDGPFKWELATNLSYTKNKLLSLDGVLDMKINGGGANTGKVMHALMVGKPVSAFYMLRQDGIYQTDQEVPSKLYAKGVRAGDCKYFDYNNDGDITDDDRMYVGKVTPDIYGGITSTMNWKNFDLSIFCQFAAGGKILSAWKGCGGTEGTEHLGLASSSIKGYKNGTLVDSEQFYNISKYAANHYWRGEGTSNTVPRPTLAGTFTGGFGNNLVSTRYLEDASYFKFKTITLGYSLPHSLLSKIHVTGARIFVSLDNFFTLTKYSGYDPEFSYESNPTGNSYGADFGEQATLKSFIIGASINF

SEQ ID NO: 11808 - protein, 407 aa, Gamma proteobacterium HTCC5015
MKPTHRLTLLSSALLLAFQANAAGTLIQEMSKMTVSTAGAGSAVLAENASVAYSNPAGMSYIEGDALSVNAGVMDLGINYDDANDPQNSSDNAGGLQPYGSLYYVHQLNNDIHLGMSVSAQGGSALDYGTSYAGALSLNDLRLSVIQLNPSMSYQVNDKLSIGGGLQIDYASFDETLLYGQGNIETDSWTLGYNLGVMYQIDNHNRLGIAYRSRMNHDLTGEMSTESMIVHRPSHPKVPLPIPAMSGQAGLNVLNPRQLEVSGLHQLSQPLSVVWSLGFEQWSDNESTTVSINDGNHIQQIERNFDDVWTGSVGARYQLTLKLRLESGIGYATSPLDDPKSQGADLPVDTQHRYSIGATYQWTKDTSFNTYYSYVDYGDPEINNSGMMGQFDNSNQFIGITMNMAFK

SEQ ID NO: 11809 - protein, 226 aa, Gamma proteobacterium HTCC5015
MAARSSRLAAVFGVLGIGLLGISTPSQAAEPAMNTVSEGGLTAGSLLVRGRVIGSIPVGQFSRVEPIGGRVITPARALPDLDVTYFLSDHFALAGQLGVVSTKTSIRGSLIGDLTIGSTWSFSMTGAVQYHFLPHGPFNPYIGAGAGYTHPIAYEPAKPLITEMKADPQLGPMLQAGFDYHLGGNWYANMEIKKIFLPPQVSRIGSGTTTVRLDMLIIGAGIGYRF

SEQ ID NO: 11810 - protein, 437 aa, Gamma proteobacterium HTCC5015
MKRLTATTVRGLITGAGLGGLLIPGLALATNGYQLTGLGSHEKSLGGAVTAAPRSAMTAISNPAGIGRIGSRVDFSMEVFSPERSTDFRALGGEKVTSDTDTYIIPSLGWAAPITEDRRLWFGGGFFGTSGLGVDYAVTDVMPNGQLMNGHTQWDGYSSIFFAQMTPVLSLRVNDRLTVGAGPVLARQQVALKQRFHDMPVGPGMVMDTNFDLSKASSALGAGVSLGLIYDLGTRWRLGATYQSKIHFEDLRYNLAAGDIHGQDSNGEFVDGEAGTWRLGLDYPQQASVGLAWAANNTLTLSADVKWLNWSDTMDELTVKGPNGSRFALDPGWDDQWVFAAGAEWVVNPERLTLRAGVNYAESPLDDEDVATNLLLPAVVERHVALGGTVRMVNGWDLGFHLKHALKNKQTQDGGPFDGVSVEMDQWSAGLNIGYAF

SEQ ID NO: 11811 - protein, 2365 aa, Gamma proteobacterium HTCC5015
MTIARSKKAGEPFPRLLLPTGVFLALSGAGIVPAHATCSTAGTTVTCSGVANPLAPSYSNSANNVNATVNPGASVGVLLGVGGTAMSLTGNNVTLTNNGTIDPSALGSGLGVLSSGTVVGNAAASTTTVTNNGTMMGSTGVAISGVTGMALSVQNGAGGTSTITNTGTIGSSPLVGATLTGADAPVVAAYGGGTVNMSNSGTITGRVSLGSSGTPGQGNTFTNSGTINGGVSMGVNSTNTFNAVTGSSVNTAGGTGGAFNITVGPITLGVAATGVVDGGAGGNNTLNLQQGTAANGTIAANNYINFNHLDVTSGNWTINGASTAQDATLSGGVAVINDNASLGTGTVTGNGGALQAGTTGLNVSNNVSLGAGGLTVQGATGLTLSGTVSGGGALTKNDGGTLTLSGANSYTGATNLNAGGLVVGNNSALGIGALNVNASASLDASTNVTLGNTVNLATGSTLTLGGSNALGLTGTISGSGGLTKNGAATTTLSGVNTYTGDTTINSGTLALNGAGSLSATGTVNLTGAGATFDVTGASGARTIGSLAGAAGTNVTLGANSLTLNGSGNATYAGTIGGSGSVTLSGTGTQSLTGTNVYTGGTNLNGGNLVVGSNTSLGIGAVNVNGSSTLDATTNVTLANGVNLATGTTLTLGGSTDLGLGGVVSGGGGLVKNGAATLTLSGANNYAGGTTLNAGGLVLGNGSALGTGALTVGGSATLDTNTNLTVGNAINLTTGNTLTLGGSNALGLSGAISGTGSLVKNGAATTTLTGANTYTGGTTINAGTLAIGAGGSLSSTGTVNLVNPGAALDISAGSAQSIGALSGAIGTSVSLGANALTLGGTASGTFSGTIGGTGSLTLAGTGTQTLNGANTYTGGTNLNSGSLVLGNNGALGFGALNVGGAATLDTNATLSVGNAINLGTGAALTLGGSNNLPLGGAISGAGSLVKDGAATTTLTGVNTYTGGTTVNGGTLAIGAGGSLASTGTMNLAGAGAMLDLSAATGGQTLGALSGVTGTNLNLGGNALTLGGTASGTFSGAIGGTGSLTLAGTGTQTLNGASTYSGGTNLNSGGLVLGNNGALGFGALNVGGAATLDTNATLSVGNAVNLGTGAALTLGGSNSLTLGGAISGAGSLVKDGAATTTLTGANTYTGGTTINAGTLAVSAGGSLASTGAMNLAGAGATLDLSAATGAQTLGALSGVAGTSLNLGGNALTLGGTASGTFGGVIGGTGGLTLSGTGTQTLSGANTYTGGTTINSGSTLALGAGGSLASTGTVNLTGSGATFNLSGASGAQTIGALTGAAGTNVNLGGNGLTLSSAGNYAFGGAIGGTGGLTLAGAGTQTLTGANTYTGGTTIGGGSTLALGAGGSLAATGAVNLAAAGATFDVSGASGAQTIGALTGAAGTNVALGANALTLNGSGNNTFGGAIGGTGAVTFAGTGTQTLTGANTYTGGTTIGGGSTLALGAGGSLASTGAVNLAGAAATFDVSGATGAQTVGALTGAAGTNVNLGANALTLNGSGNGTFGGTIGGTAGVTVAGTGTQTLTGANTYTGGTTINGGSTLALGAGGSLASGSAVNLAGTGATFDVSGSTGTQTIGALSGAAGTNVNLGANALTLNGSGNTTFGGTIGGTGGVTLAGTGTQTLTGANTYTGGTTINGGSTLALGAGGSLASTGAVNLAGTGATFDVSGATGTQTVGALSGAAGTNVNLGANALALNGSGSSTFGGTIGGAGGVTVASGTQVLTGDNTYTGGTTIAAGGTLQLGNGGTSGSVAGNVVDNGALIVNQSGNVTIASVLSGTGSLTQAGSGRLTLTGTSTLSGPTTVGAGTLAVNGSLGQSTVTVQNGATLTGTGTIGGLVVQGGATAAATQPGAALNVGGNVTFQPGSTFQVAATPQQSGSLAASGTATLNGGTVQVLANQSGYQPSTTYTILSASSGVQGAFTQVSANYAFLTPTLSYDPGHVYLRLVQNGTSLPDVATTPNQRSVATAVAALGAGNPLYDTVLTTDAPTARRAYGLLGGELQASLKSMLLIDSRYVRDAVTDRVRQGLAPGSGPLAALSSGGAALCGDNTAGVVDPTLPPERRIGSRDGCYGGTPYQPVVWGQAFGGRSRLAGDGNASSINRSMTGFIAGADMALNDKWRAGLAAGVTHSSLDNDQSSSAAVNSYYLSLYGGAQYGALGVRGGASYTWYRINSDRYPGFAGFSDHDSAGYNANSAQVFGEVGYALPVGPVAIEPFAGLAYVNLHTDGYTESGGAAALRAGGETTHVGFSTLGLRAASQLGSIASGTFTARGTVGWRHAFGNVRPSSAFTFANGGTSFQVSGVPIARDSAVLEAGIDANITKRLTLGLTYSGQYGSGVRDNAILGNILWKF

SEQ ID NO: 11812 - protein, 788 aa, Gamma proteobacterium HTCC5015
MNFLEPPRRRSYAFLRRNIGWLFPCFCLGAISTAAFSETASFPQENMESERSDDSMSGRHHRHHHEDRDHHADSYHDEHPHGHHHGHQDRGSEDELSIRDLIVEADRPKATTDGSNSYAVKGVTIGKRIQRLEDIPQSVSVMTKQQMLDQNLNTVNEALNQVPGVTVNNYGDGTSGFMSRGYSMNTQFDSIPSFGGTSFAQQFDLSIYDRMEILRGPDGIFQGGGSPGGVINMVHKRPLNKFHVETGGSVGSWNNLHGYFDVTGPLNKAGTINGRIVMAGTSQDYYYKPGHDQRWTGYGAIDFHFDDKTTLTLTAAGQKNKTTRFMGLPRASNGSDLNLPVSSYVGASWNKSQSPMYELSADFERHLGKGWQVRLAGRHRYTNSSQEYSLLSKLDPQTMKGSFNLTKAIDKERYDDVDLYVTGPVHLFNRKHIFLVGANYSYNLERDGSGSATYSKNPQLTNQDIFNPVLPQNLLSGDLTSYYREPSVQKGLYASAQIEVIKPVQILLGGRLSSYTYKLKNLIAGTPTKIQQHVGNHLTPYAGVVWHMTPNLTSYFSYTDIFSPQGGYTEAGTRIKPLQGQQMEAGIKGSWFRGKLHASFAAYRIMQHNLARATEDGRMDCGPSQSSTCYEAAGLVRSQGFDTEIIGQPMKGLDINFGYTYNDNRLMKAIGSTLPVGSRYTSNTPAHLFKLWTHYRFALGKSSDKNILSFGGGLNAQSSTFGNARTVTQPGYIIGSAQIGYQLSPKFEISVTVNNLSDTRYYSRLGNVNYYNYYGTPRSFMFSVHNSF

SEQ ID NO: 11813 - protein, 429 aa, Gamma proteobacterium HTCC5015
MNKFTKTALASIFTFSAAGASAAAFQLAEVSTSGLGMAYAGNAAVADNASVVATNPALMTKFKQVEVSVGGVYVDADVNVEGSFGTKTTVNGNVIASSPVSDANAKDIIPSAIVPNLYVVAPVSERFAVGGGVNVNYGLKSEFPTNYSAGVFAGKTELTAVNYNLSGAYDLGYGFSFGVGLNAVHAKATLERHFGALNPMAPTATASRLKGDKWGFGWNVGLAYDINENNRLGVAYHSPVDLRFKGKYVGTQSTNVEIPGRLNLELPAYWEISGYHKLTEKLAVQYSYKKTHWNSFQELRAIDNNGKVLLQKDEKFNNNSRIALGVSYDVIEALTLRAGIAYDESASVAHPSISIPDTDRTWYTLGATYRFTPSLSVDLAYAHLRGSKNEFTESQAVTRLPNGTVINAEGTFKVKSTANLYGLNVNYKF

SEQ ID NO: 11814 - protein, 953 aa, Gamma proteobacterium HTCC5015
MKKTDVARTVLASALAVALTACGGGGGGGGIRPSTPTAPPPTSPPPPPPPTSPPPPTTAPTPPPPTTVPTPQPAFDAHLALTNTRTAQALGFTGAGYRIGVVDSGINGNHPALQGRLSDSFIYVDPRDNNIAVGDVVGHGTVVAELAAGGAVGQWPGGIAPGATLVSARIIADKAPTDDGSGQGNEIDGPLGLEAVHADLIRAGTRIMNNSWGGLYWTDPNVTNPVAQEYRAFVIDNDGLVVFASGNESRTEPSDTAALPSQLGPNGTRPAADLERGWLVVGAVDTANPTQLASYSNACGVTMRYCLVAPGTSVYVGPDSTAGNLSYFYGSGTSFAVPLVSGAAALVWQAYPYFNNDLVRQTLLGTATDLGAAGVDPTFGYGLLNVGKAVLGPARFDWGTVDVTVNTLRSTWANDISGNGGLTKRGSGTLVLSSTANTFAGDIQVLGGTLQTASLQSARVGVASGASLIGSGRIAGTLNNAGTVQVNGATLAVAGNYIQDSTGRLALNVGDRLNVTGTASIAGELQLLGRRDYVVDNATYTLLQAAGGLQGTFGTVTRGPAVTFLDASVTYDSNNAYLALRGLTATAVASTLGLSGTTAMDSAVRVEQAFQQVDVQLLQGSGAISSGFVQAAAALQQSPTGETAADSLRSLSGRAHAESAAMTFDTIDLSRRALATHFDGVSQQPRLLGVWQRALGGPGEGGATSNGFATSGWMMGNDLRMASGAVAGFAFGETRSNSLGDLDGARGRDRQVHAQLYWGTTRGPGYALGQMGFGNVRRQIERSLQFGLDRSAAFSDYSGSYLSGNLETGYRFGDVAASLTPYLGVDYVRLASEGFREQGGEGFGLRAAASTSARTQLLAGLRSAYRWRGLQLGGYAEWQQALSSEGLSLDASFIGVDAWAPLRGMQPARSGGLLGVAASAPLGERGALRFGYDQRVGERGDDRALSLRYSADF

SEQ ID NO: 11815 - protein, 1065 aa, Gamma proteobacterium HTCC5015
MIFLPTTRRSIVAILFFFLLPATPILAADELLIYVFSGDNPAVGSEIQLDQNRVGKTSEDGSLLVDVPGQGTHVITVRADQGDITARFASGAGQLVDAVVQVETGETFLDVYAQTESVLERKSSAKGSLNIRVMQGDSVASNESIYIAGLGASLKTNSAGEASITLPRGRYRTQVAEKTANLRIVGGLTRSVVLEIDESAMMMQVAAPTLEEVIVIASFDPAGLELSERDTTNIVDTIGVEMLARFADSDVAASVVRVPGVSVQDDKYVFIRGLGGRYVSATLNNATMPSTNPSKRTVPLDLFPSNFVNQLDVKKTFLTHMPGESTGGNLAINTKTFPDERILGMSIQGGYTTDLTGETVFVDALQGDFDQLGWDDGARSPDPALAAISDMLNSGEATDTNTGQVFTLDDATAGELRRAGALLMKDGFDPSFESAAPDGKMGLNFGDLFLFDNSELGVYAAMNYSNDWSKRDDGERYTYESQGEVADNFLYRQYTNTIQLNGFLSVGWNVGDHTFEWNTVASRVTESQLERSVGQEGDEFQALLRQTIQWEERQYLSTQLAGSHFLDDMGSVSLEWQATVSQADRYAPDRREYDFSATSSATDPVALKSQYQFAQPNDQQTELFNGFILEPGTIIRRYDDLMDDNLDVSGQLGWDVFDAGESYATLSAGIQLIFRERTSESATYGFNVNQVRDDLLRTSNLLVSDVVYSCNTTSSNAQCGSDAEGGISNDPNSGLVFADKTLASDSYDAELEYNSAFLMYDHTFNASWQVVVGGRYETYKQTTDTFSLQGSGGAVQSVIDEESFLPSLGVNWFITDSQQVRFALSQTVARPDFKEAANATFYDNEFNVRVRGNPFLEISDILNADLRWEWYLSEMDSLSVALFYKDMDKPIERVVQAASGSAGNSRTFQNSDSGELYGVEVDGRFEFALGDGYDQSLFVAFNGALIESEVRAANQEARALQGQPEYTANLIFGFDSISAGHQLTLLLNQNGKSIADVGVSGQPDVFLEPRLDLNMVYRFNMSDSLTLKAKLENLLDEEVKYSQGGQVFQVYRRGSSVQLGFDWQF

SEQ ID NO: 11816 - protein, 287 aa, Gamma proteobacterium HTCC5015
MIRKLLLTSAATALLTGAASAADLPRREPPPPPVFTPVPVFTWTGFYAGFNAGYGFDTGPNRGPTVIGVGPATGLVIVPTVIAFRNESNLDGFTGGGQIGYNYQFTPGAGVVIGLEADAQYVDFGRDRNRFIATGPIAAQRVFNPAGLAGLDFFGTVRGRLGYAWDRTLIYGTGGFAYGSGGGRDFGLPNDDDFQTGWTAGGGVEYALPTDSFLNFFRSSSVTVKVEGLYVNLDRGRRFNGAFAVNNAGAIITTASPGVVVVNAGQFRRDTEFAVVRAGLNYKFGTW

SEQ ID NO: 11817 - protein, 588 aa, Gamma proteobacterium HTCC5015
MKAAAKTQKPKRQEEHANFISWRFALLCGCILLALAFLLGRVAWLQVISPDMLVKEGDMRSLRVQQVSTSRGMITDRSGRPLAVSVPVKAIWADPKEVHDAGGISVGDRWKALANALNIPLDQLSARINANPKGRFIYLARQVNPDMADYIKKLKLPGIHLREESRRYYPSGEVTAHLIGFTNVDSQGIEGVEKSFDKWLTGQPGERIVRKDRYGRVIEDISSTDSQAAHNLALSIDERLQALVYRELNNAVAFNKAESGSAVLVDVNTGEVLAMANSPSYNPNNLSGTPKEAMRNRTITDVFEPGSTVKPMVVMTALQRGVVRENSVLNTIPYRINGHEIKDVARYSELTLTGVLQKSSNVGVSKLALAMPSSALVDTYSRFGLGKATNLGLVGERSGLYPQKQRWSDIERATFSFGYGLMVTPLQLARVYATIGSYGIYRPLSITKVDPPVPGERVFPESIVRTVVHMMESVALPGGGGVKAAIKGYRIAIKTGTAKKVGPDGRYINKYIAYTAGVAPASQPRFALVVVINDPQAGKYYGGAVSAPVFGAIMGGVLRTMNIEPDALTTGDKNEFVINQGEGTGGRS

SEQ ID NO: 11818 - protein, 641 aa, Octadecabacter antarcticus 238
MEGELKFLEAERDTLVTASRTKERTDESIATSTVITQDQIRRMGARTLSDALRIVPGIGITQTEFGIGAIDVRGVRTSFSDKVLMLLNGHPLDQDMANPGSTWVYDDLAVDTIKRIEVVRGSASALYGANAMMAVINIITQDAKDTHGVRASAGYGNYDTQQYRLSAGQQFDNGEAVVHFNYRGTNGLPRNAGGTQRAVTGPESRYDLEWQLGYEGFKLDGRYIGKRLDPYVSPFDLNAVTQNSQYDNYFLRLSRDWTVREDLSLSTQLYYDSFDSSYTGTAGAGSRLNPLIASWGGGSNDSRTGGEVQANYRVSRNNSLIGGVALAREAYDNPSYRQTVPYNPDFNIKATSSDMSRTRWSVYLQDMWEVWHSLHLSLGARYDHYSDFGGTFNPRMGFNWEFVRDYSLKFSYGTAYRAPVLGEMDPYTNVLAIGNPNLDPEREQTFETGLVAHPLRGLTTQAVYFHSRIADMIDAVRYCPAPGACPKSEVFPNFKRYENQGTLVTDGVEWEGRYDFQGADHGSYLLANYTYQNPLLNGQTAPDVPHSRVNLIANWRFDRHWNGFANLLYNGAVAGDSSVSPASPDLGSYALLNLSVLNQGQLVNGLDMGLTVYNLLGKQYADPGDFSVPGRIFYGHMSLRF

SEQ ID NO: 11819 - protein, 757 aa, Octadecabacter antarcticus 238
MLSQTSGNLNTDTIIRVNSDGSVTPSFSDGDDTFIVTAGNHAVGVLACASPGSARACVSSLDEESTADTGSNENNAIAKLDMAKGEITTHGTESYAAYANGTVVKAGDTLDYTNASVTLTDVDITTHGDNAHAIAARQGTVSFNQGEIYTTGPDAAIAKIYNGGTVTLKNTSAVAHQGSGIVLESSINGQEATVDILSGSSLRSANEILYHKNETSNVTITDSEVSSAADVFINNIKGHLTVDATNSKITGSANISTDDNTHTYLSLSDNSTWDIKADSTVSNLTVDNSTVYISRADGRDVEPTRLTITENYVGNNGVLHLRTELDDDNSATDKVVINGNTSGTTRVKVTNAGGSGAYTLNGIEIISVEGESNGEFIKDSRIFAGAYEYSLTRGNTEATNKNWYLTNFQATSGGETNSGGSSAPTVAPTPVLRPEAGSYVANLAAANTLFVMRLNDRAGETRYIDPVTEQERSSRLWLRQIGGHNAWRDSNGQLRTTSHRYVSQLGGDLLTGGFTDSDSWRLGVMAGYARDYNLTHSSVSDYRSKGSVRGYSAGLYATWFADDISKKGAYIDSWAQYSWFKNSVKGDELAYESYSAKGATVSLEAGYGFALNKSFGLEAAKYTWIFQPQAQAIWMGVDHNAHTEANGSRIENDANNNIQTRLGFRTFIRTQEKNSGPHGDDFEPFVEMNWIHNSKDFAVSMNGVKVEQDGVSNLGEIKLGVNGNLNPAASVWGNVGVQLGDNGYNDTAVMVGLKYKF

SEQ ID NO: 11820 - protein, 125 aa, Wolbachia endosymbiont of Apoica sp. JKS-343
TDTETDGIGGVGEYHWQEFAAAGGFSGNIAVAGRIDDDGDAWAGAGVAGRYRIGRRFFIEGSFMPGFYHAGDTELGGSLHFRSLIGAGFDINENAAISLTIDHMSNGSTQTLNPGSDAITLRFSF

SEQ ID NO: 11821 - protein, 163 aa, Wolbachia endosymbiont of Calyptratae sp. JKS-344
TKVDGITYKKDNSDYSPLKASFIAGGGAFGYKMDDIRVDVEGVYSYLNKNDVTDAQFTPDTIADSLTAISGLVNVYYDIAIEDMPITPYIGVGVGAAHISTPLKDAVNDQKSKFGFAGQVKAGVSYDVTPEVKLYAGARYFGSFGAHFDKDAAAGKDKGELKV

SEQ ID NO: 11822 - protein, 171 aa, Wolbachia endosymbiont of Sphaeroceridae sp. JKS-345
TKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDLTKQVTDASAYKV

SEQ ID NO: 11823 - protein, 214 aa, Wolbachia endosymbiont of Suillia sp. JKS-346
TKRDGHEIENYDYKIYPNKQADLRAVGPTREKADPYQITRQSTLIKLGFQPNENHRLSVALDDSTLETKGMDLSYVFRPCKDTSCAETHGERVINDQSKRKNIQFSYENFSQTPFWDHIKLSYSSQKITNKARSDEYCHQSTCAGVSNPQGLHLVEEGGVYKIKDKDNQEFKGSYYYGLTLKNHKDKDVSNDVDTEGGSLDSVLINCEKLNCEG

SEQ ID NO: 11824 - protein, 158 aa, Wolbachia endosymbiont of Drosophila neotestacea
TKVDGITNVAGKEKDSPLTRSFIAGGGAFGYKMDDIRVDVEGLYSQLTKDATVVNDNSAADDVTAFSGLVNVYYDIAIEDMPITPYIGVGVGAAYLSNPSKAEGVKDQRGLGFAGQVKAGVSYDVTPEIKLYAGARYFGSYGASFNKATVSTNKDVNV

SEQ ID NO: 11825 - protein, 162 aa, Wolbachia endosymbiont of Staphylinidae sp. JKS-349
TKVDGITYKKDKSDYSPLKPSFIAGGGAFGYKMDDIRVDVEGVYSYLNKNDVTDAEFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTV

SEQ ID NO: 11826 - protein, 171 aa, Wolbachia endosymbiont of Calyptratae sp. JKS-350
TKVDGITYKKDKSDYSPLKPSFIAGGGAFGYKMDDIRVDVEGVYSYLNKNDVKGATFDSADTIADSVTAISGLVNVYYDIAIEDMPITPYIGVGVGAAYISTPLALAVNDQKSKFGFAGQVKAGVSYDVTPEVKLYAGARYFGSYGANFDGKKADPQDATKKVIDAGARKV

SEQ ID NO: 11827 - protein, 158 aa, Wolbachia endosymbiont of Drosophila innubila
TKVDGITNAAGKEKDSPLTRSFIAGGGAFGYKMDDIRVDVEGLYSQLTKDATVVNDISAADDVTAFSGLVNVYYDIAIEDMPITPYIGVGVGAAYLSNPSKAEGVKDQRGLGFAGQVKAGVSYDVTPEIKLYAGARYFGSYGASFNKATISTNKDVNV

SEQ ID NO: 11828 - protein, 160 aa, Wolbachia endosymbiont of microlepidopteran, specimen 86
TKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNV

SEQ ID NO: 11829 - protein, 166 aa, Wolbachia endosymbiont of Calyptratae sp. JKS-355
TKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYGANFDKTDKDGKGELKVLYSTVGAEA

SEQ ID NO: 11830 - protein, 173 aa, Wolbachia endosymbiont of Drosophila munda
TKVDGITYKKDKSDYSPLKPSFIAGGGAFGYKMDDIRVDVEGVYSYLNKNDVKDVIFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKV

SEQ ID NO: 11831 - protein, 163 aa, Wolbachia endosymbiont of Sphaeroceridae sp. JKS-358
TKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKV

SEQ ID NO: 11832 - protein, 162 aa, Wolbachia endosymbiont of Hirtodrosophila trilineata
TKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGASYDVTPEVKLYAGARYFGSYGANFDKSGGEKDKGGHTV

SEQ ID NO: 11833 - protein, 173 aa, Wolbachia endosymbiont of Mycetophilidae sp. JKS-361
TKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSFGAHFDKSEEVDKAGGGKETKVTKDAYKV

SEQ ID NO: 11834 - protein, 159 aa, Wolbachia endosymbiont of Phoridae sp. JKS-362
TKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKV

SEQ ID NO: 11835 - protein, 164 aa, Wolbachia endosymbiont of Heleomyzidae sp. JKS-363
TKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKV

SEQ ID NO: 11836 - protein, 159 aa, Wolbachia endosymbiont of Mycetophilidae sp. JKS-365
TKIDGVTYKSGKDNNSPLKASFLAGGGAFGYKMDDIRVDVEGLYSQLSKDADVVDTFPAVVESLTAFSGLVNVYYDIAIEDMPITPYVGVGVGAAYVSNPLVTEVTGDKKSGFGFAYQAKAGVSYDVTPEIKLYAGARYFGSYGANFGKTAKDDGGIKV

SEQ ID NO: 11837 - protein, 171 aa, Wolbachia endosymbiont of Mycetophilidae sp. JKS-366
TKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGATYISTPLEPAVNDQKSKFGFAGQVKAGVSYDVTPEVKLYAGARYFGSYGANFDGKKTDPKDSTRQVTDAGAYKV

SEQ ID NO: 11838 - protein, 163 aa, Wolbachia endosymbiont of Chloropidae sp. JKS-367
TKVDGITYKKDNSDYSPLKASFIAGGGAFGYKMDDIRVDVEGVYSYLNKNDVTDATFTPDTIADSLTAISGLVNVYYDIVIEDMPITPYIGVGVGAAYISTPLKDAVNDQKSKFGFAGQVKAGVSYDVTPEVKLYAGARYFGSFGAYFDKDAAAGKDKGELKV

SEQ ID NO: 11839 - protein, 171 aa, Wolbachia endosymbiont of Drosophilidae sp., specimen B1D
TKVDGITYKKDKSDYSPLKPSFIAGGGAFGYKMDDIRVDVEGVYSYLNKNDVKDVTFDSANTIADSVTAISGLVNVYYDIAIEDMPITPYIGVGVGAAYISTPLEPTVNDQKSKFGFAGQVKAGVSYDVTPEVKLYAGARYFGSYGANFDGKKTDPKDSTRQVTDAGAYKV

SEQ ID NO: 11840 - protein, 302 aa, Wolbachia endosymbiont of Drosophilidae sp. JKS-368
TIKAGVETSRSVEHNGGQVVSVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNVGRHNSESYHAGFNYKNGGFFVQYGGAYKRHQDVDDVKIEKYQIHRLVSGYDNDALYASVAVQQQDAKLVEDNSHNSQTEVAATLAYRFGNVTPRVSYAHGFKGSVDDAKRDNTYDQVVVGAEYDFSKRTSALVSAGWLQEGKGENKFVATAGGVGLRH

SEQ ID NO: 11841 - protein, 171 aa, Wolbachia endosymbiont of Drosophilidae sp. JKS-369
TKVDGITYKKDKSDYSPLKPSFIAGGGAFGYKMDDIRVDVEGVYSYLNKNDVKDVTFGPANTIADSVTAISGLVNVYYDIAIEDMPITPYIGVGVGAAYISTPLALPVNDQKSKFGFAGQVKAGVSYDVTPEVKLYAGARYFGSYGANFDGKKADPADSTKQVTDPGAYKV

SEQ ID NO: 11842 - protein, 164 aa, Wolbachia endosymbiont of Polistes dominulus
TKVDGITYKKDNNDYSPLKASFIAGGGAFGYKMDDIRVDVEGVYSQLSKNNVTGAAFNPDTVADSLTAISGLVNVYYDIAIEDMPITPYIGVGVGAAYISTPLKEAVNDQKSKFGFAGQVKAGVSYDVTPEIKLYAGARYFGSFGAHFYKDDVTASKDKGELKV

SEQ ID NO: 11843 - protein, 171 aa, Wolbachia endosymbiont of Drosophilidae sp. JKS-370
TKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKV

SEQ ID NO: 11844 - protein, 157 aa, Wolbachia endosymbiont of Polybia sp. JKS-371
TKVDGIAHKSGKDNNSPLKASFIAGGGAFGYKMDNIRVDVEGLYSWLNKDADVVGDTVADNLTAISGLVNVYYDVAIEDMPITPYIGVGVGAAYVSNPLATKVTDDKASGFGVAYQAKAGVSYDVTPEVKLYAGARYFGSYGANFGKTAKDDAGIKV

SEQ ID NO: 11845 - protein, 171 aa, Wolbachia endosymbiont of calyptrate muscoid fly
TKVDGITYKKDKSDYSPLKPSFIAGGGAFGYKMDDIRVDVEGVYSYLNKNDVKDVTFDPANIIADSVTAISGLVNVYYDIAIEDMPITPYIGVGVGAAYISTPLELAVNDQKSKFGFAGQVKAGVSYDVTPEVKLYAGARYFGSYGANFDGRKTDPRDAAKQVIDAGAYKV

SEQ ID NO: 11846 - protein, 162 aa, Wolbachia endosymbiont of Calyptratae sp. JKS-374
TKVDGITYKKDNSDYSPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTV

SEQ ID NO: 11847 - protein, 162 aa, Wolbachia endosymbiont of Chloropidae sp. JKS-375
TKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSYGANFDKSGGEKDKGGHTV

SEQ ID NO: 11848 - protein, 166 aa, Wolbachia endosymbiont of Chloropidae sp. JKS-376
TKVDGITGLKDTSGKDNTTDLYTASFMAGGGAFGYKMDDIRVDVEGIYSQLNKDTTLTGNPSPSGGIANNLTAISGLVNVYYDIAIEDMPITPYIGVGVGAAYVSNPLATKVTDDKASGFSVAYQAKAGVSYDVTPEIKLYAGARYFGSYGANFGKVAKDDAGIKV

SEQ ID NO: 11849 - protein, 160 aa, Wolbachia endosymbiont of Chloropidae sp. JKS-377
TKVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDDNDIKNV

SEQ ID NO: 11850 - protein, 166 aa, Wolbachia endosymbiont of Polistes fuscatus
TKIDGVTGLKKKTGDTADTTDLYNASFIAGGGAFGYKMDDIRVDVEGIYSWLNKDTKVTGTAVPGAVAESLTATSGLVNVYYDVAIKDMPITPYVGVGVGAAYISTPLATAVSSQNGKFAFAGQARAGVSYDVTPEVKLYAGARYFGSYGANFDKTDKDGKGELKV

SEQ ID NO: 11851 - protein, 160 aa, Wolbachia endosymbiont of Calyptratae sp. JKS-380
TKVDGIKNVTGKEKDSPLTRSFIAGGGAFGYKMDDIRVDVEGLYSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNV

SEQ ID NO: 11852 - protein, 167 aa, Wolbachia endosymbiont of Calyptratae sp. JKS-383
TKVDGVTGLKKKTADTTDTTDLYTASFMAGGGAFGYKMDDIRVDVEGIYSQLNKDTTVTGTSAPAGGIANKLTAISGLVNVYYDIAIEGMPITPYIGVGVGAAYVSNPLAKKVTDDKASGFGVAYQAKAGVSYDVTPEIKLYAGARYFGSYGANFGKAAKDDAGIKV

SEQ ID NO: 11853 - protein, 117 aa, Wolbachia endosymbiont of Chloropidae sp. JKS-385
TRIDGIEYKKGTEVHDPLKASFMAGGAAFGYKMDDIRVDVEGLYSQLNKNDVGGATFAPTTVANSVAVFSGLVNVYYDIAIEDMPITPYVGVGVGAAYISNPSEASAVKDQKGFGFA

SEQ ID NO: 11854 - protein, 160 aa, Wolbachia endosymbiont of Chloropidae sp. JKS-386
TKVDGITNATGKEKDSPLTRSFIAGGGAFGYKMDDIRVDVEGLYSQLAKDTAVVNASETNVADSLTAFSGLVNVYYDIAIEDMPITPYVGVGLGVAYISNPSKASEVKDQKGFGFAYQAKAGVSYDVTPEIKLFAGARYFGSYGASFDKAAKDDTGIKNV

SEQ ID NO: 11855 - protein, 163 aa, Wolbachia endosymbiont of Calyptratae sp. JKS-387
TKVDGITYTKDNSDYSPLKASFLAGGGAFGYKMDDIRVDVEGVYSYLNKNNVTDARFMPDTIADSVTAISGLVNVYYDIAIEDMPITPYIGVGVGAAYISTPLKDAVNDQKSKFGFAGQVKAGVSYDVTPEVKLYAGARYFGSFGAHFDKDAAAGKDKGELKV

SEQ ID NO: 11856 - protein, 262 aa, Wolbachia endosymbiont of Calyptratae sp. JKS-388
TRFVADQSGTESDHFGHIITKYAYVTLGNKAFGEVKLGRAKTIADGITSAEDKEYGVLNNSKYIPTNGNTVGYTFKGIDGLVLGANYLLAQERHKYTGVGAAGAVAGEVYPQKISNGVQVGAKYDANNIIAGIAYGRTNYREDIHKEDLGKKQQVNGALSTLGYRFSDLGLLVSLDSGYAKTKNYKDKHEKHYFVSPGFQYELMEDTNVYGNFKYERNSVDQGKKAREHAVLFGVDHKLHKQVLTYIEGAYARTRTNDQGKT

SEQ ID NO: 11857 - protein, 162 aa, Wolbachia endosymbiont of Calyptratae sp. JKS-389
TKVDNMKIKKGTDDVDPFEASFIGGGAAFGYKMDDIRVDIEGLYSQLNKNVNNDEVLTPDTVAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTV

SEQ ID NO: 11858 - protein, 162 aa, Wolbachia endosymbiont of Drosophilidae sp. JKS-390
TKVDNMKIKKGTDDVDPFKASFIGGGAAFGYKMDDIRVDIEGLYSQLNKNVNNDEVLTPDTVAGSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTV

SEQ ID NO: 11859 - protein, 164 aa, Wolbachia endosymbiont of calyptrate muscoid fly
TKIDGVKGLKKNNADTTDFYTASFMAGGGAFGYKMDDVRVDVEGIYSQLNKDTTLIGTPDPSAGIASNLTAISGLVNVYYDVAIEDMPITPYIGVGVGAAYVSNPLAQKVIDDKASKFGVAYQAKAGVSYDVTPEIKLYAGARYFGSYGVNFGKINKDDAEIKV

SEQ ID NO: 11860 - protein, 168 aa, Wolbachia endosymbiont of calyptrate muscoid fly
TKIDGIQKTKGKEKDSPLKASFVAGGGAFGYKMDDIRVDVEGLYSWLNKDADVVGDTVADNLTAISGLVNVYYDVAIEDMPITPYIGVGIGAAYISTPLKTAVNEQNSKFGFAGQVKAGVSYDVTPEIKLYAGARYFGSYGAHFDKSEEVDKAVGGKETKVTKDAYKV

SEQ ID NO: 11861 - protein, 160 aa, Wolbachia endosymbiont of calyptrate muscoid fly
TKVDGIKNAKDKEKDSPLTRSFIAGGGAFGYKMDDIRVDVEGLYSQLAKDTAVVDTSETNVADSLTAFSGLVNVYYDIAIEDMPITPYVGVGVGAAYISNPSKADTVKDQKGFGFAYQAKAGVSYDVTPEIKLFAGARYFGSYGASFDKAAKDDTGIKNV

SEQ ID NO: 11862 - protein, 162 aa, Wolbachia endosymbiont of Aleochara bilineata
SYYVRLQYNGEILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISIPLKDAMNDQKSKFGFAGQVKAGVSYDVTPEVKLYAGARYFGSFGA

SEQ ID NO: 11863 - protein, 187 aa, Wolbachia endosymbiont of Delia radicum
  misc_feature (68)..(69): Xaa can be any naturally occurring amino acid
SYYVRLQYNGEILPLFTKVDGMKIKKGTDDVDPFKASFIGGGAAFGYKMDDIRVDVEGLYSQLNKNVXXNAVLTPDTVADSVTAISGLVNVYYDIAIEDMPITPYVGVGVGAAYISTPLEDAVNGQKSKFGFAGQVKAGVSYDVTPEVKLYAGARYFGSYGANFDKSGGEKDKGGHTVLYSTVGAEA

SEQ ID NO: 11864 - protein, 189 aa, Wolbachia endosymbiont of Leptopilina heterotoma
SYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITPYVGVGVGAAYISTPLKDAVNDQKSKFGFAGQVKAGVSYDVTPEVKLYAGARYFGSFGAHFDKDTAAASKDKGELKVLYSTVGAEA

SEQ ID NO: 11865 - protein, 185 aa, Wolbachia endosymbiont of Amaurobius ferox
SYYVRLQYNGEILPFYTKVDGITNATGKEKDSPLTRSFLAGGGAFGYKMDDIRVDVEGLYSQLAKDTAVVNASETNVADSLTAFSGLVNVYYDIAIEDMPITPYVGVGVGAAYISNPSKANEVKDQKGFGFAYQAKAGVSYDVTSEIKLFAGARYFGSYGASFDKAAKDDTGIKNVVYSTVGAEA

SEQ ID NO: 11866 - protein, 185 aa, Wolbachia endosymbiont of Segestria florentina
SYYVRLQYNGEILPFYTKVDGITNATGKEKDSPLTRSFIAGSGAFGYKMDDIRVDVEGLYSQLAKDTAVVNTSETNVADSLTAFSGLVNVYYDIAIEDMPITPYVGVGVGAAYISNPSKTDAVKDQKGFGFAYQAKAGVSYDVTPEIKLSAGARYFGSYGASFDKAAKDDTGIKNVVYSTVGAEA

SEQ ID NO: 11867 - protein, 185 aa, Wolbachia endosymbiont of Philoscia muscorum
SYYVRLQYNGEILPLYTKVDGITNVTGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFNKETVSATKEINVLYSAVGAEA

SEQ ID NO: 11868 - protein, 185 aa, Wolbachia endosymbiont of Reticulotermes santonensis
SYYVRLQYNGEILPFYTKVDGITNATGKEKDSPLTRSFLAGGGAFGYKMDDIRVDVEGLYSQLAKDTAVVNASETNVADSLTAFSGLVNVYYDIAIEDMPITPYVGVGVGAAYISNPSKANEVKDQKGFGFAYQAKAGVSYDVTSKIKLFAGARYFGSYGASFDKAAKDDTGIKNVVYSTVGAEA

SEQ ID NO: 11869 - protein, 194 aa, Wolbachia endosymbiont of Maniola jurtina
SYYVRLQYNGEISPFKTKIDGIEYKKNNDAQDPLKASFMAGSGAFGYKMDDIRIDIEGLYSQLNKNDVSGAVFTPATVADNVTAFSGLVNVYYDVAIEDMPVTPYVGVGVGAAYFSNPSSADTVKDQKGFGFAYQAKAGVSYDVTPEIKLYAGARYFGSYGAKFDGEKKQGSGEDEVTTTDKGAYKVFYSTIGA

SEQ ID NO: 11870 - protein, 186 aa, Wolbachia endosymbiont of Peribatodes rhomboidaria
SYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFKKEAVSATKEINVLYSAVGAEA

SEQ ID NO: 11871 - protein, 196 aa, Wolbachia endosymbiont of Spilosoma lubricipeda
SYYVRLQYNGEVLPFKTKIDGIEYKKNNDAQDPLKASFMAGSGAFGYKMDDIRVDVEGLYSQLNKNDVSGAAFTPVTVADSVTAFSGLVNVYYDVAIEDMPITPYVGVGVGAAYVSNPLATKIAGDKDSGFGFAYQAKAGVSYDVTPEIKLYAGARYFGSYGASFDGEKQDPDDSSKKVADKGAHKVFYSTIGAEA

SEQ ID NO: 11872 - protein, 568 aa, Collimonas fungivorans
MAAALLLWTAGTVCAAPIPWQSQKFEYVADRKDIKEVLRDLGASQHVMTSISTQVEGSVTGSFNETPQKFLDRMAGTFGFAWYYDGAVLRVTSANEAQSATIALTRASTAQVKRALTRMGIADSRFPIQYDDDSGSIVVSGPPRLVELVRDIAQVIDRGREDANRTVVRAFPLRYAWATDHRVTVNGQSVNIRGVASILNSMYGGDGPSDSGTAPRAQDRRLDSVAPGEASAGRAGTRALSSLGGGKSPLPPGGTGQYVGNSGPYAPPPSGENRLRSDELDDRGSTPIIRADPRSNSVLVRDRADRMAAHQSLIESLDSRPAVLEISASIIDISENALEQLGVDWRLHNSRFDLQTGNGTNTMLNNPGSLDSVATTAGAAAAIAATPAGGVLSAVIGGGSRYLMARISALQQTDQARITANPKVATLDNTEAVMDNRQNFYVPVAGYQSADLYAISAGVSLRVLPMVVMDGGTVRIRMNVHIEDGQITSQQVGNLPITSQSEIDTQALINEGDSLLIAGYSVEQQSKSVDAVPGLSKIPLVGALFRTDQTTGKRFQRMFLVTPRVITP

SEQ ID NO: 11873 - protein, 243 aa, Anaplasma phagocytophilum
ELGGRLSVIAEQSNSTADDQKQQHGALRNQGSRFHIKATHNFGDGFYAQGYLETRFVTKASENGSDNFGDITTKYAYVTLGNKASGEVKLGRAKTIADGITSAEDKEYGVIKNSKYIPTNGNTIGYTFKGIDGLVLGANYLLAQERYEGEVNPQKISNGVQVGAKYDANNIIAGIAYGRTNYRENTIGIPDLGKKQQVNGALSTLGYRFSDLGLLVSLDSGYAKTKNYKAKHEKRYFLSPGFQ

SEQ ID NO: 11874 - protein, 633 aa, Anaplasma phagocytophilum
YRTDNLLSKFGWDYSDTGRLQLTYERYQDDTDTRVLSNYSNTATIRTQDAEDRVDRERFSLAHTQQLDTLLADQIHSQLNYQDSQTRQQTFEDRVVGGQPRYRTRDSYYEEKLWAFNTKLDKAFSIGSTQHALVYGLDIKHLKNADLRKGGETVLATGVTTPVLPTSDFPDPTTKEYALFVQDNISIGRWTLLPGLRYDRYEMQPHVTDKYLNSQATERNPSDFKDSALSPKFGVTYQLDDAHSVYGQYAAGFRAPQAIEIFGEFTNPGMYRTLANTSLKAETSDSFELGLRGQYAIGSFGAALFYNQYDDFIEQVSRASSVPGFPFGEFQYVNRDRVTIPMSDQHAQRIEQACEPAYPGKRKKGHGKTPVNNCSLDWQSIFTQSTLVHSNSDKQPRFDVNNGHLLECGADFAMQSHARLKPLQPRAEQKLQTRHALMDAARSLMDSGRGFGSLSLREVARCAGIVPTGFYRHFEDMDALGLALIAEVGETFRETIRQVRHHEFEVGGVIDASVRIFLDAVTANRSQFLFLAREQYGGSQLVRQAVGALRERITADLVADLAAMPKLQHFDAPAQNVIADLVVKTVFATLPELIDPPAAALPMHASPEIKMIEQLRFIFIGAKHWQGLGQTRA

SEQ ID NO: 11875 - protein, 619 aa, Anaplasma phagocytophilum
ARWNHIENLDVFFRRVYKYYINHGLTYMILNYVFELMQFLFIILFTTFLITCVDYPVLFGDKLPSGHTGDSHKVTIPDAVRPLGQCVNRFTTSIICFLVIAFTSWAMRLIRIIWNLSHFIEIKSFYSEALKISTSELQNITWQEVQNRMMKYQLEHQMCIHKEQLSELDITHRISRFTNYLVAMVNKDIIPVRLTVPLIGQRLFFTKGYLYNLEAILFWAPGSPFDNDWHLRPDYKKANKRQELAEQLSTRIFYFALLNIVLSPIIFIWQILFSFFSYAEIIRRDPGRLGIRRWSLYSRHYLRHFNELDHDLNLRLGRAYKPASKYMNIFYSHLLALIAKNIAFFAGAMLAVLLALTIYDEFLLTVEHVLTAVTVLGVIITSCRTLIPNEQDVQCPHKAMKSILCHIHYMPDDWKTQAHTVTIREEFSTLFQYKLSFYLEELLSPLITPFVLLYALRTKSLTIIDFFRQFTIEVEGVGDVCSFAEMDIKRHGDPKWLSSNNPERNQQSTARDGKMELSLINFQMKNPEWKPNPETSQYISKLKEQGNDYLLQLYCTSIFDKLLLYYKKFKSIHIRAISFYSNIRKCKLFFTATFTLKFIVFGMVTYVNNATLLTSQHFF

SEQ ID NO: 11876 - protein, 255 aa, Anaplasma phagocytophilum
RELLVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAG

SEQ ID NO: 11877 - protein, 693 aa, Anaplasma phagocytophilum
RDDGYDIADFYGIHPDYGTLADFQRLVEAAHQRGLRIITELVVNHTSDQHPWFQESRRDPKSPKRDWYVWSDTEEKYKGTRIIFLDTERSNWTWDPVAKQYFWHRFFSHQPDLNYDNPEVQEAMLDVMRFWLNMGVDGFRCDAVPYLFEREGTNCENLPETHAFLKRLRKTIDAEYPSKMLLAEANQWPADVRVYFGDGDEFNMGFHFPVMPRLFMAVRREDRNPIVEILQQTPDTPVFLETKEGTSSSVTVGGFIQDSWSVLDKVTVNAGVRYDMQTLWGLDDKVGLNLPNQWSPRVGVIYDFTQQGRSKLFVNYARFFESVPLDMADLSFPQQQLLSATYKAPPCDLTEPGNLENTCSVAPNRDVIGNLESPNQGWDAQGGDRVSVDPNIEPQSMDELSVGAEYELLLGRFGAAYTLRSLNNVIEDMSRDDGNTFFLGNPGKGYSSDFPVARRRYDGVNLYYQKNFSNLWLAQASYTWSRLRGNYSGLFRADTGQLSPNLTRDFDLLSLTFNREGPLPGDRTHSFKLFGAREFVFNQVASLNVGGSYRARSGTPLNYLGAHPQRSGSETFILPRGSGGRLPWVHGVDTHVGFNLKVVKDSTLSLSLDVFNLFNFQQYTAVDQTLTTTRVYAIEQGGSPAGVDACVTGQGECTVISTATNKPITTADINPNFKRPIAYQAPRSVRLGAKISF

SEQ ID NO: 11878 - protein, 232 aa, Anaplasma phagocytophilum
LLTGGVNFTYGKAKADIHSFFGDGRINSAGYGLGTSLTWYGNNGVYVDGQLQTMWFDSDLSSRTAGHAVASGNNGRGYTSAIEAGKGYTLSHGLSLTPQMQVTYSRVDFDTFRDPFDSEVSLQEGDSLRGRLGVSLNKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 11879 - protein, 231 aa, Anaplasma phagocytophilum
DVNAPYVALTFDSGKFSIDGSLRYDMGDARGNYNGTAIAQNLDVNGDGVIQPVEQRVATVDTANARPVDYDWNYLSYSLGSNYLINDDLGAFARISRGARANADRLLFGVIRDDGSVSSDEGVNVVRQAEAGLKWRRDGLSLFATAFSARTEEQNFEVTSQRFFNRSYQANGVELEASYRHEGFTVNGGLTWTDAEISKDQITPENTGNVPRRQADVVWQLTPSYRGDGYQ

SEQ ID NO: 11880 - protein, 274 aa, Anaplasma phagocytophilum
ELLVGSLSAAAVCACSLLISGSSFAYSGNNDASDVSGVMNGSFYVSGSYSPSFPSISSFAISESDRGGSYVKGYNKNLSTLNVSDPISFTQNDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGAR

SEQ ID NO: 11881 - protein, 275 aa, Anaplasma phagocytophilum
ELLVGSLSAAAVCACSLLISGSSFAYSGNNDASDVSGVMNGSFYVSGSYSPSFPSISSFAISESDRGGSYVKGYNKNLSTLNVSDPASFTQHDPSFKFAKSLLTSFDGATGYAIGGARVEVEVGYKKFETLAESDYKHIESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGAAAKVKANIASYGFNIGARF

SEQ ID NO: 11882 - protein, 111 aa, Anaplasma phagocytophilum
LVDGLDLTLQYQGKNEGREAKKQNGDGVGTSLSYDFGGSDFAVSAAYTSSDRTNDQNLLARGQGSKAEAWATGLKYDANNIYLATMYSETRKMTPISGGFANKAQNFEAVA

SEQ ID NO: 11883 - protein, 364 aa, Haemophilus influenzae
AVSAGTSQLAMASAHDESKGFIEDSKLSVKTRMLYFSRDFRNNAPGSQSRVEETGLGFLGTFESGFTQGTVGFGVDAIGMLGLKLDSGKGRAGTGLFPTGADGRSQDDYSEGGGAVKMRISNTVLKFGDQFTALPVLATDDSRLLPEVAEGGLITSNEIDGLTLHAGHFTALNAQAQTYHDSLNLTEANVFGGTYAITDSLSTSVYYSRIEDHFRKWYGNINWALPISDKQGLVFDFNIYDTKSIGNNLTGAYVSKSDGTNELDNIAASLSAAYNVGAHTFTLAYQKVSGDGDYAYGVDGGGTVFLANSVARSDFNAEDEKSWQARYDLNFAEFGVPGLTFMTRYVSGTGATTRTTDSGKEWER

SEQ ID NO: 11884 - protein, 196 aa, Wolbachia endosymbiont of Nurscia albofasciata
GPISDEETSYYVRLQYNGEILPLFTKIDGITNATSKEKDSPLKASFIAGGGAFGYKMDDIRVDVEGLYSWLNKDADVVGGTVADNLTAISGLVNVYYDIAIEDMPITPYVGVGVGAAYVSNPLAKKVTDDKASGFGVAYQAKAGVSYDVTPEVKLYAGARYFGSYGANFGKATKDDAGIKVLYSTVGAEAGVAFNF

SEQ ID NO: 11885 - protein, 196 aa, Wolbachia endosymbiont of Nurscia albofasciata
GPISDEETSYYVRLQYNGEILPLFTKIDGIVRKAGKDNDSPLKPSFMAGGGAFGYKMDDIRVDVEGLYSWLNKDAGVVDDTVADNLTAISGLVNVYYDIAIEDMPITPYVGVGVGAAYISTPLKTAVSSQNGKFAFAGQARAGVSYAITPEIKLHAGARYFGSYGANFDKTDKDGKGELKVLYSTVGAEAGVAFNF

SEQ ID NO: 11886 - protein, 238 aa, Wolbachia endosymbiont of Hylyphantes graminicola
GPISDEETSYYVRLQYNGEVLPFYTSIEGITHKSGKDKDSPLKASFIAGGGAFGYKMDDIRVDVEGLYSQLSKDANVVNAAAVPAVGTTSATSATSATSATSATSATSATSATSAIAAIPEVAESLTAISGLVNVYYDIAIEDMPITPYVGVGVGAAYISTPLKTAVNGQNSKFGFAGQVKAGVSYDVTPEIKLYAGARYFGSFGAHFDKDAAAGKDKGELKVLYSTVGAEAGVAFNF

SEQ ID NO: 11887 - protein, 197 aa, Wolbachia endosymbiont of Hylyphantes graminicola
GPISDEETSYYVRLQYNGEILPLYTKVDNITYTSGQENNSPLKASFIAGGGAFGYKMDDIRVDVEGLYSQLTKDTTVVNDSSAADGVTAFSGLVNVYYDIAIEDMPITPYIGVGVGAACLSNPSKATGVSDQRGFGFAGQVKAGVSYDVTPEIKLYAGARYFGSYGASFKKATTSTTNDINVLYSTVGAEAGVAFNF

SEQ ID NO: 11888 - protein, 197 aa, Wolbachia endosymbiont of Hylyphantes graminicola
GPISDEETSYYVRLQYNGEILPLYTKVDGITYTAGQSPLKASFMAGGGAFGYKMDDIRVDVEGLYSQLNKDAAVITGADANIAADSVTAFSGLVNVYYDIAIEDMPITPYIGVGVGAACLSNPSKADGASDQRGFGFAGQVKAGVSYDVTPEIKLYAGARYFGSYGASFKKATASATNDINVLYSTVGAEAGVAFNF

SEQ ID NO: 11889 - protein, 237 aa, Wolbachia endosymbiont of Hylyphantes graminicola
GPISDEETSYYVRLQYNGEVLPFYTSIEGITHKSGKDKDSPLKASFIAGGGAFGYKMDDIRVDVEGLYSQLSKDANVVNAAAVPAVGTTSATSATSATSATSATSATSATSATSAIAAIPEVAESLTAISGLVNVYYDIAIEDMPITPYVGVGVGAAYISTPLKTAVNGQNSKFGFAGQVKAGVSYDVTPEIKLYAGARYFGSFGAHFDKDAAAAKTKGNSKFLQHCGAEAGVAFNF

SEQ ID NO: 11890 - protein, 250 aa, Wolbachia endosymbiont of Hylyphantes graminicola
GPISDEETSYYVRLQYNGEVLPFYTSIEGITHKSGKDKDSPLKASFIAGGGAFGYKMDDIRVDVEGLYSQLSKDANVVNAAAVAAVSTTPAVAAVSTTPAVAAVSTTPAVAAVSTTPAVAAVGTTPAIAAIPEVAESLTAISGLVNVYYDIAIEDMPITPYVGVGVGAAYISTPLKTAVNGQNSKFGFAGQVKAGVSYDVTPEIKLYAGARYFGSFGAHFDKDAAAGKDKGELKVLYSTVGAEAGVAFNF

SEQ ID NO: 11891 - protein, 250 aa, Wolbachia endosymbiont of Hylyphantes graminicola
GPISDEETSYYVRLQYNGEVLPFYTSIEGITHKSGKDKDSPLKASFIAGGGAFGYKMDDIRVDVEGLYSQLSKDANVVNAAAAAAVSTTPAVAAVSTTPAVAAVSTTPAVAAVSTTPAVAAVGTTPAIAAIPEVAESLTAISGLVNVYYDIAIEDMPITPYVGVGVGAAYISTPLKTAVNGQNSKFGFAGQVKAGVSYDVTPEIKLYAGARYFGSFGAHFDKDAAAGKDKGELKVLYSTVGAEAGVAFNF

SEQ ID NO: 11892 - protein, 199 aa, Wolbachia endosymbiont of Hylyphantes graminicola
GPISDEETSYYVRLQYNGEVLPFYTKVDGVTNATGKEKDSPLTRSFIAGGGAFGYKMDDIRVDVEGLYSQFAKDTAVVNASETNVADSLTAFSGLVNVYYDIAIEDMPITPYVGVGLGVAYISNPSKASEVKDQKGFGFAYQAKAGVSYDVTPEIKLFAGARYFGSYGASFDKAAKDDTGIKNVVYSTVGAEVGVAFNF

SEQ ID NO: 11893 - protein, 146 aa, Wolbachia endosymbiont of Paederus fuscipes
GPISDEETSYYVRLQYNGEVLPFKTKIDGVTYKSGKDDNSPLKASFLAGGGAFGYKMDDIRVDVEGLYSQLSKDADVVDTSPAVVESLTAFSGLVNVYYDIAIEDMPITPYVGVGVGAAYVSNPLVTEVTGDKKSGFGFAYQAKAG

SEQ ID NO: 11894 - protein, 198 aa, Wolbachia endosymbiont of Paederus fuscipes
GPISDEETSYYVRLQYNGEVLPFKTKIDGVTYKSGKDNNSPLKASFLAGGGAFGYKMDDIRVDVEGLYSQLSKDADVVDTSPAVVESLTAFSGLVNVYYDIAIEDMPITPYVGVGVGAAYVSNSLVTEVTGDKKSGFGFAYQAKAGVSYDVTPEIKLYAGARYFGSYGANFGKTAKDDGGIKVLYSTVGAEAGVAFNF

SEQ ID NO: 11895 - protein, 198 aa, Wolbachia endosymbiont of Neriene limbatinella
GPISDEETSYYVRLQYNGEVLPFKTKIDGVTYKSGKDNNSPLKASFLAGGGAFGYKMDDIRVDVEGLYSQLSKDADVVDTSPAVVGSLTAFSGLVNVYYDIAIEDMPITPYVGVGVGAAYVSNPLVTEVTGDKKSGFGFAYQAKAGVSYDVTPEIKLYAGARCFGSYGANFGKTAKDGGGIKVLYSTVGAEAGVAFNF

SEQ ID NO: 11896 - protein, 229 aa, Aeromonas hydrophila
VWRADTKSNVPGGPSTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 11897 - protein, 391 aa, Anaplasma ovis
LVLSALPLAAVADVSLYGEIKAGVEGRNFQLQLTEQPQAANTQQGGKVKVTKAKSRIRTKISDFGSFIGFKGSEDLGEGLKAVWQLEQDVSVAGGGATRWGNRESFVGLAGEFGTLRTGRVANQFDDASQAIDPWDSNNDVASQLGIFKRHDDMPVSVRYDSPDFSGFSGSVQFVPIQNSKSAYTPAHWNTVYDTNGTTTTTTFVPAVVGKPGSDVYYAGLNYKNGGFAGNYAFKYARHANVGRDAFELFLIGSATSDQAKGTDPLKNHQVHRLTGGYEEGGLNLALAAQLDLSENGDKAKTKNSTTEIAATASYRFGNAVPRISYAHGFDLIERGKKGENTSYDQIIAGVDYDFSKRTSAIVSGAWLKRNTGIGNYTQINAASVGLRHKF

SEQ ID NO: 11898 - protein, 373 aa, Vibrio alginolyticus
MSYLKKSLLATAITGMMFSGSAFADGANSDAAKEYLTKDSFSYEVYGIIAMQAAYRDYDSGSKATDDDLGGMQLNNESRIGFRGKKQFANFEPTFIWQIEGGYVDPSFGGEGAGLGERDTFVGFESASWGQVRLGRVLTPMYELVDWPASNPGLGDVYDWGGAIGGAKYQDRQSNTVRWDSPMFADKFSLDIAAGAGDEAGLGAGDDYWGGIAAHYKLGPLQLDAAYEGNRNIESEGQTWENNTYLVGVQGWFENGISFFAQYKYMEADASNGVSEKQDAMSAGLMYTTGDWQYKLGYAANFDLERDGKTIDNTADDVLSAQIMYFVDPSAVLYARARTLDFGDGASQVGDPSEYRWKSADYDEFSVGVEYYF

SEQ ID NO: 11899 - protein, 342 aa, Salmonella typhi
VKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMST

SEQ ID NO: 11900 - protein, 234 aa, Salmonella enterica
MIVRKRRGRRTLRCLACLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLALTDPLWHASVSTLGWRVNSQFGDVRPWAQISYNQQFGENIWKAQSGLSRMAAGNQVGNWLDVTVGADVLLNPHLAAYAAFSQAENSATDSDYLYTLGVSARF

SEQ ID NO: 11901 - protein, 634 aa, Salmonella enterica
MQKKIIALLIASVCCHCTLYADDSSQSAILSSYTGDELVVTATRFPIKEKESSRFITVADSEKLKEVGATNAMDALGKIGGIGYKSLAPMGINRQGMNAAVYIRGIEDGELILINGMPVQQASGKGYDISSIPVEQIERIEVLKGAASTLYGADAMAGVINIVMKKAVDEKSGTASVEFGNEEWMNHGVSFSLPGISAGVRYQHMGELDDVGRDLKNEHTMALGNTDKYMVNVNASPFDNVSVDYQYNWYETTFIDRYDSGEEESTDQESSFHFLSLRYETARFKAKAFGVYDNRYQTDYVNEEQDGETLQRLNYNYGAETDYRFKFSEAFELVAGADYVHRFADYENNYGEKYRDDYGLFAELKAEPSSDLLLALGVREQFIDNEDGTSDYDAFLPSAGVTWKVNEELNLFANTGKAFQAPTFTQLYYEGRIIVGNPDLEPESGWTYEAGFKYDSGVASARLAGFYMTYDDKIEVDRSQGRPYGYFNAGSYSSKGVEWKLGLYPFLSSGSFLSDVSFSAAGYWAYPVAENTDGEEYQPGPKFQNTFGISYATLPVNVDLTCRILAGREDELENYAAFDMTGKVKAGSGYVTLAVENVFDTEIQTTGNLVEDASSRYVYYEPGRLARLGYTVSF

SEQ ID NO: 11902 - protein, 2554 aa, Salmonella enterica
MLQTGTGTFTIQSTITDNGGAIGFTKAGAGSVTLTGQNTYSGVTTLSGGILTVTQMANAGMASGIGQSTADPANLMLESGTFRYTGGSVTTDRGFTLVNGGPARVIEVTGSGSNLAFSGLVTSPDDAGFEKKGAGTLTFLNGSNDHIGATTVSGGTLAVSTLADGGQVSSLGKSGSDATNLILAGGALNYLGSTTSSDRSFTLGAGNGSIGVANAGTTLSMSGTAVGTDGLTKLGDGTLILSGTNTYTGNTAVNAGVLRAGSAQAFGPSGLMTVGNGASLELGGYDITVSGLLGAGTVDLGGNTLTSSGSAANSFTGKITGTGGFTRTGGSTQTLSGCNSDYTGKTTIASNGTLSVDCLKNGGQASSIGASSNAPDNLVLNNGTLSYTGNTVTTDRGFTIQGGTGAISVTDAATTLTFSGQVVGTGALQKRDTGTLVLMNSNSYRGGTSVDAGTLRAGSSGAFGGGSMSLSNAAGAILDLDGFDTSVTSLSGGGALGGNVALGGATLTISSGNSNGTSYTGAITGIGNFVKNGNGTQRLTGCASSYSGSTTINGGVLEVSCLADGGSVSSIGMSSADADNLVINGGVLRYTGSGDSTDRQFTLGASGGNSIESEGTGAILFTSNAAVTFAAANTAQTLTLTLAGTNTDDNERGAQLTNNGSGITSLTKTDTGTWFLTNSDSTYTGVTKINGGVLSVDKLANGVLASSIGASSSAASNLIIGNDSTLRYLGTGDTTDRLFTLASGLTYIESSGSGAIVFTDTGQVALADNNQARTIALGGKNTGDNTLAGSIGDAGTGKTTLAKNDDGTGVLTGNNTFTGPTNINKGLLKIGNGGTTGSLTSDIVVTDGGLIFNRSDTLNYGGLISGAGFVTQSGSGTTILTGANSYTGATSVSAGTLLVNGDQSAATGQTSVANGSILGGSGIIGGNVVVTDGALAPGSNGAGTLTINGSLALSAGSILSMQLGQAGVAGGALNDLIEVKGNLTLDGTLDVAETAGGSYGPGIYRLINYTGSLTDNGLDIGMLPNGAGAIQTAVAGQVNLLAGGTNFNFWDGDVGPKFNSAVDGGNGTWQNSSGNNNWTDATGNINASYSDGAFAIFTGTAGTVTIDNSLGQVKAEGMQFAIDSYAVTGDKLELTGPQSTIRVGDGTTAGAAYIATINSVLTGNTQLEKTDAGTLVLTGANSYTGGTAINGGTIRISSDDNLGVASSDISFDGGALNTTANIATDRAIILTGAGTLLTDASTTLSLSGPISGTGALTKSGTGTLLLSGTAAHTGGTTITAGTLQIGNRGTDSSIDGNIVNNGALVFDRAGTLAYTGSISGTGTLTKNGSSTLTMTGTSTYTGETTVSAGTLALQAGGQIKGTASLTVDGGAEVLIDGSGSQFATGAGASVVGTGTVTVRDGGTASFDSLTTSNATGTNSTITVAGSGSQMTQTGIATFGLAGTATVDILDGGTMISSGASVFVGGQLPMDATGQVTISGAGSQWTIANALYARRGSITVDDGGVVTAGSAVIGYADTGINNPETDLVVTGAGSRFETTGELAITNSAANAARGSITIADGGVVKVGGGALAMGPGNAVLNIGAAAGGSPAHAGTLDAGTVTMAVGSNQINFNHDDASTTFSATISGAGSVSQNGSGATLLTGNNSYAGLTTVTAGSLYIDGDQSMATGLTTVNPGGTLGGTGTIGGDVTVASGGAINPGSFGMAPGTLNINGDLTLASGSTQSFSFGQANIPGGPLNDLINVGGDLVLAGTLQVDTSAGGTMDPGIYRVFNYTGTLSQNAWTVNLPSPDFYVQTSVAQQINLVNTAGLALRFWDGADPQNKNNGKIEGGNGIWQAFGSAPDNGNDNWTETGNINAPFQDATFAVFTGEKGTVTVDDSKGAINVSGIQFVTDGYIVNGDAINLVGASGSTIRVGDGTTGGTDTVASIDAEITGASQLIKADMGTLILTGDNSYTGGTKITGGTLQVAKDSALGTRTGELILDGGTLNTTADMTIDRSGTIDQAGTLDIDTGTTLKIDGVLSGAGAFVKTGAGRLELAGDDHTYNGDASIASGTLALTGALGGTMNVGIDGRLEATGRVGATTNSGVIALDQEGFGSLTVNGNYTGKDGRLEIATVLGDDTSLTNRLVIDGDTAGTTQVSVTNRGGLGAQTVEGIKIIQVGGASNGMFLLAGDYMFNGEQAVVAGAYGYRLYKGGVSTPADGNWYLRSALLNPETPTNPTDPETPLYQPGVPLYESYAGSLQQLNKLGTLQQRVGNRVWAKHPVPAQSDENGAGPSGNNGIRARIEAAHAEFDPKQSTSRASYDADIWKFQTGIDGMFTETASGKFIGGVYVQYGTVSSSVSSPFGNGSIESSGYGAGATLTWYGESDFYIDGVAQINWFDSDLNSATLGRQLVDGNRAVGYSLSVETGQKIEIGEGWSLTPQAQLAYSAIRFDDFKDAFDTSVSPENDHDLTGRLGLAINRDAEWLDAQGRRVAMHIYGIGNLYYGFAGASKVDVSSVRFVSGNERLRGGIGLGGTYDWADSKYSLYGETRFDTSLQNFGDSNVIAGYVGLRVRW

SEQ ID NO: 11903 - protein, 378 aa, Salmonella enterica
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTADEHLYGNGDRATVYTGGLKYDANNIYLAAQYSQTYNATRFGTSNGNNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 11904 - protein, 981 aa, Salmonella enterica
MKKHIILFIAIFFASVLHAQTINIRGTVTDTSNETLPGVSITIKGTQTGTVSDANGNYSIRAQRGNVLEFTFVGMVKQSVTVGKQNVINIQMAADAINLDEVVAIGYGIAKKSDLTGAVASIKSENLTNSKVGTVTTALQGLAAGVQVTTGSVKPGGDASVVIRGVGSLRAGSEPLYIVDGIPVQGGLQDLSSGDIESIEILKDASSASIYGSRGSNGVVLVTTKKGTSGKAKISLNASFGTQRMLNKQDLMNAQQYYELVSIAQPNYKWTSEELRLLSRGESTDWQDAVTQNGQYQNYNFSISGGKNDIQHFLGVDWYDQKGTIKNSSFNKLTVRYNMDAKLNKWLRYGVRFNVIESKLMNINEEADSGYGTMFSAISSQPTAPIYTEDGEYFDGFLNTRANPVAIVDLLDKATLKSRFVGSAYIEIEPIKNLKLRSDNGGELVFYKVNTYEDGRMGQHYTAGGHANVMSNKKRYWQTENTATYSFDINKEHQLSAMAGFSASRTDYEEVTADSKKLSSILKYYNLQGAEEHGPNSSYAVPSSLVSFYGRFNYNFSNRYLATLTMRGDGSSRFAPGHRWGFFPSLALAWRASEESFIKENAPVISNLKLRISAGKLGNQNIGDFAYAPTIALGGASANYILGNNLVTGSVQTSISNPELTWEKANQLDLGIDFGLFNNRIAGTIEAYYKRTTDLLWEVPLPLESGFGTSLTNIGKIDNKGIEFTLNTVNISTKDFLWTTAFMISYNNNKIKELYDGKQDVNKTLFVGRPIGQFYLLKSEGIWQTNEAAEAAKYNAQPGDRKILDAKKDYVINGEDRDFCGVSTPKYYGSFTNTFSYKGIDLTAFFTFAGGHKINNSLNRYLNSFNVWGNMSENYYKYYWRQDRPNNKYPAPRVGSAYANGDGTDANLQKGDYLRLRNLEIGYSLPKNVIRNIKASNIRVYFSVQNLFTATEFTGFDVESSDNTNPYPNARSFIGGISLNF

SEQ ID NO: 11905 - protein, 706 aa, Salmonella enterica
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVYYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11906 - protein, 721 aa, Salmonella enterica
MSVYAQAAVQPKEETITVTAAPAAQESAWGPAATIAARQSATATKTDTPIQKVPQSISVVTAEEMALHQPKSVKEALSYTPGVAVGTRGASNTYDYLIIRGFAADGQSQNNYLNGLKMQGNFYNDAVIDPYMLERAEVMRGPVSVLYGKSSPGGLLNMVSKRPTTEPLKEIQFKMGTDSLFQTGFDFSDALDEEGVYSYRLTGLARSANAQQDRAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRYAENKVSQNSVYGYGVCSDPANRDSKQCAALAPEDKGHYLARKYVVDDEKLQNFSVDTQLQSKFATGEVDHTLLTGVDFMRMRNDINAWFGYDDSVPLLDLYNPVYTDFDFASRDPATSGPYQILNKQKQTGLYVQDQAQWDKVLVTLGGRYDWADQESLNRTTGITSKRDDKQFTWRGGVNYLFDNGITPYFSYSESFEPASQTGENGKIFAPSKGKQYEAGVKYVPNDRPIVITGAVYQLTKTNNLMADPAGSFFSVEGGEIRARGVELEAKAALSASINVVGSYTYTDAEYTTDTTYKGNTPAQVPKHMASLWGDYTFFDGPLSGLTLGTGGRFTGSSYGDPANSFKVGSYTVVDALVRYDLARVGMAGSNVALHVNNLFDREYVASCFQTYGCFWGAERQVVATATFRF

SEQ ID NO: 11907 - protein, 751 aa, Salmonella enterica
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 11908 - protein, 656 aa, Salmonella enterica
MTQKRTLLKYGILSLALAAPLSACAFDSLTVFGDSLSDTGNNGRWTWDSGQNKLYDEQLAERFGLALSPSNNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEAAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGQLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLSDGNQTRYNVGFSARF

SEQ ID NO: 11909 - protein, 377 aa, Salmonella enterica
MTIKITALAASIGAAVAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGATDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGVDYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11910 - protein, 186 aa, Salmonella enterica
MIIRKYFLIIALLLMPWLAIPSVSAADKGGFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 11911 - protein, 650 aa, Salmonella enterica
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKRGKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDNRISISRTADVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 11912 - protein, 381 aa, Salmonella enterica
MKRKVLALMVPALLMASAANAAEIYNKNGNKLDLYGKVDGLHYFSDDASEDGDQTYVRFGLKGETQITSELTGYGQWEYNIQANTSEKEGANSWTRLGFASLKFADCGSLDYGRNYGVVYDIESWTDMLPEFGGDTYTQTDVYMTGRTNGVATYRNSDFFGLVDGLHFALQYQGNNENAGSGEGTNNGGKRKLARENGDGFGISSYYDLDMGISFGAAYSSSDRTHNQLAAARSSQRYANGDKADAWTVGAKYDANNIYLAAMYAETRNMTFYGNDSFGGIANKTQNFEVVAQYQFDDFNLPLRPSVAYLQSKGKDLYAYSRYGDKDLVKYVDVGMTYYFNKNMSTYVDYKINLLDEDDRFYKNSGIATDDIVALGLVYQF

SEQ ID NO: 11913 - protein, 788 aa, Salmonella enterica
MALLFCGQLMFAQEKTPLHDQQLTQIVKGTVTDRISGLPLGSVTVRISSAANVKSVSSNDKGEFQLFKVPLGRQTIQASLTGYQQLIISELLVSSGKEAVINMEMEPQNNRLSEVVVSASSNKKPLNQMALTSARSFSPEETNRYAGGFFDPARMAQSFAGVVAGGDDNQIIVRGNSPKSLQWRLEGIEIINPNHFGNEGASGGAISMLNTTVLSTSDFYTGALPAEYSNASAGAFDLKFRKGNTDKREYALTIGVLGAGLAMEGPFKKGSDASYLVSYRYSSLSLLEKAGLSVADQGVPKYQDLSFNIVVPTKKAGTFSLFGIGGLGALNDDAERDYTKWEERIDGQDVNFKFDAGSAGLKHLYIANDNTYFSNILSYSVNRSASMIDTLSNEYLPALREHTQYTNTAIRYAGIINYKLNNTNTIRAGVNASLLSYNLYALGYDTERKSTRQLLDQDGQTSSFDTFLQHKASLNNSMTLNTGIHASYFVLSKTWSVEPRIGLNWQLEHSQTLSFATGIYNRIEPLSYYFAKNEKAPAVGVPPSEKLKPTKSAQAVLGYEKLLGGNLKFKTEVYYQYLYDVPVSADPSINFSLLDVSDNYAILSSSYRSLVNKGSGKNYGLELSLEKSLTNGYYYMLTTSLFDSKFKALSEKEFNTTFNTQYVANLVVGKEWKAGKDGRNLFGLNSKIIYAGGRKYSPLQIEETFRLDEEVIDQSKINTLTADPYFRIDFSGSYRINSKRVNHLLILDIQNLLNKENTLGMHYNPSKRIIEPAKWIGMVPTLNYRLEF

SEQ ID NO: 11914 - protein, 724 aa, Salmonella enterica
MRVKKFIWLITVVSTGINSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLISYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMTVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11915 - protein, 403 aa, Salmonella enterica
MNRKVLALLVPALLVAGAANAAEVYNKNGNKLDLYGKVDGLRYFSDDAGSDGDQSYARIGFKGETQINDMLTGYGQWEYNMQASGTEGNRDTSWTRLGFAGLKFGEYGSFDYGRNYGVIYDVEAWTDVLPEFGGDSYTQTDVYMLQRANGLATYRNTDFFGLVEGWNFALQYQGNNESGNNGFGQEGSGNGTNRGTNKENGDGFGLSTSYDFDFGLSLGAAYSNSDRTDAQVGNGYGDGHRYYGNNDAGGETAEAWTVGVKYDAYDVYLAAMYSETRNMTSYGDSDYHSADGKLGGGGIANKTQNFEVVAQYQFDFGLRPSIAYLQSKGKDLGGQDMDSHGNYRYTDKDLVKYVDVGMTYYFNKNMSTYVDYKINLLDEDDDFYTNNGIATDDIVGVGLVYQF

SEQ ID NO: 11916 - protein, 350 aa, Salmonella enterica
MNKSTLAIVVSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFDIVDGLDLTLQYQGKNEDRDVKKQNGDGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAIGLTYQF

SEQ ID NO: 11917 - protein, 239 aa, Salmonella enterica
MKNFFAVCIASLLVTNVVTASAKEGAYITGKAGASVVNLYGINSTFSQDEIVNGHATLPNRTKGVFGGGVAIGYDFYDPFQLPVRLELDTTFRGETDAKGGQDITAFGEPVHINVKNQVRMTTYMVNGYYDFHNSTAFTPYISAGVGLARVKLKNNTIPVGYDINETLSASKNNFAWGAGIGAKYAVTDNIAIDASYKYINAGKVSISKNNYAGDEHTSYYADTKAASNDFMIGITYAF

SEQ ID NO: 11918 - protein, 656 aa, Salmonella enterica
MTQKRTLLKYGILSLALAAPLSACAFDSLTVIGDSLSDTGNNGRWTWDSGQNKLYDEQLAERYGLELSPSSNGGSNYAAGGATATPELNPQDNTADQVRQWIAKTGGKADHNGLYIHWVGGNDLAAAIAQPTMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYETAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 11919 - protein, 304 aa, Salmonella enterica
MIIRISIALFFIFIPCVYFFITYISNNTHIEQVQPLKLETDNNESVIHSEEVTEKEVPIKCQELESSSPSVFQVANQKNMWPSIADQAEPTKEKSKKLDFYVSANGGKIYSDNSEVFVEGIREIGKRILALAEGRYGSFLLDLFLGDEIKNIKKFNGKIDFQWLSSISVGYYAGENGRVDFETMYSKVNIEDSNSPPVFDKSASVSAFLLNFYYNPNVQNTQFAPYIGLGIGSTVFRLKRIDKSSKNLVPLNVPWFAYQIKLGVDYSIIPEVKTFFGYRYFSIPIPIADDISTHNIEVGLMFNF

SEQ ID NO: 11920 - protein, 174 aa, Salmonella enterica
MKRRSSFLVFLGLLLASPLALANDQHTVSFGYAQTHLSSLKNSDSKDLRGFNFKYRYEFNETWGMLGSFTATRNEMENYTWKEGKLHKNGSDSVDYGSLMFGPTYRFNDYVSLYGNAGIATMKFNKHSKEDSFAYGAGVIFNPVKSISIDASWEASRFFAVDTNTFGVSVGYRF

SEQ ID NO: 11921 - protein, 312 aa, Salmonella enterica
MKKHAIAVMMIAVFSESVYAESALFIPDVSPDSVTTSLSVGVLNGKSRELVYDTDTGRKLSQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11922 - protein, 350 aa, Salmonella enterica
MNKSTLAIVVSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFGIVDGLDLTLQYQGKNENRDVKKQNGDGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLNSDNTLGINDDDIVAIGLTYQF

SEQ ID NO: 11923 - protein, 403 aa, Salmonella enterica
MNRKVLALLVPALLVAGAANAAEVYNKNGNKLDLYGKVDGLRYFSDDAGSDGDQSYARIGFKGETQINDMLTGYGQWEYNMQASGTEGNRDTSWTRLGFAGLKFGEYGSFDYGRNYGVIYDVEAWTDVLPEFGGDSYTQTDVYMLQRANGLATYRNTDFFGLVEGWNFALQYQGNNESGNNGFGQEGSGNGTNRSTNKENGDGFGLSTSYDFDFGLSLGAAYSNSDRTDAQVGNGYGDGHRYYGNNDAGGETAEAWTVGVKYDAYDVYLAAMYSETRNMTSYGDSDYHSADGKLGGGGIANKTQNFEVVAQYQFDFGLRPSIAYLQSKGKDLGGQDMDSHGNYRYTDKDLVKYVDVGMTYYFNKNMSTYVDYKINLLDEDDDFYTNNGIATDDIVGVGLVYQF

SEQ ID NO: 11924 - protein, 178 aa, Salmonella enterica
MNKMLLAGSTGIVLLSAAASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSNVAITLGYEGADFDATHNSGSLNSNGFNLGVGYRF

SEQ ID NO: 11925 - protein, 381 aa, Salmonella enterica
MKRKVLALVIPALLAAGAAHAAEIYNKDGNKLDLYGKVDGLHYFSDDSSKDGDQTYMRVGFKGETQINDQLTGYGQWEYNVQANTTEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTDAGYAGGVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 11926 - protein, 1976 aa, Salmonella enterica
MQKKKLISIAIALTLQSYYIPAIAAENNDDEKECPSNISSLPKEKRAKLSPTCLATPENDNHWGWVAGGVAALVAGVAIGVENNGGGDSNHSYTPPKPDNGGDVTPPDDGGNVTPPDDGGNVTPPDDGGDDNVTPPDDSGDDDVAPPDDSGDDDVTPPDDSGDDDVTPPDDSGDGDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSATGGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGNIYLDGLVPTLDDENNITSTSYWQPSSLYLTSSGMVAGSTDADGDATAINTGNITVNNAGFGMMALNGGTAINQGVINLTADAGVEGTDPNQLVGMAALNGGTVVNDTTGKINIYADYGKPFLTDGNSLIVNYGTVCFGDDCQDSDEYNPTNSDVSIPYTDGATIADAGTSTTLDNKAVVTGDVNNAGAISGESITVLDSGTLTNNDSGVIDSDITVSGNLVNDGVINGTLTQNGGDIVNNGTIDSRSLTTNGVLTNGTDGTMTSGAKVTGANSAIINDGTFYLGSATDAKNASMLEINDFAQFFNTGTLILDNNKNAIHLNANNGTLYNTGTMELTATSNKGAINYWGAGATFINDGTVNATTAALAYAGGGAGNAPDKHAFFWNQSNGVINYDADNGRAVDFSAYNNYVAVNDGTMNISGNNAYGMYGGKNAQLVNNNTINLGTEGTTDTGMVAMALDKNATANAVIENNGTINIYANNSYAFSVAGAGHVVNNGTVVIADGVTGSGIIKQGDSVNVEGTNGNNGNSDEAHYADYTLPETPVEPGSNTTSGFAAGDTSGASNNLNGYVVGTNADGSAGQLKVSNASMEGVGINTGFTAGTADTTVSFDNVVEGSNLTDASAIQSTSVVWNAQGSQDSDGNVDVTMTKNAYADVATDGSVSDVAQALDAGYTNNELYTSLNVGTTAELNSALKQVSGAQATTVFREARVLSNRFNMLADAAPQIKDGLAFNVVAKGDPRAELGNDTQYDMLALRQKLDLTENQNLTLEYGIARLDGDGSEKAGDNGLTGGYSQFFGLKHSMAFDEGLAWNNSLRYDVHNLDSSRSVAYGDVNKIADSDARQQYMEFRSEGVKTFSLMDDALKVTPYAGVKFRHTMEDGYKERNAGDFNLSMNSGSETAVDSIVGMKLDYAGKDGWSATATLEGGPNLSYSKSQRTASLQGAAGQSFGVDDGQKGGGINGLATIGVKYSSNDTALHLDAYQWKEDGISDKGFMLNVKKTFR

SEQ ID NO: 11927 - protein, 353 aa, Salmonella enterica
MKKIVLSALIAGLSPCLSHAQSSVTLYGDIGGGVRWVNGQKGGSAVMFNNNILTVNRFGLYGREDLGNGFAAIFKLENAFNSGTGALKSAGVLFSQAAFVGLSGSFGRLTFGRQVSASEYFATLVDPTGGQAQSLAIQPNALYFFNYFTNETRFNNTISYIGRAGGFRFGASYSPGGVAGNLRSGTNVSGTAMYQWGPALGGFGYQKTWNATATQWAQTFHAGGSLQLGPARLYMSYADFSVSAATERQPTRRDHIPSIGVMVVATPGLQFTAAAYYDSARHLANAKDGSGHKVTTYAIAEYYLSKRTELYAEVDYNGFSGAYRTDAMNIAGLGMRNGASSTTGVTLGLMTRF

SEQ ID NO: 11928 - protein, 703 aa, Salmonella enterica
MSVYAQAAVQPKEETITVTAAPAAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNEGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 11929 - protein, 803 aa, Salmonella enterica
MKRRSQLAVLIAALLPASVLASTIEGVVLNNKGKVVSNATVEVEGSDLKVTTDENGKFVIAELNNGLKELHIVAPGYAHLHRDITIINDEKQSVTFNLKRSPIEVIDIEATPIHMSAMESASPVSVLSGEQLRRQQAATLGDSLEKLPGVNTNFHGKVASTPIIRGLSGPRVLITQNGLDVSDVSRVGPDHSVASEASTAQQIEVLRGPATLFYGSGAIGGVVNVVDNRVPTDSTTRGEWNLEHNSADNQKVASFNATTGTDSVAFYADAFWREADDYEVPVAADIDSDDEEHRGDYKVENSNEESDGFTVGASYLMDNGFIGLAVEQFNRQYGIPGHTHGDEEEEEHSDEEESVFADLEQTKVQLLGEYNLDNKWLNKVNLRVGHTDYEHAEIEGGAVGTTFKNETNELRIDLLHNQFSEWNGGISFHYKQSDVEAQGEEAFTPPSETESFAVALMEERHFGDFLVQVGGRIERVTIQAGDVLLPHIDAHAHDEAQEADEHDHYHEESAETTRVFDVEHEFTPISLSAGVVWDFTPNYNLGLSVSRSERAPSASELLSFGPHIGTGTYEVGALFDLDEDGHLGLSSQTIDLETANNIDLTLRKTQGDVGFILNTFYNQVDNYYYQIDTGLFAESGHDHGDEEEGVDEHDHSSELPVYLFKTDDVILHGFEAQIAWQLTDEFKVDLFSDYVRARLKDGGDLPRTPPLRFGSELSYETDKLSAHIHVTRYQKQDRTAPQETATDGYTLVDASISYDLSVLNQDMSVYLRGTNLTDTEARVHSSFVKDIAPRPGRSFALGIRGYF

SEQ ID NO: 11930 - protein, 696 aa, Salmonella enterica
MFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11931 - protein, 203 aa, Salmonella enterica
MYNGQGANRAERNDSMHAVVHATYPFKFANGQYLEVGADAYAGRFVPTAAAVNIGGLSFTPAITAPTGYTDQRVAAHIIYYPQPFGLQAEWTVGRGPELDVAQRRIRTRSLSGGYVQAMFKHDVTYGTLLPYVKWQSYRGGSTFDTNAPRMRLDEVEAGVEWQPMDALELVFASSKMKRTDVSTAPYPVVEGDLLRLQLQVND

SEQ ID NO: 11932 - protein, 388 aa, Salmonella enterica
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNFMTGRANGVATYRNTDFFGLVDGLNFALQYQGKNESQSADDVNIGTNNRNDSDDIRYDNGDGFGISTTYDIGMGFSAGAAYTTSDRTNEQVNASSTIAGRTIAGGDKADAWTAGLKYDANNIYLATMYSETRNMTPYGKTDKGYDGGVANKTQNFEVTAQYQFDFGLRPAVSFLMSKGKDLTYNNVNGDDKDLVKYADVGATYYFNKNFSTYVDYKINLLDDDDPFYKDAGISTDDIVALGMVYQF

SEQ ID NO: 11933 - protein, 178 aa, Salmonella enterica
MNKMLLAGSAGIVLLSAAASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSSVAITLGYEGADFDATHNSGSLNSNGFNLGVGYRF

SEQ ID NO: 11934 - protein, 234 aa, Salmonella enterica
MIVRKRRGRRTLRCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLALTDPLWHASVSTLGWRVNSQFGDVRPWAQISYNQQFGENIWKAQSGLSRMTAGNQAGNWLDVTVGADVLLNPHMAAYAAFSQAENSATDSDYLYTLGVSARF

SEQ ID NO: 11935 - protein, 1940 aa, Salmonella enterica
MQKKKLISIAIALTLQSYYIPAIAAENNDDEKECPSNISSLPKEKRAKLSPTCLATLPENDNHWGWVAGGVAALVAGVAIGVENNGGGDSTHSYTPPTPDNGGDVTPPDNGGNVTPPDDGGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPTDNSVTTFSNGVTIDKGKDTLAFDSFKLDNGSVLEGAVLNYSEQDDQWQLTTEDGKTLNVTGWDVTDANAAVIEGTQENGLYWKYDSRGYLIIADDNTTVITGDGESHTSDRGMDISGQDRTGVIISGDRTVNTLTGDSSVTDGATGMVISGDGTTNTISGHSTVDNAIGALISGNNTTTDFSGDITVSGGGTAIIIDGDNATVQNTGTSSISGAGSTGTTIDGNNARVSNDGDMTITDGATGGHIIGDNAVIDNVGDTTVSGAGSAALYVDGDNTLIINEGDQTISGGATGTRIDGSKARIANTGDIAVDGAGSAAVVINGDNGSLTQAGDLLVTDGAMGIITYGTGNEAKNTGNATVRDQDSVGFVVAGEQNAFRNKGNINVSLNGTGALVSGNTSQVTLDGDINVISVQDSDGVFRGATGVNVSGDSNTVNIAGNVNMSAEFEQNSLIAGDTPLTGVTVNGANNDITLDGTFDINVGDLSTVSGQALSVIGLNVTGEGNNVDIRGGISITHSQNTDGSVSIVTGINLNGDSEVTLSGQSTIDTATMIGGAVTLAKVSNGGSLILDDNSIIDINVNYIDVSASINNALLVANGENSSIANQGDITSHGVYSIMRVDNGATIGNSGEILVYATSNGGGDDRTAVARADDAGSVIHNQSGGDITIISDQQPVKYKGFSFFPLKWYNHTFYAMLASGYGDVVNDKDAAIHLQGAGVYGVSAIKGAALNAGDIYLDGFVPTLDDEGDITSTSYWHPSSLYLTSAGMVAGSTDGGDGDATATNTGTINVNNAGFGMMALNGGTAINQGTINLTADEGVTKIDDNQLVGMAALNGGTVINDTTGTINIDASYGKPFYADDSSVVVNYGTICVADSCQNSSQYNPTDPMVSFAYNDGLLSAYGENIKLNNNILILGDVGNEGAVATEKVNVTDSGYLTNSASGEITSFVVAENGGKIDNRGKITSVDVEEGGTLTNSGDISDTLTVGGGASAINSATGSVNHIDMWKGSLDNQGYIGTLILQNTSGAVSNTGVIDVVNFKAATVFNNNGTVNDLAVASGATVNNLSGGVVSIPEQMWKGTLNNWGEVNGTMDIANGTFTFYNAGTFNGNIKTASAKGGMVENDGVINVTGNNVVAMSASGSAKMVNNGEINLGTKGTTDTGMIGMQLESNASSSAVIENNGTINIYASNSYAFSQLGSNGHIVNNGTVYIDDSVTGSGFIKQSGKTIEGSGENGDGTEVHYVDFIAPTEPTINDGMATVTTGDSAGSSTTNNLSGYVVGTSADGSAGKLKVSNASMNGVEINTGFAAGTADTTVSFDNVVEGSNLSDAGAIQSTTVVWNAQGSQDSDGNVDVTMTKNAYADVATDASVSGVASALDAGYTNNELYTSLNVGTTAELNNALKQVSGAQATTVFREARILSNRFNMLADAAQQIKDGLAFNVVAKGDPRAELGNDTQYDMLALRQKLDLTTSQNLTLEYGIARLDGDGSKTAGDNGLTGGYSQFFGLKHSMAFEEGLAWNNSLRYDVHNLDSSRSVSYGDTNKVADSDVRQQYLEFRSEGAKTFTLMSDTLKVTPYAGVKFRHTMEDGYKERSAGDFNLSMNSGNETAVDSLVGLKLDYAGKDGWSATATLEGGPNLSYSKSQRTASLQGAAGQSFGIDDGQKGGGVNGLATIGVKYSSNDTALHLDAYQWKEDGISDKGFMLNVKKTFR

SEQ ID NO: 11936 - protein, 650 aa, Salmonella enterica
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 11937 - protein, 437 aa, Salmonella enterica
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGRIPSDTKIAHLNGNQWGFGWNAGILYELDKNNRYALTYRSEVKIDFKGNYSSDLPIAINQFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 11938 - protein, 312 aa, Salmonella enterica
MKKHAIAVMMIAVFSESAYAESTLFIPDVSPESVTTSLSVGVLNGKSRELVYDTDTGRKLSQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLLKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11939 - protein, 724 aa, Salmonella enterica
MRVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDKIIGRSASGAYVLQWQNGGKALIEGIEASMTVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11940 - protein, 253 aa, Salmonella enterica
MKKILTLTLSSLLIIPALTHAEFKGGFADIGLHYLDWTSDTTEKTSKKSHKDDFGYLELEGGANFSWGEMYGFFDWENFYNGRHAKPSSEQRYTFKNTNRIYLGDTGLNLYLHAYGTYGSPHRANFHDDMFLYGLGYNFTGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 11941 - protein, 614 aa, Salmonella enterica
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSERWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 11942 - protein, 697 aa, Salmonella enterica
MTQIKNMKFKKSLLCFLILSGALLQAEETYQLNDVVVSASGFEQDLVDAPASISIITKEELEKKPIKDIGEAIGDIPGVDVTMDKTGTYDFSIRGFGSSYTLVLIDGKRQSVANGFYTNVFKGSESGYLPPLSMIERIEVIRGPASTLYGSDAVGGVINIITKKNPDKIEANIEFNTLLQQHSNHYGNAGGFNAYVATPLIEDTLSISARLKYYDKAASDLKWPTPVWNNNNQKPDNYQQRPDNYQIAIHSPGAFTSLGFGSRLNWTVDDKNNIYFDIERYINEISVNSISSRAIKSEKQLFKDNIVLNHDGNYDFGSTNSYLQYGSTKDKELHSQIWVGEGKVVLPWNLGQYGNLVNTFGARIDYEMLKNDQASAGSQIRGKNLDQTTVALYGENEYFITDDLIFTTGLRYIYSNLFDSEFTPRIYLVYHLNDNIAFKGGVSKGYKTPSAKQLTNGYYNYANGNAHFGNPDLKPEESINYELGADFRVFDFAHYSITGFITDFTNQISSEYLTGMQNGINCSNGTVCKRPINLGKTQTKGIEFAFNTKTYNGFSLNSSYTFMDNRYKDSQKNWFGGDRIENLPRHIAMLKLNYERGKFNSYIKTRARLDTVAKARVGGNGSLPWQKYKPFYIVDLGINYKINKQSSLSFAVQNLFDKNFFDPQVTKWAGANPAGYANRYQDYTEGRSFWLSYKYDF

SEQ ID NO: 11943 - protein, 230 aa, Salmonella enterica
MKINRYLLGMVSFIAFSSYLQAATLDYRHEYADRTRINKDRIAIIEKLPNGIGFYVDASVKSGGVDGEQDKHLSDLVANAIELGVSYNYKVTDHFVLQPGFIFESGPDTSIYKPYLRAQYNFDSGVYMAGRYRYDYARKTANYNDDEKTNRFDTYIGYVFDELKLEYKFTWMDSDQIKFDNKKTNYEHNVALAWKLNKSFTPYVEVGNVAVRNNTDERQTRYRVGLQYHF

SEQ ID NO: 11944 - protein, 724 aa, Salmonella enterica
MSFIQYRRDKHLQSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIIDADLGATTSLSAGYEYQKIDVNSPTWGGLPRWNTGGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11945 - protein, 185 aa, Salmonella enterica
MKNIILSTLFITTSVLVVNVAQADTNAFSVGYAQSKVQDFKNIRGVNVKYRYEDDSPVSFISSLSYLYGDRQASGSVEPEGIHYHDKFEVKYGSLMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 11946 - protein, 1129 aa, Salmonella enterica
MNRKTIVTKVASFAKAFCLAGLLSVPVYSSASTVSFEKLNGIYILKAENSTVKQVFDYIEKHSKYVFVYDQSVKERLEYKVNIELQGKSIDTILAEVCRLANLKYYIQNRQVTITVNSSPKPTTKVKKTKHISGQVVDVTELPMIGATVRVKGSDVATITDLDGKFQIDVHEGSELLISYVGYMDKIVRIDSKNMYAVVMEEASKTLNEVVVIGYGAVKKKDLTGAVAAVKGEELVNKRTAMLSNALQGSLSGVMVTRNSSAPGSGAASIRVRGITTMGESSPLVIVDGVQSSLDYVNSNDVESISVLKDAAAASIYGSKAAAGVILVTTKRGNDSGKINLKYNAEFGWEIPTKQPGMVGVTRYLEMSNELKYNDNPTGGFFQEYTADQTKNWVKYNAVDPNHYPITDWTDLILKSSAPRMTHTLSVSGGNKTVKSVATLSYDEVDGLYDGRGFQRYMFRSNNDFNINDKLSAQIDVNIRHAKSSTKNYDPFDTMRKMPAIYPATWDDGRLASGKSGSNPYGLLVAGGNSVAHSTQVAGKGSLTFKPVKGLSISGIVSPFINYQKKKAFKNSCGYTLADDPETFGGYFDSGSTWTTNSLTETRKDDYHVTSQVIANYMGTFGSHDLTVMAGFENYYMKDEELTAARDKYELTGYPYLNIGSEDFQTNSGKGSEYTSNSVFGRVIYSYADRYLFQANIRHDGSSRFAKGYRWGTFPSFSAGWVMSEEKFMKSLNWDWLSFLKLRGSWGILGNERIGDDYFPYIALMSFGNSLFYMADGSVVSDKTARPAILAVEDITWETTTSTDFGLDANFFNNRLQFHFDYYWKQTKDMLLKIEIPYFMGYNNPNTNAGKMSTHGYDIELAWNDRIGDLQYGVNVNFSDFLSKIDYMNDGEQISNGKIKRAGVLFNEYYGYVCDGIYQTQEEVNNSARTSTTVTVGDLKYRDISGPDGVPDGIISPEYDRVPLGNSLPRFQYGGTFNASYKGIDFSIAFQGIGKQNSYLSTAMVQPLRDNYGSVPSIIEGKYWSPFNTAEENLSARYPRLSNVSKSNNYATSSFWMFNGSYFRLKNLTLGYTLPETWTQKAGIDRVRFYISGSDLFCLSNFPDGWDPEMGASSYPITTSLVMGLQVNF

SEQ ID NO: 11947 - protein, 673 aa, Salmonella enterica
MSRFPKHLSALPRPNHAPRTSGRLRALSFLLPALPLLAGPVQASPLDLDITQMSLEQLMEISVTGASKYEQKQSEVAAAVSVITRDEIRTYGWRTLAEALASLPGVHTTYDRQYSYVGARGFGLPGDFNSRLLLTVDGNRANEVVYGTALMGREFLVDLDLVERIEYIPGPGGAVYGQNALFGVVNVVTRTGADVNGGEVALAHSTLDSGNEGRATWGGVLDNGVDVLLSASAYEAEGRDLYFDYGSSGVAGVASGMDGERDKQFFGRAGRGPWSFDFSYGERRKDDPIAAYKSDPLVPGQYAEDRHLLTQLQYQDRFAGGTLQVSGRLFLGRERFRGLFHRSGDAHRYAFSSDWQGMEVRLVSTARADHKTMFGFEYQDNARQDQSVVGAAAGVMIPGAGWRAGVYAQDEWTLTETLSATLGVRADRSDVSGSALSPRLALVWQMTPDTTLKAMYGRAFRAPNALESNLGDGVTQLPNPNLDAERIDTLELLAEQRVTPSLRLRATAYRWTMQGLVTLAGLPGGFTQYQNGADIEARGVELSADKTWDWGGRIRGSLSRQDACYADGPVLLNSPRLLGKLNVSSPVPQTGLRLGYELQYSADRRAVDGTDVPGYWLSNLNLVADKWARGLELSLGLYNLLDRDYAQPGSAFNWQNVFEQDGRSARLKAVYRF

SEQ ID NO: 11948 - protein, 721 aa, Salmonella enterica
MSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLFNLYNPVNPDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 11949 - protein, 403 aa, Salmonella enterica
MNRKVLALLVPALLVAGAANAAEVYNKNGNKLDLYGKVDGLRYFSDDAGSDGDQSYARIGFKGETQINDMLTGYGQWEYNMQASGTEGNRDTSWTRLGFAGLKFGEYGSFDYGRNYGVIYDVEAWTDVLPEFGGDSYTQTDVYMLQRANGLATYRNTDFFGLVEGWNFALQYQGNNESGNNGFGQEGSGNGTNRGTNKENGDGFGLSTSYDFDFGLSLGAAYSSSDRTDAQVGNGYGDGHRYYGNNDAGGETAEAWTVGVKYDAYNVYLAAMYSETRNMTSYGDSDYHSADGKLGGGGIANKTQNFEVVAQYQFDFGLRPSIAYLQSKGKDLGGQDMDSRGNYRYTDKDLVKYVDVGMTYYFNKNMSTYVDYKINLLDEDDDFYANNGIATDDIVGVGLVYQF

SEQ ID NO: 11950 - protein, 698 aa, Salmonella enterica
MFMFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNNNQRGAAFDVTGPLDDNERVAARLSGMTRYADSQFTPLKEERYALMPSLTWRITDRTRLDLMAYLHRDPQGGSHSGLPYQGTVVPYNGRKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11951 - protein, 719 aa, Salmonella enterica
MGDNRTMTRTFAWLSTAALCAFVAPAFAQAPDAASAPDEETIVVTGTYTLQNKIDTATGLGLTTLETPQSVSIMTAQRILDQNLITVKDVITNAVGVSANEFDDVRNSFFARGFEIRNTQVDGVPAAWTLAGGNGETSIDVSIYERVEIVRGATGLLSGAGDPSASVNLVRKHADATELTGYASASIGSWDTWRLSADVAGPLTADGRVRARLVGRYEEGDSYIDIQHRKKWVLYGVVDADLTDTTLVRAGISHQDTKPRGITWGALPTFYSDGSVTDLPRSQTTAADWTYWNTTNQNIFATVRQEFGDRWNLTLNYNRLKNTGDTQLLYLYGTVDKDTGTMDGTNPYKSSGQSIQNSFDAQLKGLVPLFGRDHEVVLGALHSVLKRHTDNFEAPLPWLTDLPVIGQEGVPYPEPIWGTTPVRNEQERIKQTGYYGAMRLNIADPLKVILGGRIASWKQTGYAWGATSDYGDDNVFIPYVGALYDLTPNHRVYASYTKIFQPQNLYDRERRLLDPLDGNAYEIGLKSSFFGGALQTSVALFRIEQDNVGQMDGPQIIVDGLLFQPYRAAAGVVSKGFELEATGQPMPGWNVNASYSQFKAEDADDVPANTDQPRKLLKIFTTYDLGGALDGLTVGGGINYRSKAYSDGANPVTGAAFRFQQDGYTLVALMARYAVTPQLQLQANVDNLFDEKFYSNMGSFSQYRYGAPRNFTIGATYRF

SEQ ID NO: 11952 - protein, 710 aa, Salmonella enterica
MFRFNNILLCTSALVLTLPAVAATTSGKAVHGTKGHPAVPPSVVRVRHVVPSSDPESIQVYRRKNAFGQLAMQHQSVSVTHIDSTELARHQVTDVKGLMNLAPNLTVQPQGSSSAVNFTLRGVGLNDFTANNTPSVMTYVDGVTLPIGYMAGAAMFDMAGVDVSTGPSGFTHGQTVTAGEINIKTADPTKTFHYGASEDIATYDRSITNLYVSGPLSSNVQYRIAGFTQQGGGFQKNINTGQSLGNANKGGLRAKVAWQPDDRTNIVFSSNWMQDDSQAMGAYNIQDLARNTPTYQNNRNTGWGFTPDFLKITGNSAGTKPSYNNTFWGAGVNFTRNLGFADLSTISAFQQMYVHNLMDLDGTRYAIYDDDVNTDANLFSQEVKLASRNPHDRLQWNVGMYYDRTQMHSVIFNDYTGSGSRPYIQRTSYNQDQQAFSQYGHLRLTVTKRLHLLAGITHESDDRDLYNMQTMRYNTAIYPTPFDNHYGRRGALTNQFSGMGGIEYQALDNLMFYGSIRKGFKPGGFTANNTVVASQLNPTKPESLLAYEVGFKSDYWNHKIRLNGDAFWYDYHGQQVAGLAVVSNYGVVGQYVNIPKSRIWGVEMEIDANPIPGLLLHQHFGYERGNYEDYSAIDSTAVAATYIRTGKLVALYRSYAGVDMGIPKLTLEGSASYKAKLGTRWTLTSYLDYSYRGSQLDGRGTTCTGCRSIS

SEQ ID NO: 11953 - protein, 312 aa, Salmonella enterica
MKKHAIAVMMIAIFSESVYAESTLFIPDVSPDSVTTSLSVGVLNGKSRELVYDTDTGRKISQLDWKIKNVATLQGDLSWEPYSFMTLDARGWTSLASGSGYMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11954 - protein, 950 aa, Salmonella enterica
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGSPGVIFGNDLTIRTQSANAANNGRDVDGIRTHGANTPDNPVFIITGDRTRIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLSDDDSETDRLQVLGNTSGNTFVAVNNIGGAGAQTIEGIEIVNVAGNSNGTFEKASRIVAGAYDYNMVQKGKNWYLTSYIEPDEPIIPDPVDPVIPDPVIPDPVDPDPVDPVIPDPVIPDPVDPEPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQLGGDLAQWSTDGLDRWHIGAMAGYANSQNRTQSSVSDYHSRGQVTGYSVGLYGTWYANNIDRSGAYVDTWMLFNWFDNKVMGQDQAAEKYKSKGITASVEAGYSFRLGESVHQSYWLQPKAQVVWMGVQADDNREANGTLVKDDTAGNLLTRMGVKAYINGHNAIDDNKSREFQPFVEANWIHNTQPASVKMDDVSSDMRGTKNIGELKVGIEGQITPRLNVWGNVAQQVGDQGYSNTQGLLGVKYSF

SEQ ID NO: 11955 - protein, 234 aa, Salmonella enterica
MIVRKRRGRRTLRCLACLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLALTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 11956 - protein, 992 aa, Salmonella enterica
MHSWKKKLVVSQLALACTLAITSQANATTYDTWTYYDNPTTALDWSNMDAPGTVDGNYVNYSGFVYYNNTNGDFDTTFNGDTVNGTISTYYLNHDFTDGTTNQLNISNSLIHGSITSMLPMGESSDGHYVYQFSEYGTDRVIDDNWHDGDVFTLNIANSTIDDDYEGLYFTDSYLDGDVTKYTNETFHTPAGEGEEYAGLFANGGVGLGLAVNLDVESNINISNNSRVAGISLTQGNTVNNTYTTESHTWDNNISVTDSTVTSGSVTTLEDSGFYGNSAEPSDYSGNGEANDVALYFSDSAASNYSMKNNVYFSNSTLLGDVVFASTFNANFYPQGHDSNADGVLDTNGGWADDSLNVDELNITLDNGSKWVGSATTSANVDDESTASTDWYDVTGNSLYPGVVTEANAWGRTIDDQVFQSGVFNVTLNNGSEWNTVNASNIDTLAVNNGSQVNVSESSLISDSIALTNGSSLNIGDEGYVGTDHLTVDSYSTVALSSDDNSSIYNGYYTPSLLANTITVTNGGLLDINVDQFDDNPFQTDTLELTSGNIADHNGNVVSGVFDIHSSDYVLNADLVNDRTWDTSKSNYGYGIVAMNSDGHLTINGNGDMNNGDELDNSSVDNVVAATGNYKVRIDNATGAGAIADYKDKEIIYVNDVNTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 11957 - protein, 698 aa, Salmonella enterica
MFMFATTRMALLIGGAIGGATFPLSAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDVGGEVKLFAGNHNQRGAAFDVTGPLDDNERVAARLSGMTRYADSQFTPLKEERYALMPSLTWRITDRTRLDLMAYLHRDPEGGSHSGLPYQGTVVPYNGRKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTFGGRYDRVSVSNIDKLHDSRSDLDKNNVSTRAALLYLFDNGVAPYLSYSTAFTPTSFADENGNVLEPMKGKQWEAGVKYEPLGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11958 - protein, 350 aa, Salmonella enterica
MNKSTLAIVVSIIASASVHAAEVYNKNGNKLDVYGKVKAMHYMSDYDSKDGDQSYVRFGFKGETQINDQLTGYGRWEAEFAGNKAESDSSQQKTRLAFAGLKLKDIGSFDYGRNLGALYDVEAWTDMFPEFGGDSSAQTDNFMTKRASGLATYRNTDFFGIVDGLDLTLQYQGKNEDRDVKKQNGDGFGTSVSYDFGGSDFAVSGAYTLSDRTREQNLQRRGTGDKAEAWATGVKYDANDIYIATFYSETRNMTPVSGGFANKTQNFEAVIQYQFDFGLRPSLGYVLSKGKDIEGVGSEDLVNYIDVGATYYFNKNMSAFVDYKINQLDSDNTLGINDDDIVAIGLTYQF

SEQ ID NO: 11959 - protein, 239 aa, Salmonella enterica
MKNFFAVCIIPLVVAWSATASAKEGIYITGKAGTSVVNVYGINSTFSQDEIVNGHATLPDRTKGVFGGGVAIGYDFYDPFQLPVRLELDTTFRGETDAKGGQDIIAFGDPVHINVKNQIRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKVASNDFMLGITYAF

SEQ ID NO: 11960 - protein, 186 aa, Salmonella enterica
MIIRKYFLIIALLVMPWLAIPSVSAADKGWFNTFTDNVAETWRQPEHYDLYVPAITWHARFAYDKEKTDRYNERPWGVGFGQSRWDEKGNWHGLYMMAFKDSFNKWEPIGGYGWEKTWRPLEDDNFRLGLGFTAGVTARDNWNYIPIPVLLPLASIGYGPATFQMTYIPGSYNNGNVYFAWMRFQF

SEQ ID NO: 11961 - protein, 584 aa, Salmonella enterica
MTQKRTLLKYGILSLALAAPLSACAFDSLTVFGDSLSDTGNNGRWTWDSGQNKLYDEQLAERFGLALSPSNNGGSNYAAGGATATPELNPQDNTADQVRQWLAKTGGKADHNGLYIHWVGGNDLAAAIAQPTMAQQIAGNSATNAAAQVGLLLDAGAGLVVVPNVPDISATPMLLEAVITAGLGAAAPPALKAALDALAEGATPDFASRQQAIRKALLAAAATVSSNPFIQQLLVEQLLAGYETAAEQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGRLWGARLTSGYDFVMMPWLTTGPMLQYAWDYSHVNGYSEKLNQIKRVIILASVMDRSSSIIIDWQRSCFKCKYNVLISSSLVAK

SEQ ID NO: 11962 - protein, 706 aa, Salmonella enterica
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQNVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGLNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDEEYIGSVIVNESNGRYYEPAPGRNYGVGINLAWQFE

SEQ ID NO: 11963 - protein, 403 aa, Salmonella enterica
MNRKVLALLVPALLVAGAANAAEVYNKNGNKLDLYGKVDGLRYFSDDAGSDGDQSYARIGFKGETQINDMLTGYGQWEYNMQASGTEGNRDTSWTRLGFAGLKFGEYGSFDYGRNYGVIYDVEAWTDVLPEFGGDSYTQTDVYMLQRANGLATYRNTDFFGLVEGWNFALQYQGNNESGNNGFGQEGSGNGTNRGTNKENGDGFGLSTSYDFDFGLSLGAAYSSSDRTDAQVGNGYGDGHRYYGNNDAGGETAEAWTVGVKYDAYNVYLAAMYSETRNMTSYGDSDYHSADGKLGGGGIANKTQNFEVVAQYQFDFGLRPSIAYLQSKGKDLGGQDMDSHGNYRYTDKDLVKYVDVGMTYYFNKNMSTYVDYKINLLDEDDDFYANNGIATDDIVGVGLVYQF

SEQ ID NO: 11964 - protein, 1035 aa, Salmonella enterica
MKKDVVSKVWQLIFLLALSIPMSGFAQAIQVKGTVLDASGMTVIGASVLEKGTTNGVITDMDGNFELSVSPKGTLVISYVGFQTQEIAVNNQRNFKITLKEDTEVLDEVVVVGYGTMKKSDMTGAISSVDVDELTKRTTTNPAEALQGKIAGVNIMKSGGNAGAGVSVKIRGVKSFGDNEPLYIIDGFPGDINSVNPVDIQSMEVLKDGAAAAIYGSVAANGVVIITTKNGKKGETHIDFNTYLSMTTVAKRMEFLNAEQYKSTIKQMYINAGREDEIPAYCTTDTGVDTNWQDEMMRNGLSQNYMFSVRGGGETAQYSVSYNHADDKGIFLGNDFRQDNARMKLHMSKYIFDLDANLGFRYTKSHQPTYSLKEVYNISPLVPVYDENEKYGFGLTASQGLPSNNNPMADYYYQDETEKTFSTTANVSLGIKITSWLNFKTSYAYRGKHYRYTLHYPDYISNAQQTHLYPYNSESTYYWEEQTIDNILNFNKEFGKHSLNAMIGSSITSTKNTSNGVAVEGFATRYTVDKNGNLVSTNEPSGFLDPSFDTIDAGKGGTYTGEGTKYEYNRASFFGRINYNFDNRYLIQATMRYDGSSKFGKNNRWGCFPSIALGWRISEEKFFPKNTFINNLKFRVSWGRLGNENALGYYDFQALISSYNTYYGGYVQGSGSNPWAGAVAWNMERNDLKWETTDTKNIGFDYAMFNNRLTGSINYYINQTEDLLITKKLSPSAGYQNPILNVGKIRNRGFELELNWNDRIKDFEYGIGFNLSTTHNEVISLADKGQALYCTGLVYGTDYTPAYATEGKPISAFYLYRTDGIFQSDAEAAAYVNANGERLQPNAKAGDIRFKDINGDGVLDENDREYCGTGIPKVEANLNLTAGYKGFDLSLLFGSAWGHKLFNGNRYFYESMQTPGQMLTSVLDAWTPTNTDTDMPRAVLNDPNRNARESDRFLENGNFVRLRQAQLGYTLPTNILKKAYIEKLRFYISGENLFTITKYSGTDPEFSRSSPLDTGIDSYIFPFTRSFTIGAQLTF

SEQ ID NO: 11965 - protein, 724 aa, Salmonella enterica
MSFIQYRRDKHLPSTAAPSLLAMGMAMAFMPAAFAAEDTVIVEGATTADAVNREEQDYSVKMTAAGTQMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYSSWNKQRYVMDLQSPLTADGNVRGRIVAGYQNNDSWLDRYNSEKAFFSGIIDADLGATTSLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKYDWMNSRLTTTLSVFRIEQDNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTTYGTFRAEQGSYALVDLFTRYQVTKNFSVQGNINNLFDKTYDTNIDGSIVYGAPRNVSLTANYQF

SEQ ID NO: 11966 - protein, 724 aa, Salmonella enterica
MRVKKFIWLITVVSTGVNSPLSAAESTDDNGETMVVESTVEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTVTSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11967 - protein, 721 aa, Salmonella enterica
MSRFPLIRLHLSGIFMKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTTKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11968 - protein, 1983 aa, Salmonella enterica
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVIDGNNARVNNDGDMTITDGGTGGHITGDNVVIDNAGSTTVSGADSTALYIDGDNALVINEGNQTISGGAVGTRIDGDDAHTTNTGDIAVDGAGSAAVIINGDNGSLTQAGDLLVTDGAMGIITYGTGNEAKNTGNATVRDADSIGFVVAGEKNTFKNKGDIDVSLNGTGALVSGDMSQVTLDGDINVVSVQDSEGVFSSATGVNVSGDSNTVDITGNVNISADYGQDDLAAGAPPLTGVVVGGNGNTVTLNGALNIDDNDLSATGGQYLDVVGLSVTGDDNDVEIDGGINITHSEDPFDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGAEVSNSGDILVYATSSNSSEDRAAITRASGEGAAVHNKAGGDITIISNQTPQGNGGIGTYPLEWYTHTFYAMMASDYGDVVNDEGATIHLQGAGVYGVAASKGTASNAGDIYLDGFVPTLDDENNITGTNYWKPSQLYLTSSGMVAGSTSSGNGDATAINTGNITVNNAGFGMMALNGGTAINQGVITLTADDGVTGQANELVGMAALSGGVVINDTSGIINIDADYGQPFLTDSSSTVVNYGTVCYDSACQNSDEYNPTDSNVSLSFSDGDEITAEGETLTGETIITNPIATQTVHVTNAGIVSGGKVTVRNYGDVTNESTGSISSVGIDKGGVYTNEGTTAAVSVDGGVFNNTGTVTGKTGTTVAGSIINNSGSMNAVEQWASTMNNIGTVSAWVGASGSTVLNNYSGGEIDKLNFTGAATVNNAGIINNGSVDKGGTFNNLEGGVVTLINDGLWAGAFNNWGTVNSDADIATGGSGHTLYNGSTGVINGQITTAKNNGGSKAINDGTINIDKTGNVAMSAHGSAKMVNNGTINVGTVGTTQTGMVGMQLESDAKSDAVIENNGTTNIYASNSYAFSQLGSNGHIVNNGTVYIDDSVTGSGFIKQDGKTIEGSGENGDGTEVHYVDFTAPTEPTITDGTTTVTTSDSADSSATNNLSGYVVGTSADGSAGKLMVSNASMNGVEINTGFTAGTADTTVSFDNVVEGSNLSDAGAIQSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 11969 - protein, 696 aa, Salmonella enterica
MFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNNNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPPGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 11970 - protein, 751 aa, Salmonella enterica
MNKKIHSLTLLVNLGIYGAALPVMAEEKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWDNGVTTSNWVQYEHTRNSRMPEGLAGGTEGIFDPKASQKYADADLNDVTLHSEVSLPFDLLVNQNLTLGSEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 11971 - protein, 656 aa, Salmonella enterica
MTQKRTLLKYGILSLALAAPLSACAFDSLTVIGDSLSDTGNNGRWTWDSGQNKLYDEQLAERYGLALSPSSNGGSNYAAGGAMTAPELNPQDNTADQVRQWLANTGGKADHNGLYIHWVGGNDLAAAIARPAMAQQIAGNSATSAAAQVGLLLDAGAGLVVVPNVPDISATPELLEAVITAGLGAAAPPALKAALEALAEGATPDFASRQQAIRKALLAAAATVSSNPFIQQLLVEQLLAGYEKVAEQASALTDYYNQMEEKGLEQHGGNIARADINGLFKEILANPQAFGLTNTVGMACPPGVSASVCSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDGDLHYLSAKFSNIQRSITLGALRRVEEGETNGRLWGARLTSGYDFVMMPWLTTGPMLQYAWDYSHVNGYSEKLNTSTSMRFGDQNAHSQMGSVGWRLDLRHSIIHSWAQINYRRQFGDDTYVANGGLKSTALTFSRAGKAQDKNWVDIAIGADFPLSATVSAFAGLAQTAGLSDGNQTRYNVGFSARF

SEQ ID NO: 11972 - protein, 253 aa, Salmonella enterica
MKKILTLTLSSLLIIPALTHAEFKGGFADIGLHYLDWTSDTTEKTSKKSHKDDFGYLELEGGANFSWGEMYGFFDWENFYNGRHAKPGSEQRYTFKNTNRIYLGDTGLNLYLHTYGTYGSPHRANFHDDMFLYGLGYNFTGNGYWFKPFFAKRYTDQTYYTGDNGYVLGWVAGYSFSLGSEKFSVTNWNEYEFDRDASYAAGNGGKDGINGAVALWWNATPHLTAGVQYRYADNKLGESFLQDGIIYSIKYLF

SEQ ID NO: 11973 - protein, 312 aa, Salmonella enterica
MKKHAIAVMMIAVFSESVYAESTLFIPDVSPDSVTTSLSVGVLNGKSRELVYDTDTGRKISQLDWKIKNVATLQGDLSWEPYSFMTLDARGWTSLASGSGHMVDHDWMSSEQPGWTDRSIHPDTSANYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 11974 - protein, 724 aa, Salmonella enterica
MRVKKFIWLITVVSTGINSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTVTSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 11975 - protein, 223 aa, Salmonella enterica
MRKSLFLLLPLVVTNAHAVYVDVRHEYLDDSKANYDRAYISHRFANGVGFAIEAISKSGGDDTNKAFNDLETQGNEYTISYQFKTGDVAWQPGFVLETGNGYSTYKPYFRATWTLNESWWVGARYRFEYVRRSSDIRDDDTINRMDVWAGYKWNNFDWTIEGIYKKADKYDLYDGGKDNYEYNFRTAYIIDQWSPFVEVGNVSVNSNSDERQTRFRVGIGYTF

SEQ ID NO: 11976 - protein, 383 aa, Salmonella enterica
MKRKVLALVIPALLAAGAAHAAEIYNKDGNKLDLYGKVDGLHYFSDDSSKDGDQTYMRFGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNDGDDIRYDNGDGFGISTTYDIGMGFSAGAAYTTSDRTNEQVNAGGTIAGGDKADAWTAGLKYDANNIYLATMYSETRNMTPYGKTDKDYAGGVANKTQNFEVTAQYQFDFGLRPAVSFLMSKGKDLTYNNVNGDDKDLVKYADVGATYYFNKNFSTYVDYKINLLDDDDPFYKDAGISTDDIVALGMVYQF

SEQ ID NO: 11977 - protein, 363 aa, Salmonella enterica
MMKRKILAAVIPALLAAATANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADGSADLAKYIQAGATYYFNKNMNVWVDYRFNLLDENDYSSSYVGTDVQAAVGITYQF

SEQ ID NO: 11978 - protein, 223 aa, Salmonella enterica
MRKSLFLLLPLVVTNAHAVYVDVRHEYLDDSKANYDRAYISHRFANGFGFAIEAISKSGGDDTNKAFNDLETQGNEYTISYQFKTGDVAWQPGFVLETGNGYSTYKPYFRATWTLNESWWVGARYRFEYVRRSSDIRDDDTINRMDVWAGYKWNNFDWTIEGIYKKADKYDLYDGGKDNYEYNFRTAYIIDQWSPFVEVGNVSVNSNSDERQTRFRVGIGYTF

SEQ ID NO: 11979 - protein, 178 aa, Salmonella enterica
MNKMLLAGSTGIVLLSAAASPVWADDNASTFSLGYAQSHTNHAGTLRGVRLANNYEMSPDWGLTTSFAWLNGSQRYSDESSNGRVTTRYYSLLAGPSWKINNQLSLYSQVGPVLLHQRDHGINESDSKVGYGYSAGVAYTPVSSVAITLGYEGADFDATHNSGSLNSNGFNLGVGYRF

SEQ ID NO: 11980 - protein, 234 aa, Salmonella enterica
MIVRKRRGRRTLRCLAGLMACSFFINTTYAWQQEYIAEAAPGHTTERYTWDSDHQPNYNDILAERIQSTQNTVGPVLSLADETPLDATSGISMGWNFPLSRRVTTGPVAALHYDGSTSSMYNEYGDSATTLAFTDPLWHASVSTLGWRVNSQFGDVRPWAQISYNQQFGENIWKAQSGLSRMTAGNQAGNWLDVTVGADVLLNPHLAAYAAFSQAENSATDSDYLYTLGVSARF

SEQ ID NO: 11981 - protein, 1982 aa, Salmonella enterica
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDVTPPDDGGNVTPPDDGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDKTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVINGNNARVNNDGDMTITDGGTGAHITGDDVVIDNAGSTTVSGADATALYIYGDNALVINEGNQTISDGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVNVSGDSNAVDITGNVNISADYGQDALAAGAPPLTGVVVGGNGNNVTLNGALNIDDNDLSATSGQYLDVVGLSVTGDDNDVEIDGGINITHSEDPRDGTSSDVTGISVSGNSTVTLNGHSTIDTNTLVGGHVVLARVNNGGSLILGDDSVVDVNVSYIPTGFFTYNALLMADGEGTSIENKGDITSHGVYSVIRADNGAKVSNSGDILVYATNSNSSEDRAAITRANGEGSAVHNKAGGDITIISDQTPQGSGGDGAYPLKWYTHTFYAMLATGDGDVVSDKDATIHLQGAGVYGVSASRGTASNAGDIYLDGFVPTLDDENNITDTNYWKPSQLYLTSSGMVAGSTDADGDATAINTGTITVNNAGFGMMALNGGTAINQGVITLTADDGVEGQANELVGMAALNGGTVINDTSGIINIDADYGQPFLTDGSSTVVNYGTVCYDSACQNSDEYNPTDSNVSLSFRDGDEITAEGETLTGETILTNPVATETVHVSNAGTVSGGQVIIKNYGDVTNESTGSISSVSIETGGIYTNDGTTAAVSVDGGVFNNTGTVTGKTGTTVAGSVINNSGSMNTVEQWTSTMNNTGTVTAWTGASGSAVLNNNTGGEVDKLTFTAAATVNNAGVIKNGSVDKSGTLNNLEDGVMTLADNGLWSGTFNNWGTVNSDADIATGGNGHTLYNGSTGVINGQITTSKNNGGSKAINDGTINIDKTNNVAMSAHGSAKMVNNGTINVGTVGTTQTGMVGMQLESDAKSDAVIENNGTINIYASDSYAFSQLGSNGHIVNNGTVYIDDSVTGSGFIKQDGKTIEGSGENGDGTEVHYVDFTAPTEPTITDGTTTVTTSDSADSSATNNLSGYVVGTSADGSAGKLMVSNASMNGVEINTGFTAGTADTTVSFDNVVEGSNLSDAGAIQSTSVVWNAQGSQDADGNVDVTMTKNAYADVATDGSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDSYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 11982 - protein, 706 aa, Salmonella enterica
MKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 11983 - protein, 362 aa, Salmonella enterica
MKLKLVAVAVTSLLAAGVVNAAEVYNKDGNKLDLYGKVHAQHYFSDDNGSDGDKTYARLGFKGETQINDQLTGFGQWEYEFKGNRTESQGADKDKTRLAFAGLKFADYGSFDYGRNYGVAYDIGAWTDVLPEFGGDTWTQTDVFMTGRTTGVATYRNTDFFGLVEGLNFAAQYQGKNDRDGAYESNGDGFGLSATYEYEGFGVGAAYAKSDRTNNQVKAASNLNAAGKNAEVWAAGLKYDANNIYLATTYSETLNMTTFGEDSAGDAFIANKTQNFEAVAQYQSDFGLRPSIAYLKSKGKNLGTYGDQDLVEYIDVGATYYFNKNMSTFVDYKINLLDDSDFTKAAKVSTDNIVAVGLNYQF

SEQ ID NO: 11984 - protein, 372 aa, Salmonella enterica
MKKVVVLSAVAAAVMMAGAANAAEIYNKDGNKLDLYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDVNGLGSFDLVKYIDVGSYYYFNKNMSAYVDYKINLLKDGNPSNPNTDNTVALGLVYEF

SEQ ID NO: 11985 - protein, 656 aa, Salmonella enterica
MTQKRTLLKYGILSLALAAPLSACAFDSLTVIGDSLSDTGNNGRWTWDSGQNKLYDEQLAERYGLALSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGQLWGARLTSGYDFVMMPWLTTGPMLQYAWDYSHVNGYSEKLNTSTSMRFGDQNAHSQVGGAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 11986 - protein, 377 aa, Salmonella enterica
MTIKITALAASIGAAVAFMPFATQAEITVLKQDPQAGNPLSRLNFTVGGSIRPQFQNMTGNDGANGYKRNGFDGGTRFRFAADYYLFDDVSWISYYELGVNIPAVFDWDNHYAKGATDTTRRMLYTGFKSATWGTLTFGQQNSIYYDVVGVKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 11987 - protein, 961 aa, Salmonella enterica
MHSWKKKLVVSQLALACTLAITSQANATTYDTFGYHDDAATVFGWDDTNDHDYLTYGGYVYNTPASDSGYFDTKFTGDTVNGVISTYYLNHDYANDTANTLDVTNSTIHGMITSYQMGYGQYVWTNGSDYTTHDWVDDDTFNLNISNSTIDDDFEAFYFTDTYLDSDGKTVKTDYDKLVTAGLGTAITLDVESNINITNNSHVAGIALYQNDLGNSTYTTEAHQWDNTINVANSTVTSGSWSEDEEQGHFGNSSEPSDYNGNGWNKDDVALAFVDDPYSNYRMVNNVTFTDSQLLGDVVLESSWNYNFYSNGRLVDDSTTVYTNGGWADDDQNVDHLTLTLNNTKWVGAAVNYSQSMDPVQFYDVDANSLDPDSTNYDAWGRVNSAASFQSGIFDVSLNNGSEWDTTKTSVIDTLAVNSGSQVDVANGSNLTADTTTLNGGSAMNIGEGGYVDTDHLTVDTFSTVTSADDVSSAWSDDALYANTITVTHGGMLDIQTNNTNADSVIDTDTLELTSSNVADNNGNVYAGVFNIHSNDYTLNADLVNDRTWDTTQANYGYGVVAMNSDGHLTINGNGDINNGDEADASSTTDNVVAATGNYKVRIDNATGAGSVADYKGNELIYVNDINTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 11988 - protein, 724 aa, Salmonella enterica
MSFIQYRRDKHLPSTAAPSLLAMGMAMAFMPAAFAAEDTVIVEGETTADAVNREEQDYSMKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGTTTNLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 11989 - protein, 690 aa, Salmonella enterica
MFLTARQPFIACLGVFLPLVTFAEDQDAYVLDAVTVQAQPGPTAQGKVDLEREQALTPGGVTLLEAEDLTERNVVSIGDMLRYVPGMWTGTGSTGDDTFISSRGSNLDAVAYDGNGIKLMVDGLPVTAADGNNHNSFIDPLAARYAVIARGANALTYGASTLGGAINFISPTARNTDNQIYLSGGSHGTVQSRITAGGVEGDLDGLVTVEQRSYDGFRDHQEQQRGSVYANTGWQINDAVENRFYFTYVDNDQELPGSLTQAQFDDDPYQANPNNIPGNFLKNVESWRVANRTQWQLSDTSNLVVGFSFEDQHLYHPIVENPFFSLLIDNDQTTFGTNIRYDKQLGNHDLLFGLNYGETRVKGGNYSHTGGIRGALDVRVDNKADNLEIFAMDRWHFADRWTLIYGAQAVTGTREVDNVTVASGAERNPKDDYESINPRVGVIYQVADRSELFANVSKLYEAPTLYELEDDADASDETLNAMQGVVGEIGTRGAAPLGQASEWNWEVSVYYAQLEDEILSMDNPSASGTSLALNVEDTIHAGVEALVGASFALGNDGQRIEPLLSMTYNDFTFDNDPEYGDNQLPVAPTFFIKGEVMYRHGNGFFAGPTFDIVDDRYGDFANNKDVDGYELLGLRTGVTRDSWEVYLEGRNLTDEVYVTNVSVSNDETINPVGIQAGEPRSVYAGVRFDF

SEQ ID NO: 11990 - protein, 239 aa, Salmonella enterica
MKNFFAVCIIPLVVAWSATASAKEGIYITGKAGTSVVNVYGINSTFSQDEIVNGHATLPDRTKGVFGGGVAIGYNFYDPFQLPVRLELDTTFRGETDAKGGQDIIAFGDPVHINVKNQVRMTTYMVNGYYDFHNSTAFTPYISVGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 11991 - protein, 864 aa, Campylobacter jejuni
MRGQASILAGSDPLYVVDGFPIVGDISSINPDEIENISVLKDAASTSLYGSRAANGVVLITTKSGKTERGSLSLSYYGGVQIVPERGRPDLMNGTEFAQFRKESFEDLGQPVPEPFQNPEQYGEGFDWYDAMFVAAPIQSLNLNWNSRTERSSVAIVAGVFNQDGVMVNSNFKRYSLRANSTFKLNDNLNLGISVAPNYSIDNLPSSDGAFYATNVNSGIPGGLVTNAMQTWPILPFENPDGTLPLTAWIPGVSAFPTPNWYRAAKEITNETKSTRILGNLFLEYRPIEGLTLKTSINGDFGNSSFFNYSPSTSSTTFTALPPVIATSIRRENKYLSWLNENTATYNKSFGNHNFELLGGISYQKYEGDNSQLYLSNFPDDRIRTIQSALNIDRTASFNNINHWSLSSYFSRLNYDYDGKYLVTLALRRDGSSRFGSNNRWGNFPSVSAGWVFSDESFLENADFLSFGKIRASYGVIGNNNIGNYTQYALVDNSINAVFGNTVASGAAVTTLGNANLGWERTKQFDIGLDLRFFNNRVEFIYDYYKKNTTDLLFNVAIPQESGFSNFNDNVGEIEFWGHEFAIVSRNVANDNFTWNTNFNIAFNRNKVVALAEGVDRIFSPGGNYTSITRAGEPLGQFWGLIHDGVYDNQAEFDSSPRAVESEVGTIKFADVNGDGVITFGNENDDRTVIGNPFPDYIFGITNDFKYKNWDASVVISGSVGNDIAVTTDQGLTNLDGVFNVLRDVQDRWRSPENPGSGRYGKTTSATFMERDWFSSRFIEDGSHLTVKNITVGYNFPVKEDGLLQRARVYASVQQAFVFTKYRGSNPEISTTTQGQQAGALSLGYDWGSYPVPRTFTVGFNLSL

SEQ ID NO: 11992 - protein, 172 aa, Campylobacter jejuni
MNINRDKIVQLVDTDTIENLTSALSQRLIADQLRLTTAESCTGGKLASALCAAEDTPKFYGAGFVTFTDQAKMKILSVSQQSLERYSAVSEKVAAEMATGAIERADADVSIAITGYGGPEGGEDGTPAGTVWFAWHIKGQNYTAVMHFAGDCETVLALAVRFALAQLLQLLL

SEQ ID NO: 11993 - protein, 755 aa, Campylobacter jejuni
MKKLSLFCAVGLCFASFAFSEELEFDSLEISGSKIKNDEKPFVTPGATSTREGIGSDTQSIDSIVRSIPGTYTNTDQAQGTVQVNIRGMSGFGRVNTMIDGVTQTFYGSASDDPARFHSQTGTSAFGAVIDTNFLIGVDVTRGTFEGVGGANALMGSANFKTIGINDIVHDGNIFGFLGRFSYGSNGIGPSYMSAVAGKTELENNGYVGALFGYSAKRITQNYTVGGGGKIGSSMVDTDGDGIADTNIAPFDPDFLTQKPNSQLFKLEYVPNSFTNTIFSYRRYQNELAGRKIHNDNYQLDFWHNPNEWLNVNTLIAYNQGIQTYGSKSTFAANDAIANTKAKNTATTFDISDTLEGEWHRFNLNTRFGANILLNDYKNTLNTSIQGVNSIPFQPRGKQNLFTYYLDNSLNYGIFTLDTNVNLLDWNIKGHRPACDEVNFMCFPKAATDIDKNGLRLNASVMLSAAIHELFTPFVSFARTNRAPNVQEMFFSNNEGNGINSFLKPEQANTWQIGFNSFKHGLLKDDDRFGFKAVYYHTKIKDYIYNEQFYLEDPSKDPPSSQFYMHLNSADDTIFKGVELELSYDLGFAYAKAMYSRQDTSSTISQTSGPLLGSFSASKIMELPKDYANVELGFRLNDKISFGGIAKYTGKAKRVNPNTDDWNKDPNNPYYPKPTTQDLPKIPIIVDLYWNIEWFKNLTMRAEVQNLFDKNYMDALNAYNSLDNQLQYNGAGDPIYLFSNSARGRTFIVSFEYKY

SEQ ID NO: 11994 - protein, 696 aa, Campylobacter jejuni
MKKICLSVCAIGLLSSNAISQNVELDSSIVSASGFTQDIKEAPATINVISKKELQSKPYRDVAEAIADIPGVDLYASKGKTGSYNITMRGITGYTLVLIDGRRQGIGGEVGPNGFNEISNSLLPPISSIERIEVIKGPMSTLYGSEALGGVVNIITKKVSDKWETSVSLDALLNENKDWGNTYGTSIYSSGPLMNDKLGLTLRFREFYRQQSNVEFTNGSGQRVQGDQAQSPTKANNFNIGTRISYLANDYNTFIFDIDFSRNHYDNKQGQLGTITSPGRTPGSLTGGYADIMEVDKFVTYLSHEGIYENFSITSTLQYNRVSNNGREVVGQATQPFLGENRDIVAEDIILDTKSVIPLGQSHILSAGGEYRLEKMQDKIANPTNFDQYLLAIFAEDEYSIKDNLRLTFGARYNHHEIFGNNISPRAYLVYNPTDELTLKGGVSTGFRTPYANRLINGAYNYSGQGRFPIYGNPDLKEETSLNYEIAAIYNNDLFYVSATGFLTNFKDKISTQRYDKGNMIPGIGTCDADRCFKAINHGKVEYKGIELGAGISPLDNLNVNFAYTYLDTEVKEAQDRSVIGKPEQDSLKHNIMLKTEYSFYNKFTPWIKGEWQIDRYMGDTNINREYYKDIFLASMGVRYDINKQWSINAAIYNLFDKSFTNGWESYASGSGSTWVNTYNRIEEGRRMYISINGNF

SEQ ID NO: 11995 - protein, 184 aa, Campylobacter jejuni
MNISNDVSIGSRVAMLNNPFGTYASKMNGLKFAALDSDMRPSYVNEYTNSVWANAFGGANIIDGDSGAMYGATIGVDKQANDDVLWGVYFTYTNAKIKDNNLEQKSDNFQLGMYSTINIAPQWELNLKAYAQVSPTKQDNVQIDGAYNSDYTSKFLGLSANAGRVFDFSDNTLFIKPFAGVLLF

SEQ ID NO: 11996 - protein, 706 aa, Salmonella enteritidis PT4
MKIISVRQRLYPALLLPLTFSPVLQAASASNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWRFE

SEQ ID NO: 11997 - protein, 801 aa, Salmonella enteritidis PT4
MPTPFSRLRTGRVKTLGLRLGGLVLALAFQGEALAEEFDFDIPAQPLNSALKELGRQGDLQILYNPDDVNGKFSGPVHGRLTPEQAVADLLKQAGVTHNLEADTLTLGSAASAHPMNLGPVAIKGDPFGITTEGSGSYATTGVSINKTSQSLRETPQSVTVMTRQLMNDKNLNGLDEVMAQTPGITFSQRNFGSHVFSSRGFALEDESYTIDGVAGQGYSVTGWMTPDTEIYDRVEVLRGAAGLLIGAGNPGGAVNLVRKRPTALPQFSITTRAGSWDQYRVDLDGSSKLNDSGSVRGRFVTSYEDRGYFIDGLKKTAPLLYGILETDLSEDTTLTLGLRHQSADTHGYSIFGLPRYSNGKAIDLPRSTSLAQDWNRHQTRTDEVFSELETRFDENWSGTLSATHSDGAFDQKVAYAKGAIDPATQSGSRLVRTLFRSDTLQSDGFDSHLDGRFDAFGLTHQLTIGGNWSEQKRDSRYATVNSNRPLDIFNPDHDAIAEPARPAWRSTDYSDKRYGVYSNLRLSLTESLSLVMGGRVSWYDYQSQSAGVTTRAQEENQVTPFVGVIYDLNRDWSWYASHTDIFLPQSGYRTASGAFLDPAIGASHETGIKGELFDKRLNVSFALFYVKQKDVAVEDDANAGQCLSNDAYGTCYVNGDIRRSKGIDMEISGEPLPGLQTLAGYTFNLTRGSDGKSISAETPRHMLRLSSSYNLPGTWRRLTVGGGVSAQSGYSEHESTQPIDNPGRATWDARASWKIDEHWSVALNGNNLLDRKYYKATGDIDRGNYYGDPRNYVLTLRGDF

SEQ ID NO: 11998 - protein, 730 aa, Salmonella enteritidis PT4
MGMKRVAHLRLVAVLGTSALALLAGGQAYAQEAVAPQEQATEASVFGDIVVTATKKANAQNVQDVPIAVTAFGSEQLESQHVRTLDNLGYSAPNVQLDDVGTAPGFANFSIRGLGINSSIPSIDPTVGVFVDGVYMGISAGILFDTFDLEGVEVLRGPQGLLFGRNVTGGAVVVRTSTPGNDLKIEGRLAAETGLNKIASAVVSGPLIKDKLAAKVAVYYNDDDGWFTNKFNGNKNFGASKTLIVRSALRYTPTSEVEAVARYEHGRVRGDGAVVSNFGLFRRESFGISVDEEGVTRNDWNQASLELNIDTDFGNGKITNIAAYRDFKGFVTSDIDSSPSYTFHADTLTRQDQWSNELRYAGTFGALELTTGLYYFQQDIDYIELRRLAAGALKISGGGKQHQKTFGAFVSTDWHVTDTVTLNGGVRYSWERKSAKVANLAGNLCDPIVTKTCSTYGFSNSKSWSDPTFRVGAQWQPTNETQAYAFFARGFRSGGYNFRNGNAAEAPGPFDAEKQNSFEAGIKQDFGRTLRLNLAAFHNTVLGLQREIIRPVLPIGTTQVIRNSANVRIQGIEAEAVLRVGDHLTFNGQFGYTKAKYTKILYDLTGDGAINAKDFALKPPRLAPWTYGVSANFAHEVTGGGEVTARLGYAHRDAAWSNDANTGLLSKADMVDANLSVETAGRRWKFSVYGTNLLNDQTEGNVSSLPFFAGSTFASINKGRVVGAEVLFRY

SEQ ID NO: 11999 - protein, 656 aa, Salmonella enteritidis PT4
MTQKRTLLKYGILSLALAAPLSACAFDSLTVIGDSLSDTGNNGRWTWDSGQNKLYDEQLAELYGLALSPSSNGGSNYAAGGATATPELNPQDNTADQVRQWLAKTGGKADHNGLYIHWVGGNDLAAAIARPAMAQQIAGNSATSAAAQVGLLLDAGAGLVVVPNVPDISATPMLLEAVITAGLGAAAPPALKAALEALAEGATPDFASRQQAIRKALLAAAATVSSNPFIQQLLVEQLLAGYEAAAGQASALTDDYNRMEEKGLEQHGGNIARADINGLFKEILAHPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQATVFSHLRAGQAWLDGDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLAQTAGLSDGNQTRYNVGFSARF

SEQ ID NO: 12000 - protein, 227 aa, Salmonella enteritidis PT4
MDSVMRKSLFLLLPLVVTNAHAVYVDVRHEYLDDSKANYDRAYISHRFANGVGFAIEAISKSGGDDTNKAFNDLETQGNEYTISYQFKTGDVAWQPGFVLETGNGYSTYKPYFRATWTLNENWWVGARYRFEYVRRSSDIRDDDTINRMDVWAGYKWNNFDWTIEGIYKKADKYDLYDGGKDNYEYNFRTAYIIDQWSPFVEVGNVSVNSNSDERQTRFRVGIGYTF

SEQ ID NO: 12001 - protein, 724 aa, Salmonella enteritidis PT4
MSFIQYRRDKHLPSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGTTTNLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRADTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 12002 - protein, 746 aa, Salmonella enteritidis PT4
MKINKLYALLLASGLGSFAPLVLADDTVDVGSVNVAGKQTLGNGHMIKEESAKGRSTVTKEAMDQMAPTANAVDKLKYTPGINVSSTDASGLSGTNFTMRGMNSDQVGLSADGFPINDSGDYSIYPNLMGDPENFSEVFVTQGSSEADGPHIGSSGGNIGLVTVRPTKDFGVFVKQSVGSNNLRKSFARLNTGELGGFKTWVSASHTEGDKWKGKGTLRADKIEWNTLFEDGNGNSTNAIVKYNLQENYNYNSVSKSQFQTQGRRLDYSESTVFKNGSVSQSYKLNRNPFESVTASVTQRFQLRDDLSLTFNPYYVWSNGGSFSGQTATTLSSTSSRAGNYDLSGLPSGTYYRPSWTETWRPGMTTKLKWDLNEEHSLDVGYWYERARQRQTQPFIGIKGNGAPENVWGDYNGSDQLVDRNGATVQGRHQYTVTPAQKLWVQDTWQATPDLTLTGALAYQYVERDGNNLGSLTDKPEKRDAKYHEFLPSFNAKYQVDPNNQAFYNVTRNMRTPPNYVLYNKGDSISLKPELSWNQELGWRYSEENMALSATLFYITFKDRQISTTDLNGDYVVANVGEVKNRGLELEWSGRLPHNFNYYASYTYTKSEQMDDLTNKNVLLPTSGKQLTNVPENMFNLSLGYDDSLYYGNVVGKYVGAFYGDLTNDEKISGRTVFDLNAGIHLPVDKKVLKSATLRFSMLNVFDKEYLASVRTMSFNSVRTNGLAPSTAYYNVGEERTAMVSLEAAF

SEQ ID NO: 12003 - protein, 400 aa, Salmonella enteritidis PT4
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNEDPGAGEGTTNGSDADSGTRKLARENGDGFGMSTSYDFDFGLSLGAAYSSSDRTDNQVASGRGDGHHYYGNSYSGGETAEAWTVGAKYDAYNVYLAAMYAETRNMTYYGGGDGGGGGGGIANKTQNFEVVAQYQFDFGLRPSIAYLQSKGKDLGGQDMDSRGNYRYTDKDLVKYVDVGMTYYFNKNMSTYVDYKINLLDEDDDFYANNGIATDDIVGVGLVYQF

SEQ ID NO: 12004 - protein, 663 aa, Salmonella enteritidis PT4
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLAAVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDDRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 12005 - protein, 1953 aa, Salmonella enteritidis PT4
MNPMQKKKLISIAIALTLQSYYIPAIAAENNDDEKECPSNISSLPKEKRAKLSPTCLATPENDNHWGWVAGGVAALVAGVAIGVENNGGGDSNHSYTPPKPDNGGDVTPPDDGGNVTPPDDGGNVTPPDDGGDDNVTPPDDSGDDDVAPPDDSGDDDVTPPDDSGDDDVTPPDDSGDGDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSDISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSATGGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGNIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTVNGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGKTKAIINNGEINLLCDSGCDIYAPGTTGTQNDHNGTADIVIPDATTAPTEGSIPTPPADPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVAQALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMGDALKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGVNGLATIGVKYSSNDTALHLDAYQWKEDGISDKGFMLNVKKTFR

SEQ ID NO: 12006 - protein, 702 aa, Salmonella enteritidis PT4
MPLEMFMFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVALTSRKPAFDAGGEVKLFAGNNNQRGAAFDVTGPLDDNERVAARLSGMTRYADSQFTPLKEERYALMPSLTWRITDRTRLDLMAYPHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREKHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPPGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 12007 - protein, 1004 aa, Salmonella enteritidis PT4
MHSWKKKLVVSQLALACTLAITSQANATTNDISGTTYNTFHHYNDATYADDVYYDGYVGWNNYATDSYYNGDIYPVINNARVNGVISTYYLDDGVTTNTNANSLTIKNSTIHGMITSACLEGTDCVNRDTGYVYDRLALTVDNSTIDDNYEHYTYNGTYTDGTADTHVVDVYGMGTAITLDQEVDLSIVNNSHVAGITLTQGYEWEDIDDNTVSTGVNSSEVFNNTINVVDSTVTSGSLSDEGTSGWFGNTNNASDYSGSYTADDIAIAAIAHPYADNAMQTTVNLSNSTLMGDVVFSSNFDENFFPNGADSYRDTDADRDTNGWDGTDRMDVTLNNGSKWVGAAMSVHMTDTGTDADGDGVFEYTVDTNGDGILDATSPDGVYDSYAVGTEATATLIDIAANSLWPLSTVGVDNIYTDYSEYNHIVGNEVYQSGLFNVTLNTGSQWDTTKTSLIDTLSINSGSVVNVADSTLVSDTIGLTGGSALNINEDGHVATDTLSIDNSTVTIADDVSAGWSVNDAALYANTINVTNNGVLDVGNSASNALQVDTLNLTSYTDANGYVNAGVFNIESNRFVLDADLTNDRTNDTTKSNYGYGVIAMNSDGHLTINGNGDTYDTDQTEAGQDEVDNVGDNVAAATGNYKVRIDNATGAGSVADYKGNELIYVNDKNSTATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVEGNLSYSHFNNDLSANMSDGTYVDGNTSSDSWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 12008 - protein, 2039 aa, Salmonella enteritidis PT4
MRNMYVVASELARGHSKVKAQVCASEIHSPNQKSEYGQIIKATRAALACAVAAALGFFSPLAMADNQVSYADAQTHVLDASTPPMSYSGTDEGAALYVSGVATVGWQPTTVTGTGLVIETSGGGADDPDGGKYVSNAISLDHYAILELTDAKITTTGIYTQGISAADGSKLTLTDSTLTIDGNFGVMTLYTGSEATLDGTIVEAANSSSAQVQQGSTLNVLDGSTITLAQGQINVVAGNTATDEGSTLNLSDSSVSSAGTMSTIQGTNKAALNLTNATITHTNASGAAVQANNATTLDISGGNITSAGMGVYILASDARIDGATINADGDGIFITSKKRSTSYEDLNALTVSDANVTSKTVALNIDGSTTINDPIELTNSTFTAPTAIKLGSKATIQAEKTMLTGNIVQTDASSSSLSLSQGSTLTGSVDAMFTTLSLDDTSQWNMTDPSTVGNLTNDGDITLGNASGSTGTLLTVDNTLTLQDGSQINATLDTANSSPIIKAANVTLDGTLDLSSTATFVAPETDEHFGSITLIDSQTAITTDFDSVTLDADTSAMPDYLTINAGVDANDNTNYELSTGLSWYAGAKSARAAHGTFTVDAGSTFTVTSELDETTATSNWNGSKLTKQGDGTLILSNTGNDYGDTEIDGGILAAKDAAALGTGDVTIAESATLALSQGTLDNNVTGEGQIVKSGSDELIVTGDNNYSGGTTISGGTLTADHADSLGSGDIDNSGVLKVGEGELENILSGSGSLVKTGTGELTLSGDNSYSGGTTITGGTLTADHADSLGSGDIDNSGVLKVGEGDLENTLSGSGSLVKTGTGELTLSGGNDYSGGTTIIGGTLTADHADSLGSGDIDNSGVLQVGEGELKNTLFGSGSLVKTGTGELTLNGDNDYSGGTTIDDGVLIADNADSLGTGAVANNGVLQVGEGELKNTLSGTGSLVKIGTGELTLNGDNDYSGGTTITGGTLIAASVNALGSGDIDNSGVLQVGEGELKNTLFGSGSLVKTGTGELTLSGDNTYSGGTTISGGTLIAANVNALGSGDIDNSGTLILDANGAFELANVTTHSGATTALAAGSTLDAGQFTQEDGSTLSIDLGAATDDAVITADSVALGGTLNVTGIGSVTDSWTPEAYTYTLIGSDSAITTDFDDLTVAGMNREDVDFLTIDGKVDEADNTHYDLTASLSWYADRDNATTDAHGTFTLSDPDGGFNVAATLTDVDDTLDPGSRWDGKSLTKEGAGTLILSGDNDYSGGTTINEGTLVAASTTALGTGLVDNNATLVLDVDGEVSAVGGITTHSGATTQLALGTSLDLGDSALIQQDGSTLNVELNSDSVQPLITGGSATLGGDLVVSDASLQARASDAEFQSFKLMDMDSDISGDFTSLTMNLTDQPDYLTVTGTINPADASEYLLTEGLSWNATATSATPAHGTFTLSAGDSFEVTSVLGDKTGNGDWDGKSLTKLGAGKLTLSGANTYSGDTNVQEGTLWLTGAGTIGEVGSQQAVNVASDATFGGSNGTTVNGKVTNEGTLVFGDSEETGAIFTLNGDLINMGTITSGSSSSTPGNTLYVDGDYTGNGGSLYLNTVLGDDDSATDKLVITGDASGTTDLYINGIGDGAQTTNGIEVVDVGGVSTSDAFVLKNEVNASLYTYRLYWNESDNDWYLASKAQSDDDDSGGDDTPSDGGDDGGNVTPPDDGGDGGNVTPPDDGGDGGDVTPPDDGGDVAPQYRADIGAYMGNQWMARNLQMQTLYDREGSQYRNADGSVWARFKAGKAESEAVSGNIDMDSNYSQFQLGGDILAWGNGQQSVTVGVMASYINADTDSTGNRGADGSQFTSSGNVDGYNLGVYATWFADAQTHSGAYVDSWYQYGFYNNSVESGDAGSESYDSTANAVSLETGYRYDIALSNGNTVSLTPQAQVVWQNYSADSVKDNYGTRIDGQDGDSWTTRLGLRVDGKLYKGSRTVIQPFAEANWLHTSDDVSVSFDDATVKQDLPANRAELKVGLQADIDKQWSVRAQVAGQTGSNDFGDLNGSLNLRYNW

SEQ ID NO: 12009 - protein, 239 aa, Salmonella gallinarum
MKNFFAVCIIPLVVAWSATASAKEGIYITGKAGTSVVNVYGINSTFSQDEIVNGHATLPDRTKGVFGGGVAIGYDFYDPFQLPVRLELDTTFRGETDAKGGQDIIAFGDPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 12010 - protein, 405 aa, Salmonella gallinarum
MKRRYPEVKLALACAAVLAAMPAFAQNSVTLYGIVDNGIGYQSSSTTLGSTSGGHSAVKMVTGVWAGSRFGLKGAEDLGGGTKAIFTLEEGFSAANGAMATNNLMFSRQAFVGVTNDNYGSLTAGRQYTSYYQLLSPYSPTTWLTGFYGAHAGDVDGLDTIYRANNTLLYMSPKLYGFKFSGSYSFAGVPGSAYQGSTWSTAVQYAQGPIGIAVGFSKINNSNVNGGTFGTDTATSNGGAQSGVSAVTNGYQTARAQQRFAVGAGYTFNSQFDITATYSNVQYIPGIGSSYRNLAIWNSGGIVLHWKPTAAWDFATGYAYTRATKSNGISSSASYSQVNLSEYYSLSKRTGIYALQAYQRANGQTLGTNGRSIINATATIGDGFNSTPSSSRSMVGVGAGIIHRF

SEQ ID NO: 12011 - protein, 1004 aa, Salmonella gallinarum
MHSWKKKLVVSQLALACTLAITSQANATTNDISGTTYNTFHHYNDATYADDVYYDGYVGWNNYATDSYYNGDIYPVINNARVNGVISTYYLDDGVTTNTNANSLTIKNSTIHGMITSACLEGTDCVNRDTGYVYDRLALTVDNSTIDDNYEHYTYNGTYTDGTADTHVVDVYGMGTAITLDQEVDLSIVNNSHVAGITLTQGYEWEDIDDNTVSTGVNSSEVFNNTINVVDSTVTSGSLSDEGTSGWFGNTNNASDYSGSYTADDIAIAAIAHPYADNAMQTTVNLSNSTLMGDVVFSSNFDENFFPNGADSYRDTDADLDTNGWDGTDRMDVTLNNGSKWVGAAMSVHMTDTGTDADGDGVFEYTVDTNGDGILDATSPDGVYDSYAVGTEATATLIDIAANSLWPLSTVGVDNIYTDYSEYNHIVGNEVYQSGLFNVTLNTGSQWDTTKTSLIDTLSINSGSVVNVADSTLVSDTIGLTGGSALNINEDGHVATDTLSIDNSTVTIADDVSAGWSVNDAALYANTINVTNNGVLDVGNSASNALQVDTLNLTSYTDANGYVNAGVFNIESNRFVLDADLTNDRTNDTTKSNYGYGVIAMNSDGHLTINGNGDTYDTDQTEAGQDEVDNVGDNVAAATGNYKVRIDNATGAGSVADYKGNELIYVNDKNSTATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 12012 - protein, 656 aa, Salmonella gallinarum
MTQKRTLLKYGILSLALAAPLSACAFDSLTVIGDSLSDTGNNGRWTWDSGQNKLYDEQLAELYGLALSPSSNGGSNYAAGGATATPELNPQDNTADQIRQWLAKTGGKADHNGLYIHWVGGNDLAAAIAQPTMAQQIAGNSATSAAAQVGLLLDAGAGLVVVPNVPDISATPMLLEAVITAGLGAAAPPALKAALDALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGQLWGARLTSGYDFVMMPWLTTGPMLQYAWDYSHVNGYSEKLNTSTSMRFGDQNAHSQVGGAGWRLDLRHSIIHSWAQINYRRQFGDDTYVANGGLKSTALTFSRDGKTQDKNWVDIAIGADFPLSATVSAFAGLSQTAGLSDGNQTRYNVGFSARF

SEQ ID NO: 12013 - protein, 751 aa, Salmonella gallinarum
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARYGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKNNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRSPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDVSLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 12014 - protein, 171 aa, Salmonella gallinarum
MKKIACLSALAAVLAFSAGTAVAATSTVTGGYAQSDAQGVANKMSGFNLKYRYEQDDNPLGVIGSFTYTEKDRTNGAGDYNKGQYYGITAGPAYRLNDWASIYGVVGVGYGKFQTTDYPTYKHDTSDYGFSYGAGLQFNPMENVALDFSYEQSRIRSVDVRTWIAGVGYRF

SEQ ID NO: 12015 - protein, 363 aa, Salmonella gallinarum
MMKRKILAAVIPALLAAATANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGAGGSADLAKYIQAGATYYFNKNMNVWVDYRFNLLDENDYSSSYVGTDDQAAVGITYQF

SEQ ID NO: 12016 - protein, 207 aa, Salmonella gallinarum
MKKIVTIAAAAAAFASSFAAPVFAQEAQSPWLVRVRAVHLSPENKSDPINGQGASDLITINSKTIPEVDISYFFTKNIAAELVLTYPQEQDVRLNGSKIGTFKHLPPSLLVQYHFMPDSAFSPYVGAGINYTRISSVNISGGLQLDNSSFGGALQIGADYKINKNWLINFDIKKVQISSDVKTAAGAKISSVKIDPWLIGVGVGYRF

SEQ ID NO: 12017 - protein, 362 aa, Salmonella gallinarum
MKLKLVAVAVTSLLAAGVVNAAEVYNKDGNKLDLYGKVHAQHYFSDDNGSDGDKTYARLGFKGETQINDQLTGFGQWEYEFKGNRTESQGADKDKTRLAFAGLKFADYGSFDYGRNYGVAYDIGAWTDVLPEFGGDTWTQTDVFMTGRTTGVATYRNTDFFGLVEGLNFAAQYQGKNDRDGAYESNGDGFGLSATYEYEGFGVGAAYAKSDRTNNQVKAASNLNAAGKNAEVWAAGLKYDANNIYLATTYSETLNMTTFGEDSAGDAFIANKTQNFEAVAQYQFDFGLRPSIAYLKSKGKNLGTYGDQDLVEYIDVGATYYFNKNMSTFVDYKINLLDDSDFTKAAKVSTDNIVAVGLNYQF

SEQ ID NO: 12018 - protein, 338 aa, Salmonella gallinarum
MYGKVDGLHYFSSNHSTDGDQSYIRMGIKGETQITDQLTGFGQWEYQVNANRPEDGDSSGSPQSWTRLGFAGLAFADMGSVDYGRNYGVLYDIGSWTDVLPEFGNDSYEASDNFMTGRANGVLTYRNNDFFGLVDGLNIALQYQGKNDGLSKEGDPLSNNARKSIAYQNGDGFGASATYDLGMGVSLGAAYTSSKRTLDQMTQDKYDNGDRAEAWTGGVKYDANNIYLAANYTRTYDMTYMGDTLGGFAHKTDNWEMVGQYQFDNGLRPSLAFLQSRANDVDGLGSFDLVKYIDVGSYYYFNKNMSAYVDYKINLLKDGNPSNPNTDNTVALGLVYEF

SEQ ID NO: 12019 - protein, 387 aa, Salmonella gallinarum
MKRKVLALVIPALLAAGAAHAAEIYNKDGNKLDLYGKVDGLHYFSDDSSKDGDQTYMRFGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNASSTIAGRTIAGGDKADAWTAGLKYDANNIYLATMYSETRNMTPYGKTDTGYGGVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 12020 - protein, 724 aa, Salmonella gallinarum
MSFIQYRRDKHLPSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGTTTNLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQNNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 12021 - protein, 663 aa, Salmonella gallinarum
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVSLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYTGRKRADSATAKTPGGYVVWDTGAAWQATKNVKLRAGVLNVGDKDLKRDDYGYTEDGRRYFMAVDYRF

SEQ ID NO: 12022 - protein, 719 aa, Salmonella gallinarum
MRIGFFSGMLGGLCLISTLHAQEPDSLKAVSLSEVVVTESYQHLKNKNSTWRMEVVGKEFLREHFTGNLIQTLGTLPGVHSMDIGSGFSKPMIRGMGFNRISVVENGIKQEGQQWGADHGLELDAFNAGQVSIRKGPASLLYGSDAMGGAIELVPLPLPAGNRLFGEASLLGKSVNGTLGGSLMLGVKKDAWYTWARYSEQHFGDYRIPTDTIVYLTQRMPVYHRRLKNTAGFERDVSWAAGFRKERYVSSYWVSNVFQKTGFFPGVHGIPDVSRLQDDGDSRNIELPYSQVNHLKVSTRQSLLYDKWALTWDIGFQKNHREEWSRFHTHYDAQPVPDKDPDKELAFTLNTYSSAVKLKLFASAVWQHTAGWDVQYQRNTIAGYSFLLPAYRRFTTGAFWMTTYRPGPTLSFSGGLRYDYGKIDASAYTDPYLAIYLREQGYGDEFIRKYEWRSYPVRRHFGDYSGSLGLVWSPSGGHLLQVNVGHSFRLPGANELASNGVHHGTFRHEQGDAALASERGWQFDVSYTYENGPLSVSLSPFVSWFSNYIFLRPTGEWSILPHAGQIYRYTGAEALFAGGEAAVGIDFLRHFNYRVSGEYVYTYNCDEHIPLSFSPPASLRNTLTWRYKEFSIYGEVQHIAAQHRVARNEDPTPGAQLLNAGVSANLRIGGIWAEVTLSARNLSGAKYFNHLSFYRKVEIPEPGRNFQILIKVPFKSLLK

SEQ ID NO: 12023 - protein, 437 aa, Salmonella gallinarum
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQILSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 12024 - protein, 312 aa, Salmonella gallinarum
MKKHAIAVMMIAVFSESVYAESALFIPDVSPDSVTTSLSVGVLNGKSRELVYDTDTGRKLSQLDWKIKNVATLQGDLSWEPYSFMTLDARGWTSLASGSGHMVDHDWMSSEQPGWTDRSIHPDTSVNYANEYDLNVKGWLLQGDNYKAGVTAGYQETRFSWTARGGSYIYDNGRYIGNFPHGVRGIGYSQRFEMPYIGLAGDYRINDFECNVLFKYSDWVNAHDNDEHYMRKLTFREKTENSRYYGASIDAGYYITSNAKIFAEFAYSKYEEGKGGTQIIDKTSGDTAYFGGDAAGIANNNYTVTAGLQYRF

SEQ ID NO: 12025 - protein, 726 aa, Salmonella gallinarum
MGMKVNKFLWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWRMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 12026 - protein, 1115 aa, Salmonella gallinarum
MKNKKQLISLVQKDNKNTIKLYSLLLFFCFLTFTSANAQTGKVSINLKNASVKELFNAIESQTPYRFSYRSVEVENKKGVTISVKNAKLKDLLIQELPKHHLSHIVQGNKIIVTPATDNQSSDKSNKVTGKVVDTNGEPIVGATIKEQGTTNGTITDMDGNFSFMVSPNTMIEISYIGYQEQRIKTVFGKSMFITLKEDTELLDEVVVVGYGIQKKVNLTGAVSVVDAKTIQNRPITNATQALQGAQGVYVNSAAGAQPGNDAATIRIRGMGTFSSAGNDPLFLIDGVPGTLTDVNPSDIASISVLKDAASASIYGSRAANGVVLVTTKKAEAGKFSVSYNNSFGLQQITYLPDAVWDPILYMKGFDKAYENEGRAPLYADIIEEYKEGMKVDPYTYPATDWFDLYFRDAFMQEHNIRISGGNDHIQTGLSVGYLDQEGVVNFTDAKKVSINFNSTIKYGQFKAGINVSANYRNYNEPHTGISDYMQLGMRALPVMTPYLADGSYGRSWVVTPGQNTFNNLLSCKDGENNYKQTRIVGSAFAEYIFPYDIKYNITLGVRKVDLTRRYFQPTTYTYNPKTLEPQKMIANTTAMNAANDDINPSISQTVNWNRSFNGKHNIAALLGMNYEEFNAWSFSAKGQDGYLDNELTEVGLATTFLKPSSSSSKVRLLSYFGRINYDYADRYLFEANLRYDGSSRFAKGHRWGLFPSFSAGWRIDQETFMENTQNWLSNLKLRVSWGQLGNQSIGLFQYTPVMSSGVNYIFGNTPATGYAMTQAVDPEISWETTTITNLALDFGIFNNSLSGSIEFFKKRTKDILRSVNQPSQVGNLTGAMRNIGTVDNTGLEANLAYRNNIGAFNYHVFGNVTYVKNEVVHIGGDDMINGKRITREGYPIDAYYLYICDGIFQSEDEVKHHAYQSANTHAGDLIFRDVSGPEGVPDGQITEDDRVVTGSSVPDFTYSFGLNLDYKGIGLNVFFQGVSGISTYPTHNLVYPYANGAGVTYEWLKRAWTPENTGGGFPRLLTTNSQHDNYTKSSTFWLRDASYLRLKNIQLSYDFPQKWIAPLKIASLKVFVNAENLLTFSDFDIFDPERSLTSDYIWSYPSVKSFTGGINVTF

SEQ ID NO: 12027 - protein, 731 aa, Salmonella gallinarum
MDSTTAPASNRSTPMTTGGRQVLAIRRIVTRHSAASVFSLLASLAAAGQSAAAEPDVALPDVVVSASRSEQRRFDAPAAVDSVPVDALRATSPLVNLSEVLTGVPGVAVRDRQNYSQDLQLSVRGFGTRSTFGVRGVRLYVDGIPATMPDGQGQTSTADLANASRVEVLRGPFAQMYGNASGGVVQVFTPDPPKDGFTGRASTGVGSDGQWQAGVSLGGGNDKLGGTLDAWTYQTDGYRDHSAARRYQLNAKVVAQPTDATRVTGQFNYFNQPLAQDPLGLTRAQADANPRQAVPAATQFDTGKTVEQTQAGVVVDHKLSQADSLQGRLYVGTRQLYQRLGMSGIAATSSGGIVDLDRSYGGAALSWTRRTTAGGLPLQWTAGVEANGMRDGRTGFVNNNGTQGALRRDETDKASDYGAFAQFDWTLHPSWELVGGVRASRVKLSIDDHFVTAASPDDSGSTTYNNVSPVLGLVWHALDMLNVYANLGRGFESPTLTEVAYGPGGVGSNLGLQASTSRQGEIGVKWQQQRQRLEAALFDADSHDEIVPLSNNAGRTVYQNVDGVRRRGLELAWRGGFGEQVGAAANGVAGSRYEAGLAYTYLSAYFGESFLNAQGQTVNAGNRLPGTARHSLNFDIAWRPLPPLVLGAEMHVDSRIYADDLNTQAAPGYATFNLRAGYEFRLGKTRLFAFGRIDNITDRKYIGSVIVNEANGRYFEPAPGRRFFVGLRAAM

SEQ ID NO: 12028 - protein, 955 aa, Salmonella gallinarum
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGNPGVIFGNDLTIRTQSANAANNGRDVDGIRTHGANTPDNPVFIITGDRTNIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVVPDPVDPDPVDPVIPDPVIPDPVDPDPVDPEPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQLGGDLAQWSTDGLDRWHIGAMAGYANSQNRTLSSVSDYHSRGQVTGYSVGLYGTWYANNIDRSGAYVDTWMLYNWFDNKVMGQDQAAEKYKSKGITASVEAGYSFRLGESAHQSYWLQPKAQVVWMGVQADDNREANGTLVKDDTAGNLLTRMGVKAYINGHNAIDDNKSREFQPFVEANWIHNTQPASVKMDDVSSDMRGTKNIGELKVGIEGQVTPRLNVWGNVAQQVGDTGYSDTRGMLGMKYSF

SEQ ID NO: 12029 - protein, 752 aa, Salmonella gallinarum
MIVRHWRSVLLVCTAVAAVLPVSQSFAQSAPATTPEATADDSTVLQKIVVKGKRVAPGSVADTPLATEITQKQLEEKQVTNYDDIGRSVDAGVNYSRADAGFNLRGLSGARILTTIDGIPIPYISNSSRQGAFAPANANGGGDTFDFDSLSSLDIVRGADSSKGGSGMLGGAIVLNTLEPEDLIPEGRDWGAIVKSTYDSEDRSLSGSAAAARKIGGTSILLQGGYRKGHERANMGNNDVYGALRTEANPADFDQNNLLFKLRQEIEGGHRIGLTAERFRRDLETDLRHLQGGTSPRNFMIDQYDGRERRDRDRVSLDYDYEAQSSDAFFSSARATLYWQDLKKEAGSGGRTTVNVAYGRHNEVENETWGFSGTATKDFEYSGLNHSVRVGLDVGVSNWSQYSWALCPTSTTCPSLNNQAEVPNVDSQNLGLVVEDKIEIGNTGFALTPGFRFDWFNYDPSTGGGFSNNTGLIRFGDLRDRTEAAMSPKILATYGLTPDVELYMQLAVGFRAPTVDELYSRFYNPTGRYAQLGNPDLEPEIGRGIEVGANFDTGDFSGRVAAFHTRYQDFIETVTSVDATGFTEFNYTNVAAATISGIEASAVKTFNNGINLHASLAYAYGRNEETTQRLRSVAPFKAIIGGGWSNETFGFDLSSTLSAGMLTDHLKTPVSNTADTTFDAPGYAIVDLTGWWTPEQLPGLRVQAGVYNIFDQEHYNALAVRDVNLSSATASQPREWYSEPGRTFKVSLTKTF

SEQ ID NO: 12030 - protein, 729 aa, Salmonella gallinarum
MARLKTAQPNSSLRKIAVVVATAVSGMSVYAQAAVQPKEETITVTAAPAAQESAWGPAPTIAAKRSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSAESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDSERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQAATVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNMPEQVPEHMASLWGDYTFNDGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 12031 - protein, 929 aa, Klebsiella pneumoniae
MQRALCAALALWPAAFVQAQATSATPSDDEPIVLSPFAVSAEKDVGYLAQNTLAGSRLNTRLKDTGAAISVLTPEFLKDLGATSMQDVILFQNNAVPDFGDAAANFNGNPMIGASEWQLRIRGLAASYARNYFAWEASTDFYNIERIDQARGPNSILFGFGSAGGIVNSSTKQASLSAQKTDEVSFLVGSWDRYRGTADVNRVLVPGKLALRLNLVAENGQTWRQFEFDRSRRAHLALKYQPSKTATLRAEAEVGKVTENVARPWLMIDQSFLWRQAGRPTFSGMWPWPTPDSVDTFWPDHLVLADDGVVRNWLGYANGNNSTVSQTWSHLAMTPENLAIVPRDSNPAGPDAVRETKYGTVSAFYENQVTDRFSFELALNHQKIDFLGYDAEGSRATNYFGGSSELWGDAAADLPGGGVNPHAGDLYLENNWTRRDRTIETTQLRATAAYQFDTGDWGSHRIAGLYEHSWRDFYSREDAEAFLNRPLNADAAEADVNRLYRRHYFTPGDAADIHVGSWRTPVANVGWVPTQYIENTESKQDTVLAALQSRFFSDRLITILGFRYDRMNYSWDPSVRDATTKEWKLDPANSKSTTFNAHTLSVGAVYHLTKSVSVYGNHSSSRDIPNVNIHVIGAEIPPMPKSEGNDAGLKFDFFDGKLYATAGYYTTKVEHTTDWGDIQTAVTDLNTRVLGALVAGGRITAGEQAARTISANGYMEDREADGWEFSLIANPTPNWRISANFSINNLVKQNSMAEVKAWADENTAYWRQKGGNDFLLGGGDWDTIGAQIGWLYQYHIDNVVALDGLQARGERKYGANLYTKYTFSDGALKGFSVGGGGRYQSPNVLGFYNDAVREGTDLLLADASIGYSFKTEFLLRGSWLDLQLNVSNVFDTRKSQIYTLAWWDTSSTIAERIGLQEPRKFTCTATLHF

SEQ ID NO: 12032 - protein, 252 aa, Klebsiella pneumoniae
MKLMRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSYANTQFKNVPSTFQVGYINDFGGLSFYEINCPVVNNICNISVANRDQ

SEQ ID NO: 12033 - protein, 1024 aa, Klebsiella pneumoniae
MNKSRYVFFILACLFGLYVQAQNRTVKGRVLSAEDKEPLIGATVKIPGTSIGVVTDIDGNFSLEVPNKDKTLVIEFLGMSTLTAKIPANGVLNVSLRPDTQRLDEVVVTGYGNFSKSSFTGSANTLRGDLLKNVPVVSVEQKLQGMTPGVSISGNSGQPGANQSIRIRGMGSFNASKEPLFVIDGVPVTSGSLSGGSADAAYMNNSKTNIMSTLNPSDIENITVIKDAAAASLYGSRAANGVILITTKKGTKGRAKATLKIDGGFSNAAVEFRPTLNGEQRRELIYEGLMNFQQDEIAKNPEAGLASPTEYADLHINDYASIPELGYTDWRKELMRTAHHQSYEASVSGGNDKTTFYSSLGFNRQEGLVENSNLDRYTARLNVTQKVGSRGEVGANVMFSQLNQEMNEERGSSINPFLCVALNTTPSFPVRDAEGNYVGSYPSSNVNPLRDIRTDYNRTRMTRMFSTGYASIDIIKGLKLKETLSYDYNIQKDSRYWNPLSGAGAKSGSDAQTAKGFIEYSKLISSTSLGYNTTIAQLHHVDALIAYEIENYQTDKAMGDKSKLPSDYLVEPDNAASLNSFVSSTQDSRMISYVSRINYDYDDRYYIAGSFRRDGSSRLSPENRWGNFWSVSGMWNVGAEKFMQSIKSVLSDLKIRASYGVNGNQPGALYGYMGLYSYGQNYMGGGGSYESALPNPNLKWEKNYNLNLGLDLAFINRIFVSLEYYNRDTKDLLYNRPISSTTGFQNYLGNLGQLNNRGWELELRTINFAGSNFNWTSVLNMTHNKNKIVSLDGKLEQSIEGSWFIHKVGLPYSTFYVKEYAGVDPQTGKALYYMNTQDANGNYDKTVTTDASAAQAIPYKSVDPKISGGFTNIVNYKWFDLALTLTYSLGGYSFDKTGTYNETDGAKEQNYNLPIYELDRWQKPGDVTDVPRFVLGQAAGPQNSSRYVHSTDHLRVKNLTLGFTLPDQWLTKLGVSKARLYFSGSNLLTWAKWDQYDPEVPVSGEVFCETPPMRTYSFGIEVSF

SEQ ID NO: 12034 - protein, 802 aa, Ralstonia solanacearum
MHQVIFKKKPLAAAVQLLLAISVSAVVSLPHAAHAQAASTESAAATRHYNIPAGPLTQALNHFAQSAGVLLSFEPELTAGKTTNGLNGSYSTKQGFDVLLQGSGLAGTPSGGNAYTLKRIPLAPLSGTETTLPEVKVTTTVADADVGQHLNAPVNSGALGSRSVLETPFSSTVVTKEDISERRITTLGELFTTDASVSDNSGAYGAWASYLTVRGLALDFQNSYRIDGKPFLSYVISLPYEHMEQIELLKGSSGFMYGFGSPGGLINYVTKKPTDTPLRSVGVGYSSKGLLSEYVDIGGRVGENGRFGYRLNATHEEGKTFNNGSLNRNSVSLALDARLTDKLTWDFQTILQDRKAVDQEPTIRTSLLGSALPSPIKNDNGRIVGGGTYADNNFRFYSTGLTYALAPDWKLSANYSYSSTKTRRNESVLRLTDSLGNYLDDHSDYGEAYQFNQWQAMLEGKFLTGSFEHQVVLGTSTLQLKNDYSSNGFYGLIGSGNLAAQNTNNYYSSGPLDLYRGGDVTQKALFASDTIKLSERISVLAGLRYTDYSQNSYNPNGTPSSSYKQDGVKTPTLALMYKLAPNTMAYASYMESLEPGSSVGVAYANYRSMLDPLKSKQYEIGLKTNQTDWSATAAMFRIEKKSEYGNSANVLVQDGTAIYQGIELGAAARLARNWNLGGSVMWLDSEYQNGFAYAGQRVAGAPDAVVAAQLAYTVPEVPGLKLNANMKYTGATMLRPSNNLQAPAYTLLNIGAVYETRINGYDTTFRVAINNATDKRYWMFQYSDYIKAGDPRSLTLNASLKF

SEQ ID NO: 12035 - protein, 389 aa, Ralstonia solanacearum
MKKSLLAMAVLGAFAGAAHAQSSVTLYGVVDANVEYVNHEQNVTSAGIAIPGSGSRVAMQAGGLSSNRWGLRGVEDIGGGLKGLFVLESGFGMDTGTLQQGGRLFGRQAFVGLQGNWGKITLGRQYTTIFDMMANFSPSGYATQYEPVVGLLGPNFREDNVIKYTGLFGPVTVEGHWAFGERAGSQTANSAYGLGANYFAGPFGLGVAYDEVKVLTAAEALGGAGNEYARDKRAAIAASYTVGPVKLMGGYRYGKTDTASSGATLALLPHRDDLYWIGVNYQATPALGFTLSYYYDNIKEATIGTTTVNPRKPQQLNFIADYNFSKRTDVYFTAAYSRNASLNWDSIGYATTASGQLSIGYLPAASQTYFITPDASNQLGAAIGIRHKF

SEQ ID NO: 12036 - protein, 851 aa, Ralstonia solanacearum
MALFFGLTAEHDRVVPVRCVLKPFTVLVLLALVGTHVAYAEEEIEFNTDVLDVQDRSRIDLKEFSRAGYIMPGDYQMMIRLNKSELSEMPVTFMAPPDDPKGSVACLPPDMVKQLGLRAEWESKISWWNNNQCLEIKTLPGMMVRGDLGSDTLYLSVPQAYLEYSSSDWDPPSRWDEGILGMMFDYNVNAQVSKPTKGNENHNISANGTTGINFGAWRLRADWQSQYNHTTGRAGSTERNWDWSRYYMYRAIPHWQAKLTLGEDYLNSGIFDSFRFTGASLVTDDNMLPPNLRGYAPEVTGVAKTNARVTIRQQGRVLYETQVAPGPFRIQDINDAVSGKLDVRVEEQDGGIQEFQVDTASIPYLTRPGRVQYKLAAGKPTNWKHHSEGNGFGLGEFSWGINNGWSLYGGLLGAGDYNALSLGVGRDLMAFGALSFDVTESRARLPDEGKTLTGGSYRLSYSKRFEEYDSQVTFAGYRFSERDFMSMSQYLDRRYHDGDAESSKELYTIMLNKQFTDLGISTYLNYSHQTYWNQSNNDRYNISVSRYFAIGTIKNINLNLSAYRNKYEGKNDDGMYLTLSLPWGNSGTISYNAMVNRKGNSNTVGYYDRINENSSYRLAAGTSIDGKAAANGYLTHYGDLAQLTTSASYQDGRYTSAALAVQGGMTITPEGAALHRINTPGTTRLMVDTDGVGSVPVKGFGAITHTNMFGKAVISDVNNYYRNSASIDLNKLPDNVEAIRSVQQATLTEGAIGYRKFQVISGEKAMSMIRLSDGSTPPFGATVLNKDKREIGIVNDGGNTYLSGINPGEKLDVRWDGELQCVIELPHELPIVEEMASLLLPCQLVNGNKQP

SEQ ID NO: 12037 - protein, 1093 aa, Ralstonia solanacearum
MSEESVNSRRCKGGNLFFSRILFCICLCGPVAYALAEESTVVSEIRQNEKKSISGVVTDTNDEPLIGATVLVKGTQNGTVTDVDGRFHLKVNSGETLVVSYIGMKSKEVAVVDGKKELFIRLDADTEMLDEVLVTGYQTLSKERSTGAFSKVSTEKLELKRMDNLSSMLEGQVAGYVNGQIRGVTTMNAVANPMVVIDGFPVENTTLDRIGQTTENMPDLNPEDIESVTVLKDAAAASIYGARAANGVIVITTKKAKEGKAEVSFSSTFTVHPYSYYKKNRTNAADVIAMEREWATMALSTPEAAEMQAADLRENGPYPSLGVNTLLDMYTGKISMAEGDKILNQLASYGYQYYDQAEKYGKRNPFYQQYNLRVGKTTERNSFNFSTTYWDNDYEDINHSDWKLGINITNSLQLTNWLHFDTGVYLKYGKEKNQSYDLFDPGFSVMPYDPLVNADGSYFVAPSQSDKSRRDLVDQYGLYSEDLVPMDELNYALNTTKTFETRAYAKLKFDLTSWLNYNVMFQYETSDSDYESLGEKESNFMRKRINDFTSKSPNGSSLVYNLPNGDSFHTLKNSKHSYNFRQQLSLDKTFDEKHNLVWILGQEVRHSLINFDENTVYGYDPELKTWQNYNMKDLAYFSGLLGSAQLDQNSIASSRELLNRFVSFYSNASYTYDDKYVLSGSIRWDRSNLWGTNSKYQNKPLWSVGGSWNIYKEKFFQADFVDMLKLRASYGIGGNIGRNTAPYLIASYYDSSLVDGMAGSVNTPPNKDIRWEKTTTVNVGVDFALFRHRLSGTIEYYNKYSVDLLAAINGSPTQGFGYTTLMTNNGKMVNRGVEITLSGEIIRQKDFSWNASLLYAFNRNKVKHISVQPSLWDSRISMPTSYPMVGKPLYGIYAYKWAGLNENGDPQVYDAENNVTSGPARDYHALVYCGTTVPIHNASLTNVLRYKGFEFSAMLILDAGHKLRSSNIPSINMSNGRITSTAKGIVDRWTQPGDVTDVPRLLFSNDTENFNTHRTELYRYSDLFVYDASNIRLSNISLAYRVPAHWCKKISLSGARLQFNVENVATFAFDSKANYDLGGKVKPNYVWGLYLNF

SEQ ID NO: 12038 - protein, 662 aa, Ralstonia solanacearum
MYTYIHTINSKFFSIKKNYFRLITIIFILLFLCYYKNSYSEDIGKRDTYDEFNWCMKQLQSISTSLNNLIQYMYEAHIRVDTSDAILRMTESYIETFTIVQNDIFNMLINESSMVRRLLQTATNDIKNGIDVSKHIHSLNNLLSNTYKYEVKINQIKQNQQKYIHDRHNVITNLLALEESVTEKLQSTQQLILSMVMTIPQYVRIPYLLEAIQQRLSNAQHQIPQLEAALDDLKSKISSCAGGHIKNVELVQELQSNLEKALMLLLESENGLRSVILKGKDQGPKPPPPSGGASASMANFSLGEGSAAFVSGYDILGNVSSLQELQCIFGNAITQVSSILKMWSLRNTFCIHETKCNIPHFFHSDIFRKKEKKISDLSLPQLSLLSHLSAPYHMFSSVEGYYKNLEYKPHAIQAGVIVFPVTGLQLGVSYDFLENRMLKVRHNSFGSAKAKTTTNILSLAASWNAEQTGLMGQAIGCYGWGYMPNTRYVPFVGEKISVNSKPDIELNGGLFQLGYNIQISSPIRLTPYVEGMLVTLGWKNYKEHYGVVSSNISNYKEALWERSVGLRGYWNINPQSNIQAWISKIFGRSNTTKLKATSLLFSIPVYKMTLPVLEKRFIKNELGMSYSMKLSDKMCMSLNSIFNYTNNTLHTQNIQCSFQYVY

SEQ ID NO: 12039 - protein, 241 aa, Ralstonia solanacearum
MAYKKALAAAAGMILATAAHAQSAGSNIFSLGWFRVMPNSSSDPLQIDSVGGVPLNRQVANTGAKIKDADTVGLAFTHFFTDNVAVELVGGIPPRHKIEGTDSFARYGQIGSAKQWSPTVLAKWFFGGADSKFRPYVGAGLNYTWFTDEKITNSTFQTQVLGGGFPSTSTVSTDSSLNPVLSVGATYAITKDWFVGLSVSYLPLKTTAKIDTTLANGQHSVTEAKITINPIVTFLSVGYRF

SEQ ID NO: 12040 - protein, 401 aa, Ralstonia solanacearum
MPRISRYLWSLFALSVSSLSSAQSSVTLFGVMDAGVSRYMVRSNSWDGSGRTASQGIWALSPSGNLASRLGVRAVEDLGAGMSASMWLEAPVTNDTGGGALNFGRRSTVSLAGNWGELRLGRDHTPSFLNDWAFDPYSVNGVGVNLLAVVSSNLAINRALRTQTSGTLPERLLGNGLSAGTDNYLRANNSIGYHLPTGLGGIYGQLMYAFPENDARRGRYAGGRIGWASGPTDIALGYGESMLGTLNGRKETIKSLNLGGSYNFGPVRVLGEWSQVRNARSDVRATDRYDGLLAGVQIPVGLHQLRVSVARVQFKDGEGAGDASVNKLALGYVHNLSKRTALYTTVSRISVSNGHNNPAVIGVTPLAVSSPVIMPQPAYSNSPGMQPRSALGFDAGLRMMF

SEQ ID NO: 12041 - protein, 264 aa, Ralstonia solanacearum
MAGPLQAHGDYGFAHDVHSSVAVDRNNDNFGDRRVTTSSDEQRYDTNFYLGEISDGEMFGRVEFGTTHSTSDVSTRLASAGISADSYDATIGALWVADSQLYIDGQFRYGHFDGDLSLNGQKMVGFDGNGYEVSVEVGKSFALLNDVTLIPQAQLMYSDIEGQIETGRIGAKVDRDTLMARFGLRAEHTLADNAMLYGQIDVYHAFENESSVMYGQDTAALSIGGIVAKSDRAQLYAEITSETGLGSSSGDHSFSWNIGFAVQF

SEQ ID NO: 12042 - protein, 224 aa, Ralstonia solanacearum
MACARPAIVAAAAGLIAAAVCPTAYAEGIDLPPATGNWMVRLRAVNLTAANKSDAIPALAVPDDAIHINNKAFPELDISYFFTPNLAAELILTYPQQQDVTVMQSALGGPTKIGSFRHLPPILTLQYHFRPESRFKPYLGAGLNYTRISGVDLQVPGVGPLDLSRNSFGPALQAGFDYRLTDRIYLNVDIKKTWISADVKLAGQTISKVRVDPWLVGVGLGYRF

SEQ ID NO: 12043 - protein, 398 aa, Ralstonia solanacearum
MNQHAGARVAGTVIAACLSGFVPDVAHAQSSVTLYGLIDTSITYSTNQRTRGAGSPGGGSVAMTSGALNASRWGLRGREDLGGGMAAVFALENGFSGTTGKLSQKGVDLFGRQAWVGVSSQTAGTLSFGRQYDLILDYVTPLGASGPGWGGNLAVHPYDNDDSNRNLRINNAVKYASPTVRGLRFGAMVGFSNAAGQFSNNAVWSTGVSYENGPVKLGAGYLKISRDRNAPNPDGALSTVDGSATITGGNQQIWAMAGRYAFGPHSVGAAWSHSATDGVTGVLQGGNIAPLKGESLVFDNFSIDGRYFVTRALSVAAAYTYTMGRFDTRTGQTRPKWNQVVAQAGYVLSKRTDAYLEGTYQSVSGGNGNPAFNATVWTLTPSANSNQVVVALGLRHKF

SEQ ID NO: 12044 - protein, 376 aa, Ralstonia solanacearum
MSRTTFALAAITAAVAGLAATGAQAQTSAVTLYGLIDTTISTVSNTNAAGARTTGFQVPWFSGSRWGLTGKEDLGGGTSAIFKLESEFETPTGNMDTPGVLFNRDAWVGLSNPLFGKLTFGRQNALARDVSGIYGDPYTSAEVTLDEGGYTNVNNFKQLIFYAGSATGTRLNNGVVWKKLWDGGFFTGLAYQFGEVPGQFSQNTTESAALGYNGGNFHLAAFAQQAKVNGFTDRSYSLGGNVILGMFRVNAGYYHYTGEQPAAIGNRKDDAYTVSLKIAPPGAFDYEIGYQIMKAGNAAFNADGNTLNAYADVSTATASGSGRKNTLYGSVFYHVSKRTEFYVAADYMKLKDQYIVGSTNGHNSQTEFGVGMRTRF

SEQ ID NO: 12045 - protein, 393 aa, Ralstonia solanacearum
MPLVAAVLTAITGTAHAQSSVTLYGLIDEGVLYNTNAKGGHQYAITNSTAQGDRWGLIGREDLGGGLQAIFRLENGFNIETGALEQGGAEFGRQAYVGFAGKFGQVTFGRHYDPIVDSVSGYILAGSTHQGGAGQVGGVFSSHPGDMDNLDNSYRVNNSIKYYSPVFDGFQSVALYSVGGVAGDYSRNQIWALSASYNSGSFSAGAAFEKINEPNFSLFGNNPSSSATGNNMAATPVYSGYASAKSQQIATAGASYAVGAFSIAAIYSNVRFSDLGSVGGGVLNPNNLSGTAVFNTGELNVGYRITSSWMVGLGYTYTQGTSFDSLPAAKYKQINIGTDYILSKRTDLFAMCSYQRASGYDSTLKPAVASIYTATPSASNTQLVATVGIRTKF

SEQ ID NO: 12046 - protein, 862 aa, Ralstonia solanacearum
MQQSSSVGLCRSVISVLVATALYSPMISASTVDYGETVDGVVLVNDIQTVYGTTNNTKITATGEQHVKKYGVSNNTEINGGYQYIESEGEVNNSTLNDGYQIVQVEGAANQTTINNGVLQVYGAANEAVIKGGSLIVENGGIAVFAVIEKGGLLEIKDQGYAIAVNQKAGSAIKATTRAAEVEGVNRLGQFSIKDGVANNVLLENGGSLLVEENNFAYDTTVDNGGVLKVMDGGTAIGIDKKTGGVLTISTNVLEASGKNSKGEFSIKNGESINYELDNGSMLIVQPQTKASYTIVDEYASMQNLGSDTGTTVMKYAVYNLGRADIDGQTQYSYDASSEGMNILGGRVTIWAGTINNVTVSDDSGVLQIMSPLEGSAAPVLTGTTNVSNGALLAVYALADTANATVNLDHSNFALYSENQRAMYTRFYFAHLNMRNSNVIMMDEPVSRTGATSGSEHYIDLTVNTLAGSGNFYMRTDMATHQSDQLNVTGQATGDFKIFVTDTGASPAAGDSLTLVTTGGGDAAFTLGNNGGVVDIGTYEYTLQDNGNHSWSLAENRAQVTPSATAVLNMAAAQPLVFDAELDTVRERLGSVKGVNYDTAMWSSAINTRNNVTTDAGAAFEQTLTGLTLGIDSRFSREESNTIRGLFFGYSHSDVGFDRGGKGNIDSYTLGAYAGWEHQNGAYVDGVVKVDRFANTVHGKMSNGATAFGDYNSNGAGAHVESGFRWGKNLWNVRPYLAFTGFTTDGQDYTLSNGMRADVGNTRILRAEAGTEVSYHMDLQNGIALEPWLKAAARQEYADSNQVKVNDDGKFNNDVAGTSGIYQAGIRSSFTPTLSGHLSVSYGNGAGVESPWNTQAGVVWTF

SEQ ID NO: 12047 - protein, 476 aa, Ralstonia solanacearum
MLFFSMLQYVWVAVRPLVWVRLQARRHAMLVALVGLLAAFTQGARAEDVPATDALPIAGGELDDRFGFHGQTTWVWQRKSAFNAPYSGDNSLSPERAKSYSFSATLDLGMRLWKGAEVHLNPEVAMGDAFSDLHGLGGPTNGELAKVTGSDPTLYRARAFLRQTWGLGGETEKIDADFNQFADVVDKRRIVLTAGNVPVLDIFDAVEYAHDPRTQFLNWSFMTHPSFDYPADARGYDWGVALEYIDSENGWAARAGRFLLPIESNGLALDTRLLMHYGDMLELEKRYTLFGQEGKVRLLGWRNRARMGSFQDAIALGQATGTAPDVGQVRKEHAKVGVGLSFEQKLGENLGLFTRLNWSDDRTETYAFTEAGRNVSFGGLLKGTAWGRPNDVLGAAFSLNMLGPDHRAYLAAGGSGAFLGDGALNYAHERVLELFYSMQLVKGVTLSPDVQLIQNPGYNRDRGPAKFVGLRVHAEF

SEQ ID NO: 12048 - protein, 703 aa, Ralstonia solanacearum
MVKNNSGWAAGLAVALMGLPYVGEVSAQEVDLPATTASGQRQAAGYRARESSVATRTDADLMEIPFAVSSVNTELMRTVAAGRGDDLYDWVAGVARQNSFGGLWDNYAVRGFAGDGNWAGTDYLLNGFSWNRGNSVPRDTASLERMEVLKGPASALYGRGDPGGIISYTTKQPQFKSANTISVSAGSYGATRETLDSTGALSPTLAYRLNLMNEDNGSFRDTVSSKRYLVAPGFTWKAGPDTVIHYEMEAARQSAPLDRGVVAVNNQLGAIPASRFLGEPRDGDYEVRNLGHQFTVDHRINADWSVNAGVAQRETDLYGRSSEALALQADGRTLWRRYRHVDFHTNDLQGRLELAGKLQTGAVGHTLVMGADAYRFTYDQLVERSTPTAAAPYAIDIFNPVYGQATPALRTVTNALERDEGQGAYVQDTLALGERWKVIAGLRWDNYRQSIDDRQSGTTTSQQQTAFSPRLGVVYQWSPAFSVYANTAYSFRPNSGTDANGNAFDPEKGRGYEVGAKWAGSGWLATVAAFNVTKRNVLTADPANDGFSRAAGEVRSRGVELEWNGELGSGFRGIANLAYVDAEVTRDTVLTPGARLVNIPRVNGSAMLMYEFAPGFAQKAGVGAGVVYVGRRAGSTANTQDGFQLPAYTTVQLNGYVQLDKHLRASVVLNNLFNRTYYVSSYNSVWVTPGAPRSILGTLSYSF

SEQ ID NO: 12049 - protein, 376 aa, Ralstonia solanacearum
MKKSAILVAVGALFAGSAYAQSSVTLYGIVDTSIHYITNANSAGNSLTQMESGAVSNSRWGLKGSEDLGGGNKALFVLESGFNSATGRMSSSGTLFNRQSYVGLSNKDLGTLTLGRQYNFGFTMGGNFDPLGVGNYDGNSWMFYGLTGLRESNMVKYENKINGLYVGLGYGFGEVAGSLSQNQFLGAAVSYEFGPAMIGGLYQQHKDIAGNKQTVWSIGGNYTIGPAKLFLGYLDSSDATGCVNSSSNCVGGSAFGLNIYGNATTGAGLTPGATKRRDHVGMGGVTYQVTPALALTGAFYYDSISNAALTAGNDGKRYTAVLLAEYALSKRTQVYGTVDYNKVKDAAIPQLQGGTNDGTGAKTNQTSVGVGIRHIF

SEQ ID NO: 12050 - protein, 464 aa, Ralstonia solanacearum
MPRQAERADAHRLRHALAALVLGLGLQGTALADTAAPKVPDTPDAPATQDLPEPQRWNLHGQFTNVTQWHPDFSARYSGPNSLTPTSDSRETVDLTLFLGVRLWKGAELYANPEIDQGFGLDNTLGMAGFPSAEAYKVGKNEPYHKLPRFFLRQVIDLGGEQQAVESAPNQLAGTRSTDNLTITIGKFSVVDIFDTNAYAHDPRGDFLNWSVVDAGAFDYAADAWGYTRGMAVEWTQSWWTVRGGFFLLSDVPNSVTIDTSFKQYAWIGELEARHQWLGRPGKVKFLAFANRGRMGGYGDAVSLAQQTGSTPDMSLVRRLAWRPGVALNVEQELAPDLGFFARASMNDGSKEAYEFTDINQSVSAGFSLKGDRWGRHNDTVGVAVVVNGLSRAARQYFEAGGLGVLIGDGALNYGTERIAEVYYNWAARPHLTLGFNYQYVVHPAYNRDRGPVSILGLRVHADF

SEQ ID NO: 12051 - protein, 698 aa, Ralstonia solanacearum
MQVVQMYKKSLLSSAIMLALVPSAYADDYASFDEVVVSTTRLNTQLTDTAASVAVINASDIEQQMAEDIEGLFKYTPGVTLTTNSRQGVQGINIRGIEGNRIKVIVDGVAQPNQFDSGNSFLNSSRVDIDTDMVKSVEIVKGAASSLQGSDAIGGIVAFETKDPADILKGRNMGGYAKLNYSSSDKTFSESIALANKSGDLESLVAYTRRDGQEIQNFGSPDQQDSNANNLLVKLQYQLNPKHRLEFSGNYIRNKNDLENLEFSGYKNASGTDETTQYQLGIKHIWDAEFSLADRITWQFDVLGKEETGITDRTSKSNGNIQKKDYLYSDKGFSFDSQLDKSFMVSNTEHYIVYGFSLSDKDIENTNQEFNSIGKNNVIFYMPNASEKRYGFFIQDEIAFDNLIVTPGVRFDSFETKPGDTSANPSLNDASEYKKYSDSALTARLGTVYKLNQENRLFAQISQGFRAPDFQELYYSFGNPAHGYVFKPNPNLEAEDSVSYELGWRYNADSVSNELSIFYSDYDNFIDSQIVSGSFKTRDAVYQSINIDKATIKGIELSNQFSWDRFMPIVGFSSRIAAAYTEGKDGNGKPLNSVSPWNAVTGINYDSENNWGTAVNLTYTAKKKASDINGDYQPISSATVIDVTAYYKPIKDLTLRAGVFNLTDEEYYNWNDVRGLPSEDKDKTQAKRNFGITAKYEF

SEQ ID NO: 12052 - protein, 569 aa, Ralstonia solanacearum
MLAGLSLAQAQDKGNLGTEVVNVVKPYTPEIGDAFKVKATPALNDSLNTAKKKVTYGIFSVPVASTFTPAKGKAAQVEKAKPVKLYDNYARLGFGTYTTALAEFYSNFEIDRDSNFGIYLNHNSSQGEIDGVVLDNQFYDTDLNLSYATRDRDYNWYADLDLGHKLFNWYGLDEFVAASPTLVESIDPVHSYFQAGLSGGVEFNEGFFEGATARLGYFGDSYESSEIRAVIAPEFMIPITDQKISIDLKLDYLSGSFDRNYRNSEAIEYTHFIASANPSLQILLEDLRLDLGVNVAADLNPDADKTDINIYPSVQASYNVVDEYFIAYGGLEGGLMQNSYQELAAENPFVSPTLDSLSPTDQKYDLFAGIKGKLSSAMSYNLRASYLAEDNRLLYKNNFRSVSEGTLAGAENYQFGNSFGIVNDNLKTLSIFGELNFDVNSNLKMRINGEAFSYDTDMEEEAWNLPDFQASFFADYQIDEHWFAGVTLFYVGARNDQVDVQTSSIVSNPQLVELESYFDANAHAGYRVNDQLSFFARVNNAFGNNYQRWVNYPVQGIQGMAGATYRFDW

SEQ ID NO: 12053 - protein, 364 aa, Ralstonia solanacearum
MKLHPLALSLLLAAPAVASAQSVTLYGVVDTGVEYVNHIGTAGSSVVRMPNLSGTVPSRWGLRGTEDLGGGTKTLFALESGFAADTGASNQGGRLFGRQAWVGLSNDNWGQISFGRQYTMLFWATLDTDLLGPNAYGSSSLDNYLPNTRADNAIAYKGKFGGLTVGATYSFGRDTVNAGPSPSGTNCAGENPADSLACREWSAMLMYETDRWGVSAAYDSLRGGPGAFAGLTSSSLKDDRLALGGYALVGSAKVGLGWIARRNEALTASRSNLFYAGVAYDLTPALTLTGEAFYLKYRSSADKAWLGAVRASYALSKRSSVYATVGYLENGGNLALSVSSAATGASPAAGGSQLGAMVGVKHVF

SEQ ID NO: 12054 - protein, 652 aa, Ralstonia solanacearum
MFALGGLLIAPGLHAETDLTELPLEQLMQVQVSSASKYAQPASEAPASMSVITAADIKAYGWRTLADILRSLPGLYTNYDRSYTELGARGFLRAGDYDTRFLLLIDGYRTNDSIFDEAAIGTDFPIDVDLIDRVEYVPGAGSAVYGSNALFGVINVITRRGGDIGGVQASASTGSLQAREGRVTWGDRAQGGAEWLLSATIGDAPGRDLYFPAFDRPDTNHGVAVGMDFDRRKQVFAKGSAGEFGLTFAHGERTKGTPTAPYDQLFNASQSRTVDARDSLNATWQHALDEASDVSARVYWGRYTSRGDYVYDYPPVTLNRDLFDSAWYGTELKFVTRRIERHTLVIGTELQRDYRDAMRNFDVSPYRSYLEDHRNNSRVGLYAQDQFTLHPGWLLDTAVRYDRSTFVPGIFSPRVGLIWRAAPGTTLKALYGMAYRAPNVYELYYQTSAPGGQETNAGLSAERIRTYETVLEQQVGAAGRATLSVYQNNVSDLISQMLDPNTGLLVFQNVARTRTRGAELGYEQSWPGGMRLRGSYSLQRSTDLDSGQTLLNSPRHLVKLNVTTPLWRDDVRLGLEAQYVGSRLAQSGRAGGFWLANATLLATRLAPGLEMSASVYNLFDRRYADPAGPELAQAVIRQDGRAFRLKFTQTFR

SEQ ID NO: 12055 - protein, 770 aa, Ralstonia solanacearum
MPAFSSTTSARSSAPRRTRLLTLLIALSTAQQAHALANETPRPFHIGRAPLEHVLLEIARVSGQHVSFASNLVQERWAGPIDGTMSAREAAGRALQGSGLTLASLPDGTLTVVAADVSAPPLNVGTLAATEVHGSTDDGFAVFSTGGITRVETAMSNMPHAIDTVSSGLLASRQPPSLADAVNQVGVVPVVVDQAAPPQYAIRGFMTDTISVDGLPDRIASMRPLEALDEIAVIKGPNADVAGVTMAGGTISASLKTPGIVPERSIAVEAGSHAERKVIADLGGAIGTNGLTYRVIGVQDSSANSDAGYIGHRVSYGHAALGWSDSATEVTVGVESLASRQPVQPATFALNGAPVRLASESPLGNTDDDVRGHAERFYYKLSHNLTDDWAVHSRWSYENVRLQSAQWHLVPTADGSVPMPTVGMGYRSDNRVWALSNDLAGTVRQGPLTHSLVLGWDEIQDRLDFHYPGAVDLGLQNPYAPVPLPATAFVPGLSLSQTVRQSVFRLRDRIAIGERWEISGSIRANDYTAKLPHAKLQGLAWTPALGVVYKLDARTSWFADYSHGFQINTGYFYNGATMQPERSQQLETGLRWEDRQRKLTAQAALYRITANHVGVADTSHPGYYTEIPEQSSDGIELSLQGSLARGWETSLWVTAAHIKRGLPGNPSFTAPGMGGSMWTTYTVQGGTLAGAGAGVGVTAQRWIPCFDGTAFRVPGFVQVDGSLFWHRKQWRIDLLARNLFNVRAYGNTVSSSFIPILPGRTLTLRVTRHF

SEQ ID NO: 12056 - protein, 817 aa, Ralstonia solanacearum
MKSPILNRTRRSCLLMTSALVSLSCVLVVSPAMAADEPQAASTTEDIVVTARRTSEKLSNVPVSVAAIGAKALEEKRILTDADLQSATPGLTVRQTNSSNQISFSLRGQSVDAFSFAAPAVLNYVNEFNAQSTSASAFFDLTSIQALKGPQGTLFGRNATGGAVLYETRKPDTDFGGYMRLSYGNYDAKFAEGAINIPGEIISGRLAAQYQKRDGYQRNLLLGIRNGSVDTFSVRPTIQIETGGFKNATVYQYNYSGGYSTSLRATNYYGVAGSSGAAGDPLNNFVNGKPVNLSLNYGLPSATLYPDGIAALLQGGERFARFGFSGLPSFIEAQKNFGFYDVFDDQDGAHLSRQHLVTNTTTYELSDEMQIKNIFGYNHSRSRDRTDVDGTPFDPLQIGFGGGTGPANPGDPAVGGRSAEGYTYVSQQLSNELQISGKTGNLKYIAGLYYFEGKDYQRLALTFAPDYSAALGDTLGFFLREYTNKTTSKGAYAQFTYGLTPELNVTAGGRWTWEKSRYTPMDRVAGSFDVFQDDFNTSLGITGGTLKANKPSWNVSVDYKITPSLLVYAAQRGSWRTGGFNGTASSVDAAGNPIPNSFKPETTYDFELGAKFNGRIGDMPATMNVAVYNQNIKNVIRAIYLGVAAVSGNVEEARVRGVEADLSIRPTDWLQLGGTLAYTDAKYTKNTATVGTTVVKFGPYGDVPKWSGSAFAKVEHELGDGSVASLRGDVYAQSSFYYSNAANTILPRTQIDGYALVDLRAEWGRIGGSDISVSAYVKNLTDKKYNTGGFALGAVNAINSVLPGLPRMYGLEAKVEF

SEQ ID NO: 12057 - protein, 915 aa, Ralstonia solanacearum
MAGQARRWYGAGGRHPIHFQISAGAALMLGLLDAAGAAAVTAAQRIDGGAAFLGDVAIATTKASEHGINVTGRQAEVRVTGGAIRTSGNQAQGVRVGTENAQDNTALGASVSLQNLIIETAGTGALGVSVHEPQGGGGTRLSMSGTTVRTRGDDSFALQLSGPASATLHGVALETAGQQAPAVVLWQGAQLNAQGLVVQVDGAGVSAIHAQDAGSFTLSGSDITARGQEVAGIYVQEGMQGTLTGTRVTTQGDTAPALQVEDAGTHVSMNGGALSTSGANSPAAWLLAGGSAQFRDTVLSTVGEASHGVDVAAHSEVELAHAQVRAGGQGAHGLVVTRSSAMVRAGSLVESTGDGAAALLESGHLTVDGSVVHGHGAAGLEVDGESNVSLLNGARLSSDQPAAIRLIDPRSVLNLDIKDRAQLLGDIAAEPQQPDGSPEQARVRVALADGGTWAGRTDGAVHTVRLLDRGVWTVTGDSRVAEVKLEGGTLAFAAPAQPKGAFKTLVATQGISGTGTIVMNAHLPSGTADVLLAPQGFGDRQVLVVNNTDDGTESGASKVPLIEDEQGHTAFTLGNMGGRVDAGARQYELTASEAQADKARTWQLTPTNELSTTATAAVNAMAIAASQRIWQAEMDVLLRHMSGLHSSGSPGGFWARGLSQRQRLDTGYGPWQKQTVSGIELGIDRRVAGGATTAWSVGMLAGYSETRRDGGAYRAGHVHSAHVGAYVSYLNDSGSYVDGVVKYNRFRHGFDVRTTDLKRVDAKHRSHGLGALLRGGRRIDIDGGWYVEPQASVAWFHADGSRYEASNGLRVRADSAHSWVLRAGAEAGRQMRLANGNIVEPYARLGWAQELGADNAVYTNGIRHVTRSRGGFAEARVGVGALLGKRHALYADYEYAKGARFEAPWTLQLGYRYSW

SEQ ID NO: 12058 - protein, 694 aa, Ralstonia solanacearum
MPFAQAALADEATKAAPAVQAGTLPAATVTGTRSRTSYDTPVATTATKIAAPLREIPQSVNVVPHAVIQDQGALSLNDTLRNVPGVSASLGDAQRDQVTIRGFSAINDQYVDGLRDDALYFRDLSNVDRVEVLKGPAAVLYGRGSSGGIINRVTKKPLATPLAEVGVVVGTEGQKRAEFDLNTSINDDAVRARLTGAVEDSGGFRNDYFLRRQAISPSFLLNLSPDTKLTLQFDYLHDTRIADQGVPSYRGRPVNVPIETRYGSASAGDGNIETTVKSVTGTLDHRFNDQWSFHSVVRNYEYSLGRNNYTSVRSVNDGPVPTVTLNVNQRNRSDRGTVWQNELTQQAETFGIRHTLLYGIELGYQDKSDRVAALSQNFTYNLFNPVPVVLPTVPGNAAPSNYGLTHNETYAVYAQDLVKFSPQWTVLAGLRYEILKQSRDDLTPKNQDLSRTDKPVSPRLGIVYHPVEPLSLYASYSRSFQPLADSFTYYTNSSALAPQSTTNYEIGAKYDVSASASVSAALFDMKQTNLTSVDPATQLAVPIGTQRTRGLELAFSGEVAKTWSVIASYAYLNGVLTNPFDKSNGVAVTGNQPSLTPRHSGSLWVKHDLPNGFYVAGGIHAEGARFASQYNLTTLPGYMTVDLGAGYRSKHVDVTLNLQNLFNRAYYVSAHGGAENYNLPGAPRMALLGVRYKM

SEQ ID NO: 12059 - protein, 192 aa, Ralstonia solanacearum
MSPGGAIKTAGGYLRYSQSGISAGAGYLGTTLPAGTKVDAYTLGGSYRVGPWYVNLGYGLNKRKDAFPAATAGGGFDQAILNSFWTGSSNGGFVAGDANKRQMYKMGFGYQITPQINVGAHYYHAKQSGSGTGNFNGKADFLVAVVDYAFSKRTDAYVALDHTKTSGGSGVMLDANGATKRTGFTVGLRHRF

SEQ ID NO: 12060 - protein, 773 aa, Ralstonia solanacearum
MKLRNWLMVTGGASALLACASTALAQTSAGERAAASDQIEEIVVTAQRRAQSIDDVGMTLNVVSNQQLQRQGVTQASDLVKVVPGFTVATNSDGTPIYTLRGVSFNSLNIGTSPTVSVYIDEASIPFSIMTQGGLLDLERVEVLKGPQGTLYGQNATGGAINYITAQPTETLAGGVKASYSRFDTFQTEAFVSGPVTDTLNARLAVSGVRSGPWQKSATRDDELGDQRKLAARLILDWRPVEALRFNLNVNGWGDWSDTQAPQFIQAKPNAPAFASPLLNTIAPNDTSARLADWDADKTYRKNNKFYQAALRGELKISDHVQLTSLTDYTYISVHYRNDNDGSSYFVSNMENDGFARAWNQELRLSGDVVDGRLKYIVGASYQQDDSLEDNTFTGALISSQETPFGRFAAAQAHGRQANRAQAGFANVDFELTKRLTLSGGARYTEVKHDTESCTRDAGDGELAAVATQLSAYLRSLAGLPPGATIPPGGCVSTGPDLLPYHQVESFKEHNVSWRLNLNYELNPDARLYATASRGYKAGNYQVAVNSSYVSFPPVHQEELTAYEVGAKLKLLDRRLALNAAVYYYDYQDKQLLTLTQDPVFGLQFSLVNVPKSSVKGFDADITWLPVRGLTIRAATTYADSAIDKFQGFDVFGAPADLSGKAFNLTPKWIGVGDVEYRHDLSGEYEGFVGASLNYNSKTYADIAGSDVLGIGAFTLVDLRAGVSSTDGRREAMVFVKNATDKYHWSYAQPGGDSVLRYASQPRTFGITLSQHF

SEQ ID NO: 12061 - protein, 718 aa, Ralstonia solanacearum
MNIKLSFIASSVLLAVSTPSLANSNNEASIFDEVVVSGTRSEQSVKNIPSTVSKVTAEQMEKNLATDVKQALKYEPGVTVNGRGRFGMQDFTIRGMSGNRVKMLIDGVEQPVSYNPGADVMRKNSNTIEVDTLTAIEINKGPSSSLYGSDALGGTVFLRTKNPEDMLGAGDDSHVGVTSGYSSADEQYKLGFEVANRTGDLESMLIYTYRNGHETDTYYKDSNEIGDARKAANPFDIASHNVLAKIFYQINDANRVGFTAEYYTRSADGRILSSDGKTISMRPPMPPIMYSNNRADDHDHRLRLGLEHEWLAEIAAFDSLEWKLNWTESESKHNSYDKTNYYGNRNRYRDGTDDTIQLDIQMKKELELANNRHEITYGVSGTNNTFDITYTDYNLDKGTSKLGPEEVPKSKSEKRAVFVQDQMFMLDEKLVVTAGLRYDDYQAKPDSDTLKDHKSDAFTGRLGAVYHFTDNFSTYGQFTQGFRAPTIHELYYDKENLAHGYKVISNPNLKPEESDAVELGLRLNGHLGSVATSVFYNNYKNFIKDVTTYDSNNIQITTNENVDKAKIYGAELKTSIWLDEALNAPMGTYANFSVAYTRGEDKKTGRELDTVAPLTAVLGLGYDSPDEMWGGVVDVTMVATKDKWQEEDHFNTPGYTVVDMTTYYRPSKDLTVRAGLFNAFDKKYWQYQNVDGIIVGKENFNCKTEPGRNWGVNVKYDF

SEQ ID NO: 12062 - protein, 762 aa, Ralstonia solanacearum
MIRNTKTPRRALLATSLLASGLAIAGAAHAQTTAAPSGPETVTEIIVTANRRSESVQAIGQSVSALTAESLERAAATSFFDFATAIPNLSFGAAAEGTTNSRSIAIRGIADRNTTGFYIDETPLPDSLDPKIIDVARIEVLRGPQGTLYGARSMGGTVRLITEQPKLDDPSGRLHVSLSNVRSAAHGNFMVDGALNVPLLKDRAALRIVAVHDQDAGYFTRAIGPYGAAPLKNRDNIGRSRTDGISLAGLVKLSDQLSVTPRVFYQRTRTDGFPFADVPTAAGGAQTRLQPSSLIQRRGFDVNEYSDDHWVLGTLDVRYKTPIGDIVSASSYFRRYTTNVEDQSDFIAFAFGTPLLPTQTQQDNRIEDYTQELRFSSDFSGPLQLVTGLYYDHKNTLRYYPPSYAHGLNAASGGAIGSDFIYTSSTPTLQTEYAAYAEATWSVTERLKLVGGLRAFDVETAASSRADGLVTGGPTRVPATSQSENGVIPKLSAQFRFTPDNQIYVTAAKGFRPGGVNGVVPTALGCAADLAALGRTPQSAAFYQSDSVWSYEVGSKNSFLDRRLTANVSVFRIDWSDIQQQIVLPCGFGFRGNAGSARSQGAELETTWRPVRDLTISAGVGYTDAVFTSTAAGTRFRDGDRVPQVPRYTANLSGDYRFALPRGLTGFLYADTKYVSSSTTALNAGANAQGALVQRIRPAYTIVDLRGGVELERYELALFVKNATDERASLGDSLSIAAEMPGRARVLMSQPREIGVEVRARF

SEQ ID NO: 12063 - protein, 745 aa, Ralstonia solanacearum
MLSSLRRMRASAAPSPARPSGAPFRPLALTARMAFAGLLTSGLGLPAFAQSAAKTSADTAEHAIQLPETVATGRADGDPVRPYTGGQTARGARAGLLGNKDTMDTPFSVSTYTAKRMEDQQATTLADVLNKDASVRFTGQTGGVTDSFYIRGFPVGEGNLSEVAFDGVYGVAPNYHVFPEYVERVEVIKGPAALLYGMSPNSGVGGVVNIVPRRALPQDLTRFTATYASDSQLGGHVDLSRRFGEGRAFGIRFNGVARQGNTPLDHQRSRTDIGALSLDYQGDRLRASLDVITQHEAVDAPTRPFLLASGVAMPSAAEGRRNVSQPWGWWKSDGQSALAHAEYDVSDRVTVFADAGGSQTSIGRLSDQTPTILDAAGNTRSTPGYYKFQVNRLTADAGARARFDTGTVKHALTLQASTYHDRVATANNMGTAILSNLYAPVTAPEQFIAAPAAVPKTSSSQLSGVAVADTMGVLDDRLQLTLGLRQQKVSSDNVSASTGAVTSSYDKSAVTPMAGIVIKPWRDVSLYANYIEGLSKGDIAPTTASNASQVFAPYKTKQYEAGVKVDRNGLLATLAVFQISKPSGQLTGTVYGVDGEQRNRGVELNLSGEPVKGVRLLGGVTVLDAVLTKTNSAATVGNRPVGVPGLMANAGAEWDLPWMPGLALNGNVTYTAKEYINQANTQSVPSWTTVDVGARYTTRLQGKSTTFRATVLNVFDRKYWAGVASFGTISLGAPRTVLLSASVDF

SEQ ID NO: 12064 - protein, 825 aa, Ralstonia solanacearum
MCTTKLRKYIILHPRFQRVIPPMPTPSNRLRTGRVKTRGLRLGGMGLVLALAFQGEALAEEFEFDIPAQALNSALKELGRQGDLQILYNPDDVNGKLGSAVHGRLTPEQAVADLLKKADVAHSFEANTLILGVAASAQPMNLGPVAIKGDHFGITTEGSGSYAATGISINKTAQSLRDTPQSVTVVTRQLMNDKNLTGLDEVMAQTPGITFSQRNFGSHVFSSRGFALEDESYTIDGVAGQGYSVTGWMTPDMQIYDRVEVLRGAAGLLIGAGNPGGAVNLVRKRPTALPQFSITTRAGSWDQYRVDLDGSSKLNDSGSVRGRFVTSYEDRGSFIDGLQKTAPLLYGILETDLSEDTTLTLGLRHQSADIHGFSIFGLPRYSNGKAIDLPRSTSLAQNWNRHQTRTDEVFSELETHFDENWSGTLSATHSEGAFEQKVAYAQGAIDPATQSGSRLVKTLFRSDALRSDGFDSHLDGRFDAFGLTHQVMVGGNWSEQKRDSRYATVNANQPLDIFNTDHNAITEPARPAWRSTDYSDKRYGVYSNLRLSLTESLSLVMGGRVSWYDYQSQSAGVTTRAQENNQVTPFLGVIYDLNRDWSWYASYTDIFLPQSGYRSASGAFLDPAIGASHETGIKGELFDKRLNVSFALFYVKQKDVAVEDDAHAGQCLSNDAYGTCYVNGDIRRSKGIDMEISGEPLPGLQTLAGYTFNLTRGSDGQSISAETPRHMVRLSSSYTLPGTWRRLTVGAGVSAQSGYSEHETTQPIDNPGRAIWDARASWKIDEHWSVALNGNNLLDHKYYKATGDIDRGNYYGDPRNYVMTLRGDF

SEQ ID NO: 12065 - protein, 289 aa, Ralstonia solanacearum
MRTLQGWLLPVFMLPMAVYAQEATVKEVHDAPAVRGSIIANMLQEHDNPFTLYPYDTNYLIYTQTSDLNKEAIASYDWAENARKDEVKFQLSLAFPLWRGILGPNSVLGASYTQKSWWQLSNSEESSPFRETNYEPQLFLGFATDYRFAGWTLRDVEMGYNHDSNGRSDPTSRSWNRLYTRLMAENGNWLVEVKPWYVVGNTDDNPDITKYMGYYQLKIGYHLGDAVLSAKGQYNWNTGYGGAELGLSYPITKHVRLYTQVYSGYGESLIDYNFNQTRVGVGVMLNDLF

SEQ ID NO: 12066 - protein, 729 aa, Ralstonia solanacearum
MIPFQPRALVLALAAALPSLAAAPALAQEAANPAAAAASSTSTAQATASKVRDLNETRVTAKRLDAARNALSPDTGSSVYRFDTDDIARLPLGDSTPLNQVLLQAPGVVQDSFGQLHVRGDHANLQYRINGVIIPEPISGFGQVLDTRFANQINVLTGALPAQYGYRTAGIVDIQTKGTATDEAGEPKAISGEIGTVLGSNATHEVNLQLQGTKDRFSYYLSGVFAENNLGIENPTGNRNATHDHTTQNKSFGMLSYLLDNDSRVSFMFGTANSRFQIPTRPGLEPQFTLDGVTPPASEALNANQREKTDFQILTYQQKVSPKLDYQVSVFRRASRIDYSPDPVGDLVYNGVASDVSRRNEAYGLQGDASYKLNDRHTLRAGLFVQRERFGVDNASTVFPADSTGAQTSGTPLTVIDNSSGSGTTLGAYLQDEWKPTDRLTINYGARYDHVNTIVSEQQLSPRLGLTFDLTSRTRLHAGYARYFTPPPTEKFDTTTVQKFAGTTNALSPDANTAVKSERSNYFDLGISHQLTPHLTLGLDAYYRDVRHLQDEGQFGNALLFSAFNYERGRIYGLEASVNYREGDFGAYLNLGVSRAQGKGIETGQFHFDDAELAYINSHWVNLDHDQRLTASAGVSYKYWGTTWLADALFGSGLRNGFANTDHLPAYWQLNLGAARDFNLPMVGKLKTRLTVLNVLDRSYELRDGTGIGVGAPQFAPRRTFLLSVSKPF

SEQ ID NO: 12067 - protein, 726 aa, Ralstonia solanacearum
MTCTQATLLSLSIAAALGCIGAARAQQTATVQATEATTLDQVVVSGRLRSLEQFTPTGSRLNLSARETPGTLDAINAAAIEARGLRSVEKAAESLPGINTGGSPGNPATFSMRGFTDGQITILHNGLYLGPSNMTNRPQNTFNLQSVEVLKGPASVIYGQGAVGGAVNVTNKAPTFGPAQYELLLGASSYGGRVFGVGAGGGINDDWAYRADISQVSSDGYVHGADSSAINATVSLLWHPREDISAQFSLDYAKDQPSTYFGTPLLPAAAARTPINGILRAPNGEVVDAATRRTNYNVADASIDSRQLWPQAYLKWKVTDAITVQNMAYYFHADRRWINAENYTYNPQSGRIERDRFFVYHEQALWGNQTSATFDQRIAGLKNRLVVGLDYSRLDFVRNRGFPDGDSVAVDARGPSGEFGERVRRRSPTTWTNAALFFEDALDVTDKAKLVLGGRYEYLDLDRKNFGPDGGFQAASSFSRTYRPANGRLGLVYALTPNITPYASYTTATDPVGSNIFIVNAGQDFALSKSRQAEVGVKAATADQRLSGTLAVYDIKRNNILALTAQDALSNIGRQTSRGFELSVDAQLTSQWSANANYAYVDAEYAQFIDSNSGLDASGNRPTNVPKSLFNAWTSVRNVAGLPLELGASVRHVGTRYGNLANTLRLESYTLTGAYATYDMNSEVSLSLHADNLFNTHYVQWADVFYPGQVILGLPRTVELSLHARF

SEQ ID NO: 12068 - protein, 353 aa, Ralstonia solanacearum
MQLKRCFKLAALAAAAGLTMGAAHAQSSVTLYGQVDAWVGAQKGFDSSRAGVVNPGGMSTSYWGLKGSEDLGNGLKSLFALEAFFRPDTGRAGRFDGDNFFARNAFVGLSSNAWGTIKLGRNTPPYFVSTILFNPFIDSYTFSPAVFHTYLGNGLSGAAGISGLVGDSGWNNSILYSTPDFNGLSANLIYGAGEQAGHNGQNKWGGSLLYFHGNFAATAAYQQVRFDANPGDLDTIVAGFRRQDAALLGATYDFGVVKLYGQYQHIKNTISTGDTKANGGQLGVSVPVGAGSILASYAYTKTSGAVDVKRNTWAIGYDYALSKRTDLYAAYFRDKVTSLSTADTFGVGMRAKF

SEQ ID NO: 12069 - protein, 746 aa, Ralstonia solanacearum
MLSSLRRKPASAMPLPARGSGAPFRPLALTARMAFAGVLTSGLGLPAFAQSVSKSATETAEQAIQLPETVATGRTSDDPLRPYAGGQTARGGRVGLLGNQDTMDTPFSVSTTTARRMEDQQATTLADVLNKDASVRFTGQTGGVTDSFYIRGFPVGEGNLSEVAFDGVYGVAPNYHVFPEYVERVEVIKGPAALLYGMSPNSGVGGVVNIAPKRALPQDLTHFTATYASDLQLGGHIDLSRRFGQGRAFGIRFNGVARQGKTPLDHQRSRTDIGALSLDYQGDRLRASLDVITQHEAVDAPTRPFLLAAGVAMPSAADGRRNVSQPWGWWKSDGQSALAHAEYDVSDRVTVFADAGGSQTRIGRLSDQTPTLLDAAGNTRSTPGYYKFQVNRLSADAGVRARVDTGPVRHALALQASTYHDRIATASNMGTAILSNLYAPVNAPEPFIAAPAAVPKTSSSQLSGVALADTMGVLDDRLQLTLGLRQQQVNSDNFSASTGAVTASYDKRAVTPMAGIVIKPWRGDVSLYANYIEGLSKGDIAPTTASNAGQVFAPYKTRQYEAGVKVDRNGLLATLAVFQITKPSGQLTGTVYGVDGEQRNRGVELNLSGEPVRGVRLLGGVTVLDAVLTKTNSAATVGNRPVGVPGLMANAGAEWDLPWMPGLALNGSVTYTAKEYINQANTQSVPSWTTVDVGARYTTRLQGKSTTFRATVLNVLDRKYWSGVASFGTISLGAPRTVLLSAAVDF

SEQ ID NO: 12070 - protein, 356 aa, Ralstonia solanacearum
MVKLRSIANVSIVFSTLLYLSLGAVYAAETDNSEAANEFDPYFYLGAKAGQMHYQNACESWSISCDGNDVGFGGFVGYQAWQYLGFETAYLDLGEAVAHYSESGVNNTYTGSMKGWEISAVTRFSLSESFELFAKAGSVYWDGDNRGPQSRNSDSDWAPMLGAGVEYQLSPSWVARLEYQYIDSLGSDLIGGSNGHLTTLGISYRFGQSATKAQPPVKETPVTLPEKIIPVTPKQIVLPALTVISLFDFDSSELTHSGSLAPVIERLKQSPEAIANIKGYTDSKGNATYNQALSERRAQAVADYLIAAGIKPEQIEVHGYGEQFPLMKNDTPEHRHENRRVLIHIQSTTSEMKPEI

SEQ ID NO: 12071 - protein, 684 aa, Ralstonia solanacearum
MAPITRASYSACYSLTHRLVVYSVAGLATLCSPAAFADNEPAASGTSVSDTADLAAMPLEALMQVTVNTASRFDQSVTDAPAAVVVLTAEDIREFGWRTLADALASLPGLYVTNDRSYQYLGARGFQRPGDYNSRFLLLIDGIRTNDGVYGQAPIGSDFPLDMDLVKRIEYVPGPGSSMYGANALFGVINVITKSGSDLAGAEAAVAAGSFGEKKARASYGWHGAHGADILLSATAYGRNGEDLYYPEFDTPDQNHGVAHRLDYDRAQDFLARAAYGDFRFSFIYGNRTKGIPDAPYGAVFNAPFSVSDTHSYADLTYQHALSDGVMLASQLYWGRYDYRMPAIDGPAPYVVNIDGSHALWYGADVHATISSLAKHRIVVGADFARDARLNQYNYNVDPYSQMLDDHHSGNRAGVYVEDEITLPWNFTLNAGLRYDQQTSAGGNLSPRIGLIYKLTPRDTFKLLYGQAYRAPNAYEMYYAISGPDGQLGNRSLKAEHIATTELVYERALFTTARATLSLFQYDARDLISQTLDESSGLFIFRNVSRASARGAELAYEQRVAGARVRASYSYQIAHDSNTGASLQNSPRHLGKLNLAVPFFANALMTGLEVQCTSSRLAAAGDAGGFCLANLTLSSRRLVRGADLSFSIYNLTDKRYADPVGPGFTQETVAQQGRTFLFKAVYGF

SEQ ID NO: 12072 - protein, 347 aa, Ralstonia solanacearum
MKHWMCAAGALALTGAAHAQSSVTLYGLIDTSVRYTTHENANGSGKLQMTEGLLTGSRWGLRADEDLGGGRKAFTQLESGFSPDTGSSLQGGRLFGRTALVGLKGDWGTVTLGRQYTVAHDVMSSYESMALANVSIVGYQGGNYTGLRQDNLLKYTYTLGPWQTELGYTFGEVPGSTRAGSTAAAALIYAQGPLMLAGVFQQSRDVTTSFFGLSIPASRQNVWSAGGTYQLGKSMLYFGFTSSALDVADYRNRAVYIGAKVPLTPALTFITTLTGDRVKHQGDGGNRFTGAAALDYSFSKRTDVYASIDYTSVRGAWATLASLPNFATPFFGYSSRLGVMAGLPHKF

SEQ ID NO: 12073 - protein, 683 aa, Ralstonia solanacearum
MPAFRCTARAVLSVLAVFSLSPLSLAVAETLPIENSTLTLGAVNVTSTESGPLATSSVLSSVDILGGDILEKMPVTYSWELFSRAPGVMLTEFNQGTTSGKLSFRGFNGEGEVNAVKLLIDGIPSNTNDGNMPFIDSVFPMDIDSIEVVRGTSDPRYGLNNIAGNVNINTRTGGNYNKARLRYGSFNTREVQLAKGIETSNWTQNYFFARQQVDGYRDHADTERYSFGGKWFYTPDDGSYRLGLIARHYESEAQEAGYLTEDDARHHPRMSNDYNATDKGTRRMNQVSVHFDTDLAETLSWSAKTYLNTYDDRRWTQYWRTSSQQERDTYEDQYGAITSLTWRPQVDWLHAFALEGGSDMQKQQNRSERYRTVERVRQAQTRDQDFDFNTVGAYVQAEIEPFESLKIVPAYRVDKISGDFTNKMTGQDYDINDYGLIKQPKLSIVYSPWKFASVYANWGRTFQVGTGAAAYKVPPRNEDLDPSINEGWETGVKFTPASWVDGRVAYWRQDASGEVSRRLNDPSGESDNVGETRRWGYDLQVNLHPDERTEVWMSYSWQYSKILEPSSALPGSKGQEIDHVPHHLWNTGISYQATPALQLTAWANGQTNYYLERENTQGTYGGYVLMNLGATYKLSETMSVDLQLKNLTNRYYEYVWYDPDGADASLHSPGDGRALYAGLTLDF

SEQ ID NO: 12074 - protein, 686 aa, Ralstonia solanacearum
MAGQPDDRAAEDGRPAGASNSAEVELPAVTITASKRDQSLASINGAAAVVQQPALDDAQVASTQDLQRVLPGVEIAGGGSLLFPVISVRGVSSAQDFYNPALTLYVDGVPQLPTFTSQTLLSVDRVELLKGPQGTLYGKSAEGGVLNIVTLPPDDMLRVRLRTGLSSRGGNVEQAEVAGPLVKALLYGSVSLAQVDAPGDLRNPVSGASHQGGSRSLAGNVKLRLAPAGAPWEAGLSAGRDCTKATQDIYVPFDNIASRTANIDPRMPAQYAEPYLRRCGNSYALSGRYDFGQWRLSAVSAWQTVDIARRFPYLQYFLQQPEQWRQNVQELRLATRAPKRRWDAVFGLYRQDVHQSRFSTYDMVIPSVVNLTTTTSGNQSKSLAAYGDVTWHATGALDLSAGLRASRDQAWTAFAGTTMTSSGAYSMFSGANASAGNRVLGKVSAGYRLDPAWRVYANVSQGYKPGGFNLAPSSPADARGYGPERAISREIGARYDSRSLRGNVALYRIDIHDAQLFSGNALGYQTLSNVGDTRSTGAEFGLEWDVARGWTAGLDGFVNHATFRSYSDLYGCTACVGNDVPFAPRYGLTLNLAGKVPTAIGVVRPRVAVRWLGAQYFDTANRLRQGSYALVDASLGWRPRHDIEIALYVQNLTNRDYRTYAFAAPTGNLAMVGLGRTVGMTVSFDY

SEQ ID NO: 12075 - protein, 415 aa, Ralstonia solanacearum
MPFAKFPRRFQQGNTGNLEEPASGTRGRAFDTLSFQRAHMKKSAILVAVGALFAGSAYAQSSVTLYGIVDTSIHYITNANSAGNSLTQMESGAVSNSRWGLKGSEDLGGGNKALFVLESGFNSATGRMSSSGTLFNRQSYVGLSNKDLGTLTLGRQYNFGFTMGGNFDPLGVGNYDGNSWMFYGLTGLRESNMVKYENKINGLYVGLGYGFGEVAGSLSQNQFLGAAVSYEFGPAMIGGLYQQHKDIAGNKQTVWSIGGNYTIGPAKLFLGYLDSSDATGCVNSSSNCVGGSAFGLNIYGNATTGAGLTPGATKRRDHVGMGGVTYQVTPALALTGAFYYDSISNAALTAGNDGKRYTAVLLAEYALSKRTQVYGTVDYNKVKDAAIPQLQGGTNDGTGAKTNQTSVGVGIRHIF

SEQ ID NO: 12076 - protein, 376 aa, Ralstonia solanacearum
MSRTTFALAAITAAVAGLAATGAQAQTSSVTLYGLIDTTISTVSNTNAAGARTTGFQVPWFSGSRWGLTGKEDLGGGTSAIFKLESEFETPTGNMDTPGVLFNRDAWVGLSNPTFGKLTFGRQNALARDVAGIYGDPYTSAEVTLEEGGFTNVNNFKQLIFYAGSATGTRLNNGVVWKKLWDGGFFTGLAYQFGEVPGQFSQNTTETAALGYNGGNFHLSAFAQQAKVNGFTDRSYSLGGNVILGMFRVNAGYFHYTGDQPAAIGNRKDDAYTVSLKIAPPGAFDYEIGYQIMKAGNAAFNADGNTLNAYADVSTATAAGSGRKNTLYGSVFYHVSKRTEFYVAADYMKLKDQYIVGSTNGHNSQTEFGVGMRTRF

SEQ ID NO: 12077 - protein, 376 aa, Ralstonia solanacearum
MKKSAILVAVGALFAGSAYAQSSVTLYGIVDTSIHYINNANQAGNSVTQMESGAVSNSRWGLKGSEDLGGGTKALFVLESGFNSATGKMSSAGTLFNRQSFVGLSNKDLGTITLGRQYNFGFTTGGNFDPLGVGNYDGNSWMYYGLTGLRESNMLKYEGKWNGLSVGLAYGFGEVPGAASQNSYVGGTVAYEFGPAYIGAFAQQHKDIAGNKQTVWGIGGNYTIAAAKLFAGYIDSSDATGCVNSSANCVGGSAFGLNIYGNATSGAGLTPGATKRRDHVGILGVTYNITPALALTGAFYYDSINNAALTAGNDGKRYTGVLLAEYALSKRTQVYGTVDYNKVKDAALPELSGGGNATGVGKSNQTSVGVGIRHIF

SEQ ID NO: 12078 - protein, 210 aa, Ralstonia solanacearum
MLWKTKRAVALAVAAASGAMSAAAHAQSSVTLYGQVDAWVGAQKGFDSSRAGVVNPGGMSTSYWGLKGSEDLGNGLKSLFALEAFFRPDTGRAGRFDGDNFFARNAFVGLSSNAWGTIKLGRNTPPYFVSTILFNPFIDSYTFSPAVFHTYLGNGLSGAAGISGLVGDSGWNNSILYSTPDFNGLSANLIYGAGEQADHNGQNKWGGSMQ

SEQ ID NO: 12079 - protein, 737 aa, Ralstonia solanacearum
MTDAPHADRIGAFSVPQRMFWARPVFTHPDGSLFAMTSRLAARALSCALAAIPLAVSTLARADATSGAQAAATVDLDETTVTARSQRGFAAGTAEVGSFRGQSLRDIPATVNVITREALDAQQDRTLYDALRNTAGVTRQQLSGETFDNIAIRGVTMENRTNFRFNGSMPFFNLMAIPLEDKERVEVLKGVSALYYGYTTPGGIVNLVTKRAGNTPVTSVGMSIDNNGTAITSVDVARRFGEDNQYGLRFNAAGGKLESPTSGIDGDRQMASVAFDWKVNSRLSLKADVEYARQVITEQSVVTLPAAKNGVISLPAMPDPTKRLSPDWAKFRANSTTAMLRADYALNDDWLVTVEGGTSELARTRAFTEIGSVNAVTGKGTISGNRQDGRWTTGHLRTDLNGTQMTGSIKHELTFGVARSEMRQAAVYSSRFTGTQNLYNPVDLGWLPTTGTSVTAAQRAVDTGVYALDRVTLTQHWQVIAGLRYTSYTSVQAPNRYDASKTTPLGALIYKFTPTLSAYASYAQGLEAGDRAPNTAANANVAMPPAVSNQKEVGVRYETPLGTQLSAALYEIDRAASYTNASNVYVQDGRQRIRGVELNAQGRVTNDLSLLASGGWIDAKFRGVGNGLAGKTPENTPRATASLFAEYTLPMLRSVSLNAGAYYVGTRPVNDADQAWLGGTTLFGAGARYVTRLAGKRTTWQLNVDNLTDKRYWAAAGNNRLAMGAPRVFKLSMKIDL

SEQ ID NO: 12080 - protein, 305 aa, Ralstonia solanacearum
MIRNTRRFAAAFACAASCALAAPLAHAQATAEPAASINGSGDSGDSGGGFSSFMDNYVWGRNIMAVGWFHIRPLDSATPLTTSTSSLGLGTWQSPGTDVRVSNADTLSLTFTHFFDDNWAGTFVGGVPPKFNLYGSGNVIAPIPVIGPLTLINLGLPQNNPVATVREWSPAILVEYHFGTAQSKVRPFVGVGVSYNFFTNLRLNSNFVNALQNLGQTLQLGMGQIPTGPGKVSAETSNSWTPTATVGVSYEFAKNWIATGSVSYLPLKTTSTITIRSQQGQVLATNKTDIKIDPIVFGLNLGYRF

SEQ ID NO: 12081 - protein, 715 aa, Ralstonia solanacearum
MIPAQKLFISLPQKKKLTLLILAAMQPGIAIAEEVIPDVITVTATRAERTSAEVPESIAIIDHERIEQEKMYNINDALKGTPGVLVESTSGAYSSRMIIRGAGLKAQYGIREVMLLRDGVPITDPDSFTRMDFIDTQDIEQIEISKGPGNIYATGSTGGAIHILSKSVFDDRRDQLRFGLGEYGNRNLHARKSYMTEEGNAFAFTASHRQSDNDWRRNNDFESNQFSFKTGFLPSENSELETEFSYTKAQLNLPGDMSEAQFQEYKRTGNQTDNNSAFKHSARNSEIFFFNSRLNVELGELTLKPRVYYNHWSHFHPVTGVINDTPGVDIWGTDLEFEYAHSLVGEDSLVAGITYRQDRNIGAKKYAYADITTAGPTITATLSDRKGDLLEVQDEINTVHGFFMQESLRPSEDWIVDAGFRFDHITIEQNTWNSDTSYNYGMGGYVTSVGSGGNTEMKHSFDLFSPRIGVTYKLNKNLSLFGNIAQGEQVPFASELESNNDLKSATSRSVEFGLKGRAQHWQFDLNAYVSEVEDEIIRVRTNGENIYQNAGGTDKKGVELSGAFQVLENTLPGKLMLGGSYAYSNYSYSEFSEIVYGMGPPTNFDRSGNQLPYIPEHYFSINATYEHPSGLKARIQSDSWGEYYLDNANTEKYGGYDFVTSFNLSYSEGPHDISLNIQNLFDKRYAVEVEKDTGGDKSYSPGAPRSAMLSYSYQF

SEQ ID NO: 12082 - protein, 626 aa, Ralstonia solanacearum
MHRAAMGALAGALTGVAVGPVWAQSDTQAAAVPVGELNPTVVTASRSEQKLADALPHTTVITRADIERSQAPDAVSLLRREAGIEIAQAGGPGATASLFMRGAGSNQTLVLIDGVRVSSGTAGTTQIEQLMADQIDHIEIVRGNVSALYGSDAIGGVVQIFTRNGRGHAPLANAEIEYGARNTKRAQAGISGELDARGDTSFALSVSEFRTTGFSSINPQQAPNANPNDNAYTNKSVSAQLQHRFSADWQAGLTWFQTWSNVSYDNAFGSPTDDNDSHNQVRAMSIYVDGKLTPDWKTRLTLSQGDDRNLNFTNGQVQVPGRFNTQNQQASWQHDWTFLPDQMLKVGFEHLQQTIDTDAYAPPTRRVESGYVGYEGKFGPHQLQLNLRRDRYSDFGGATSYYAGYGFAFTPQWRAVASLSNAFRAPSFNELYYPFFGNPNLQPEKARSVEGGVEYQSTIGLVRVTAFETDYSNLITSVFDPVSGNFLAANVNRARVNGLETSWRGTLYGVDVRASFTMQNPQDLSANQLLLRHARHFGSVSAYKSFGPFSAGIEWNAAGERQDSARTLGGYGLLNLTGRYQITRDWALSARVENLLNKNYQLIDPYNTASRGVFFTLSWQQHAPQR

SEQ ID NO: 12083 - protein, 689 aa, Ralstonia solanacearum
MALFGAPELAAADEAPTFALEEAVVRAQAGARLRARSATSATLTDTPLKDVPQSVGVVTRAALDDFGATRLDTALDWVSGISRQNNLGGIADNFAIRGFAGDLNTGSDYLVNGFSANRANSVPVDTINIARIDVLKGPSAALYGRSDPGGIVNIVTRTPQFKPSREITLAAGSHDQYRLATELTGPLSERFAYRLGVAAENNHSFRDFSTSRRYAIAPSFTWLPTDDTVVTYAFEAAQLKAPFDRGVVAINKQLGALPNSRFLGEPGDGDTTVRTQSHQLTVEHQLGSGWKVDAGLSYRTSHLFGKSSDASRLLDDGRTLWRQARERDYRANDLAGRVDVQGDVTSGPVKHTLVAGADFYDFRYDTVMYRANPSASAPYAIDIFDPVYGQPRPAMRLNSSTRESQRGFGAFVQDQVTLTPHWKLLAGVRADRFLQHADNRLTGVRVAQQQTAYSPRLGLVYQPTQTLSLYANTSRSFRPNTGVGAQGNAFAPERGRGYEVGAKLETADGRFGGTLALYSIDKANVLTGDPRDPAFQRTAGAVRSRGVELDVSGQLTANLKVLGTYAYTDARVTADTVLPSGAPLSNIPRHSASVLGLYEFGAGSLGRAGVGGGVVYVGERAGNSTDNGFKLPAYATVRLNGYVQPTRALRLSLTIDNLFDKRYYASSYNELWVAPGAERQVTLAATYTF

SEQ ID NO: 12084 - protein, 800 aa, Ralstonia solanacearum
MNRHRRPVRRSRVPRLATLAAALFASAAVAQSRVAIDIPAEPLDAALNALARRAGVQLVFASALTAGKTAPRVQGRYSIEETLHRLLAQTGLTARRQGDDTFTIEAASSGAEVTLPATVATAAQAESANGPVRGYVARRSATGTKTDAPIEEIPQSISVVTRDRFEAQGAQSVNEALRYTASVSSYGAGTRSDWYTAVRGFVPATYLDGLQLPNTINLASWRVDPWQIERVELLRGPASVLYGQGDPGGTVNIVTKQPTTEPIREIEVQYGSHARKQVAGDFAGALDADGKLSYRLTALARDGNLPLGPFNDQRLMIAPSLTWKPSADTTLTLLASTLRDKTNASDSFLPAQGTILPNPNGKIPATLFTGSPDFDAYEKTQYSLGYQFEHRLNDTWTVRQNARYMHLKLDDRMTYGVGLDPSDPAQRTLLRYAGIAQPSYGRLDIDTQAQARFATGAVRHTLLAGVDYQRQTAKDPEDYALTSSLDLYNPVYRPTDLSIFSGVGASPQDIRQRQTLLGLYLQDQVKLGERWVFTVGGRHDWSETRTDDRLGGTTGSQRDSAFTGRVGVVYLAPYGISPYVSYATSFNPTIGTDRNGQAFRPTKGRQVEAGVKVQAGSKASVTASVFRIHQTNVLTPDLDDPSGTHSAQAGEVRSQGFELEATVQPIAGWNVIAAYTYQDVRNTRANDATLDKWPIAIPTPRQIASLWMDYRIRTGVLQGVGIGAGVRYVSPVAGAPDNALKVPGYALFDAALFYNVGRHWHLALNGTNLANREVISGCYDATRCIYANGRTVLASAKYAW

SEQ ID NO: 12085 - protein, 683 aa, Ralstonia solanacearum
MAGPMSALAGGLQQPEVQLETTTVVGSAAAAAATSEAASQGYVPHAQLENRPLLRPGELLETVPGLIVTQHSGDGKANQYFLRGFNLDHGTDLATTVAGMPVNMRTHAHGQGYTDLNFVIPELVSGIAYKKGTYFAEEGDFSAAGAVRIDYADKLPHGLAQFELGEYGYRRGLLANSNTVGPGTLLYGFEWLGENGPWVVPEGVHKLNGVLRYTLPLGGGERITVTGMAYKNTWQSTDQVPQRAIDAGLISRFGAIDPTDGGMASRYSLSADWLRPLADGQFKANAYVIKSRLTLFSNFTYALANPELGDQFEQFENRVTTGFNASRTWFGEIAGHDSETEVGSQTRYDRLDPILLADTVARQPYAVVRSDTVNETSTALYLRNSIQWRPWLRTLAGLRADQFWYSVGSSNPLNSGSGAEHIVSPKLGMVLSPTAGTDVFVNWGRGYHSNDVRGATTTVDPVSGNPVQKVSVLVPATGYEIGVRTKELARGLQLSASLWRLDIGSELVFAGDTGTTQPSRPSRRTGVELAAYYKPSPELILDADAAFSRARFRDADPVGDYIPEAIQTTASAGVSWTHGRWTLGARLRYFGPRPLIEDNSVRSASSFLVNLKIGYRVQKNVRVFIEVLNALNRKANDIDYYYASLLKGETSPVDANGVATGINDRHIHPAEPRTVRAGIAWAF

SEQ ID NO: 12086 - protein, 648 aa, Ralstonia solanacearum
MPRPVRDVPATVIVLPRAEIDRSPSLTQDGLLRTVPSVATFRRTSSLVSDPTAQGLNLRGLAPSGVSRSLVLVDGVPANDPFGGWVYWRSLPRLGLDRVEVVPSGGSALYGSAALGGVVQLFSRPITVPLLEGDVAYGLLNTGQLSARGAHRWGPVGAAVETDLLTTRGHPVVASAQRGAIDRSTPGNHATLNGRVEVEASPFLRLNARLSLFRENQNGGTTYTTARAESGLASAGAQLATEEAGQFELQLFGRLQRFEQRRARVAADRSTEALSAIQEVPANEQGASLVWTGPSWTLGGTHVLTAGADVRRVEGTSDERLFVPNPSPSSTALRNAGGEQRFGGLFLQNLYTVTPALEFMAALRWDAWQNVNGKSRLEQVGGTVTPVRFEDRSEYQLSPRLGARLRPLEWLTLRASGYRSFRAPTLNELYRPFQVGTVLTAANERLRAERLVGGEAGAEVQGPRGLTARVTGFWNTLEDPIINATLATPLPDGTARQRQNLGRARVRGLEASTDWRLARAWTVLLAYTFVDSEVRDAPGNEELVGKQLAQDPRHRGTALVTFDEPSLLTATVQLRVIGPQFEDDLNAREMGGYAVVDASVSRRLVRGLELFAAVENLFDREYLVGRAGVDTIGQPLLVRMGLRLRGGL

SEQ ID NO: 12087 - protein, 177 aa, Neisseria meningitidis
YAAERITHDYPKPTGADKDKISTVSDYFRNIRAHSIHPRVSVGYDFGGWRIAADYASYRKWNNNKYSVNTKELQRNKEHGNWKELKTENQENGSFHAVSSLGLSAIYDFKLNDKFDKFKPYIGARVAYGHVKHQVHSVRKETTTVFSKPSGSATKPGQIPSLVTKPAYHESHSISSL

SEQ ID NO: 12088 - protein, 176 aa, Neisseria meningitidis
YAAERITHNYPEPTGADKDKISTVSDYFRNIRAHSIHPRVSVGYDFGGWRIAADYASYRKWNNNKYSVNTKKVQENQGTRKDLKTENQENGSFHAASSLGLSAIYDFKLNDKFDKFKPYIGARVAYGHVKHQVHSVEKETEIVTTVPTGGAQTGGTIPQGPTPKPPYHESNSISSL

SEQ ID NO: 12089 - protein, 178 aa, Neisseria meningitidis
YAAERITHDYPKPTGTDKDKISTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPRGITEPGKVVKGPTSKPPYHESHSTSSL

SEQ ID NO: 12090 - protein, 170 aa, Neisseria meningitidis
YAAERITHDYPKATGANNTSTVSDYFRNIRAHSIHPRVSVGYDFGDWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12091 - protein, 173 aa, Neisseria meningitidis
YAAERITHNYPQATGANNTSTVSDYFRNIRAHSIHPRVSVGYDFGDWRIAADYASYRKWKESNSSTKKVTEDIADNYEETKTEHQGNGSFHASSSLGLSAIYDFKLNDKFDKFKPYIGARVAHGHVRHQVNSVDKETITLISKPKGNSPGGGRVVSSLPSKPPYHESNSISSL

SEQ ID NO: 12092 - protein, 170 aa, Neisseria meningitidis
YAAERITHDYPQATGANNTSTVSDYFRNIRAHSIHPRVSVGYDFGGWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12093 - protein, 170 aa, Neisseria meningitidis
YAAERITHDYPKPTGTDKDKISTVSDYFRNIRAHSIHPRVSVGYDFGGWRIAADYASYRKWNNNKYSVNIKKGRETPDNREELKTENQENGSFHAASSLGLSAIYDFKLNDKFDKFKPYIGARVAYGHVKHQVHSVETKTTIVTSKPNGGPVPSSVTKPPYHQSHSISSL

SEQ ID NO: 12094 - protein, 176 aa, Neisseria meningitidis
YAAERITHDYPKATGTDKDKISTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGDATVGGTIPERPSSKPAYHESNSISSL

SEQ ID NO: 12095 - protein, 170 aa, Neisseria meningitidis
YAAERITHDYPKATGANNTSTVSDYFRNICAHSIHPRVSVGYDFGDWRIAADYASYRKWNNNKYSVNTKELENKHNNKKDLKTENQENGTFHAASSLGLSAIYDFKLNDKFKPYIGARVAYGHVRHSIDSTKKTTEVVTSTHGGADTKPTIYNGESTQNAYHESHSIRRL

SEQ ID NO: 12096 - protein, 178 aa, Neisseria meningitidis
YAAERITHDYPKATGADKDKISTVSDYFRNIRAHSIHPRVSVGYDFGGWRIAADYASYRKWNDNKYSVNTKELQRNKEHGNWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12097 - protein, 176 aa, Neisseria meningitidis
YAAERITHDYPKPTGANNTSTVSDYFRNIRAHSIHPRVSVGYDFGDWRIAADYASYRKWNNNKYSVNTKELQRNKEYGNWIELKTENQGNGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12098 - protein, 177 aa, Neisseria meningitidis
YAAERITHDYPQATGANNTSTVSDYFRNIRTHSIHPRVSVGYDFGDWRIAADYASYRKWNNNKYSVNTKEVGRNNNNNIDIWKELKTENQENGSFHAASSLGLSAIYDFKLNDKFDKFKPYIGVRVAYGHVKHQVHSVRKETTTVFSKPSGSTTKPGEIPSLVTKPAYHESNSISSL

SEQ ID NO: 12099 - protein, 175 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQGNGSFHAASSLGLSAIYDFKLNDKFDKFKPYIGARVAYGHVKHQVHSVESKNTIVTSKPTQGAAQGGPVPTGFVPKSAYHESHSISSL

SEQ ID NO: 12100 - protein, 178 aa, Neisseria meningitidis
YAAERITHDYPKATGANNTSTVSDYFRNIRTHSIHPRVSVGYDFGDWRIAADYASYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12101 - protein, 175 aa, Neisseria meningitidis
YAAERITHNYPEPTGADKDKISTVSDYFRNIRAHSIHPRVSVGYDFGDWRIAADYASYRKWNNNKYSVNTKVLQKNQGNRIELKTENQENGSFHAASSLGLSAIYDFKLNDKFDKFKPYIGVRVAYGHVKHQVHSVRKETTTAFLKPSKGATEPGKIPSLVTKPAYHESHSTSSL

SEQ ID NO: 12102 - protein, 174 aa, Neisseria meningitidis
YAAERITHDYPQATGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGARVAYGHVKHQVHSVRKETTTVFSKPSGSVTKPGEIVETPTSKPAYHESHSISSL

SEQ ID NO: 12103 - protein, 172 aa, Neisseria meningitidis
YAAERITHDYPEATGANNTSTVSDYFRNIRTHSIHPRVSVGYDFGGWRIAADYARYRKWNNNKYSVNTKNVQVHKSNGNREDLKTENQENGTFHAVSSFGLSAVYDFDTGSRFKPYAGVRVAYGHVRHSIDSTKKTTNVLTVPSNIPGGTPTIYNQGSTQNAYHESHSIRRL

SEQ ID NO: 12104 - protein, 170 aa, Neisseria meningitidis
YAAERITHNYPEPTGANNTSTVSDYFRNIRAHSIHPRVSVGYDFGGWRIAADYASYRKWNDNKYSVNTKKVQENQGTRKDLKTENQENGSFHAASSLGLSAIYDFKLNDKFKPYIGARVAYGHVRHSIDSTKKTTEVVTSTHGGADTKPTIYNGESTQNAYHESHSIRRL

SEQ ID NO: 12105 - protein, 170 aa, Neisseria meningitidis
YAAERITHDYPKATGANNTSTVSDYFRNIRAHSIHPRVSVGYDFGDWRIAADYASYRKWKESNSSTKKVTEDIAGNYKETKTEHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12106 - protein, 180 aa, Neisseria meningitidis
YAAERITHDYPKPTGTDKDKISTVSDYFRNIRAHSIHPRVSVGYDFGDWRIAADYASYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12107 - protein, 165 aa, Neisseria meningitidis
YAAERITHDYPQATGANNTSTVSDYFRNIRAHSIHPRVSVGYDFGGWRIAADYASYRKWKESNYSKKVTEFKHENGNKKEDKTEHQGNGSFHAASSLGLSAIYDFKLNDKFKPYIGARVAYGHVKHQVHSVESKTTTVTSKDGGPIPQGPTPKPPYHESNSISSL

SEQ ID NO: 12108 - protein, 173 aa, Neisseria meningitidis
YAAERITHDYPKATGANNTSTVSDYFRNIRAHSIHPRVSVGYDFGGWRIAADYASYRKWKESNSSTNAENRDSIQNYVKIETKHQGNGSFHAASSLGLSAIYDFKLNDKFDKFKPYIGARVAYGHVKHQVHSVETETKIIFTTPTKGAKVGGTILDKSMSKPPYHESNSISSL

SEQ ID NO: 12109 - protein, 176 aa, Neisseria meningitidis
YAAERITHDYPQATGANNTSTVSDYFRNIRAHSIHPRVSVGYDFGGWRIAADYASYRKWNNNKYSVNTKEVERNNTSGNWKELKTENQENGSFHAASSLGLSAIYDFKLNDKFDKFKPYIGARVAYGHVKHQVHSVKTETKTIFTAPTGGAQQGGTIPEKPSSKPPYHESHSISSV

SEQ ID NO: 12110 - protein, 170 aa, Neisseria meningitidis
YAAERITHDYPKATGADKDKISTVSDYFRNIRAHSIHPRVSVGYDFGGWRIAADYASYRKWNNNKYSVNTKKVQENQGTRKDLKTENQENGSFHAASSLGLSAIYDFKLNDKFDKFKPYIGVRVAYGHVKHQVHSVKKETTTVTSKGGGPIIQGPVSQPPYHESNSIGSL

SEQ ID NO: 12111 - protein, 173 aa, Neisseria meningitidis
YAAERITHDYPKPTGANNTSTVSDYFRNIRTHSIHPRVSVGYDFGDWRIAADYASYRKWNNNKYSVNTKVLKENKGNRENLKTENQENGSFHASSSLGLSAIYDFKLNDKFDKFKPYIGARVAYGHVRHSIDSTKKTTNVLTVPSNIPGGTPTIYNQGSTQNAYHESHSIRRL

SEQ ID NO: 12112 - protein, 174 aa, Neisseria meningitidis
YAAERITHDYPKPTGANNTSTVSDYFRNIRAHSIHPRVSVGYDFGGWRIAADYASYRKWNNNKYSVNTKEVERNNSTGTDNWKELKTENQGNGSFHAASSLGLSAIYDFKLNDKFKPYIGARVAYGHVKHQVHSVETETTTVFSKPKDTTVPGIISEKPISKPAYHESNSISSL

SEQ ID NO: 12113 - protein, 177 aa, Neisseria meningitidis
YAAERITHDYPQATGANNTSTVSDYFRNIRAHSIHPRVSVGYDFGDWRIAADYASYRKWNDNKYSVNTKEVGRNNNKGTDNWQELKTENQENGSFHAVSSLGLSAIYDFKLNDKFDKFKPYIGVRVAYGHVKHQVHSVRKETTTVFSKPRGITEPGKVVKGPTSKPPYHESHSISSV

SEQ ID NO: 12114 - protein, 172 aa, Neisseria meningitidis
YAAERITHDYPKATGANNTSTVSDYFRNIRAHSIHPRVSVGYDFGDWRIAADYASYRKWNNNKYSVNTKNVQVHKSNGNREDLKTENQENGTFHAVSSFGLSAVYDFDTGSRFKPYAGVRVAYGHVRHSIDSTKKTTNVLTVPSNIPGGTPTIYNQGSTQNAYHESHSIRRL

SEQ ID NO: 12115 - protein, 175 aa, Neisseria meningitidis
YAAERITHDYPQATGANNTSTVSDYFRNIRAHSIHPRVSVGYDFGGWRIAADYASYRKWNNNKYSVNTKEVQRNNNGNWQELKTENQENGSFHAASSLGLSAIYDFKLNNKFDKFKPYIGARVAYGHVKHQVHSVRKETTTAFLAPTGNAKVLGKIVQGPVSQPAYHESHSISSL

SEQ ID NO: 12116 - protein, 170 aa, Neisseria meningitidis
YAAERITHDYPKPTGTDKDKISTVSDYFRNIRAHSIHPRVSVGYDFGGWRIAADYASYRKWNNNKYSVNIKKGRETRDNREELKTENQENGSFHAASSLGLSAIYDFKLNDKFDKFKPYIGARVAYGHVKHQVHSVETKTTIVTSKPNGGPVPSSVTKPPYHESHSISSL

SEQ ID NO: 12117 - protein, 174 aa, Neisseria meningitidis
YAAERITHDYPQATGANNTSTVSDYFRNIRAHSIHPRVSVGYDFGDWRIAADYARYRKWNNNKYSVNTKEVRRNGGNSENLKTENQENGTFHAASSLGLSAIYDFKLNDKFDKFKPYIGVRVAYGHVKHQVHSVETETKIIFTTPTGGAKVGGTIPDKSMSKPPYHESRSISSL

SEQ ID NO: 12118 - protein, 177 aa, Neisseria meningitidis
YAAERITHDYPQATGANNTSTVSDYFRNIRAHSIHPRVSVGYDFGGWRIAADYASYRKWNDNKYSVNTKEVLRNNSTGTENWKELKTENQENGTFHAASSLGLSAIYDFKLNDKFDKFKPYIGARVAYGHVKHQVHSVETETTTVFSKPKGTTVPGIISEKPISKPPYHESNSISSL

SEQ ID NO: 12119 - protein, 174 aa, Neisseria meningitidis
YAAERITHDYPQATGANNTSTVSDYFRNIRAHSIHPRVSVGYDFGDWRIAADYASYRKWNNNKYSVNTKVLKENKGNRENLKTENQENGSFHASSSLGLSAIYDFKLNDKFDKFKPYIGARVAYGHVKHQVHSVETETTIYTTAPTKGAKVGGTIPNKAISKPPYHESHSTSSL

SEQ ID NO: 12120 - protein, 170 aa, Neisseria meningitidis
YAAERITHDYPQATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTVTSKPKNGSPQGGAVPSREPSKPPYHESNSISSL

SEQ ID NO: 12121 - protein, 174 aa, Neisseria meningitidis
YAAERITHDYPKATGANNTSTVSDYFRNIRAHSIHPRVSVGYDFGGWRIAADYASYRKWNNNKYSVNTKEVERNNSTGTDNWKELKTENQGNGSFHAASSLGLSAIYDFKLNDKFKPYIGARVAYGHVKHQVHSVETETTTVFSKPKDTTVPGIISEKPISKPAYHESNSISSL

SEQ ID NO: 12122 - protein, 176 aa, Neisseria meningitidis
YAAERITHDYPKPTGTDKDKISTVSDYFRNIRAHSIHPRVSVGYDFGDWRIAADYASYRKWNNNKYSVNTKKVQENNGNREDLKTENQENGTFHAVSSLGLSAIYDFKLNDKFDKFKPYIGARVAYGHVKHQVHSVESKTTIVTTAPTQGAPKGGTILQGPTPKPPYHESNSISSL

SEQ ID NO: 12123 - protein, 176 aa, Neisseria meningitidis
YAAERITHDYPKPTGTDKDKISTVSDYFRNIRAHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPKGKHLKGGPVPLQHSSQPPYHESNSISSL

SEQ ID NO: 12124 - protein, 176 aa, Neisseria meningitidis
YAAERITHDYPKPTGANNTSTVSDYFRNIRAHSIHPRVSVGYDFGDWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12125 - protein, 172 aa, Neisseria meningitidis
YAAERITHNYPEPTGADKDKISTVSDYFRNIRAHSIHPRVSVGYDFGDWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12126 - protein, 176 aa, Neisseria meningitidis
YAAERITHDYPQATGANNTSTVSDYFRNIRAHSIHPRVSVGYDFGDWRIAADYASYRKWNNNKYSVNTKEVRRNNNAGNWRELKTENQENGSFHASSSLGLSAIYDFKLNDKFDKFKPYIGVRVAYGHVKHQVHSVRKETKTTFSKPGAGATKPGKIVEGPTSKPAYHESHSISSV

SEQ ID NO: 12127 - protein, 174 aa, Neisseria meningitidis
YAAERITHDYPQATGANNTSTVSDYFRNIRAHSIHPRVSVGYDFGGWRIAADYASYRKWNNNKYSVNTKEVQRNNNGNWQELKTENQENGSFHAVSSLGLSAIYDFKLNDKFDKFKPYIGARVAYGHVKHQVHSVRKETTTVFSKPSGSATKPGQIPSLVTKPAYHESHSISSL

SEQ ID NO: 12128 - protein, 169 aa, Neisseria meningitidis
YAAERITHDYPQATGANNTSTVSDYFRNIRAHSIHPRVSVGYDFGGWRIAADYASYRKWNNNKYSVNTKKVQENQGTRKDLKTENQENGSFHAASSLGLSAIYDFKLNDKFKPYIGARVAYGHVRHSIDSTKKTTNVVTVAGAANTAPTIYYAPETQNAYHESHSIRRL

SEQ ID NO: 12129 - protein, 173 aa, Neisseria meningitidis
YAAERITHNYPQATGANNTSTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRL

SEQ ID NO: 12130 - protein, 170 aa, Neisseria meningitidis
YAAERITHDYPKATGANNTSTVSDYFRNIRAHSIHPRVSVGYDFGGWRIAADYASYRKWKESNSSTKKVTEDIADNYKETKTEHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12131 - protein, 176 aa, Neisseria meningitidis
YAAERITHDYPKATGANNTSTVSDYFRNIRAHSIHPRVSVGYDFGDWRIAADYASYRKWNNNKYSVNTKELLRNNSSGIWQELKTENQENGTFHAASSLGLSAIYDFKLNDKFDKFKPYIGARVAYGHVKHQVHSVRKETKTTFSPPKQGATVPGKIVEGPFSKPPYHESHSISSL

SEQ ID NO: 12132 - protein, 176 aa, Neisseria meningitidis
YAAERITHDYPKPTGANNTSTVSDYFRNIRAHSIHPRVSVGYDFGGWRIAADYASYRKWNDNKYSVNTKELQRNKEYGNWIELKTENQGNGSFHAVSSLGLSAIYDFKLNDKFDKFKPYIGARIAYGHVKHQVHSVETETKIIFTTPTKGAKVGGTIPNKSMSKPPYHESNSISSL

SEQ ID NO: 12133 - protein, 176 aa, Neisseria meningitidis
YAAERITHNYPEPTGADKDKISTVSDYFRNIRAHSIHPRVSVGYDFGGWRIAADYARYRKWNNNKYSVNTKVLKETQDNWQELKTENQENGSFHAASSLGLSAIYDFKLNDKFDKFKPYIGARVAYGHVKHQVHSVETKTTIVTSKPKGKHLKGGPVIKTDPSKPPYHESHSISSL

SEQ ID NO: 12134 - protein, 174 aa, Neisseria meningitidis
YAAERITHDYPQATGANNTSTVSDYFRNIRAHSIHPRVSVGYDFGGWRIAADYASYRKWNDNKYSVNTKEVRRNGGNSENLKTENQENGTFHASSSLGLSAIYDFKLNDKFDKFKPYIGARVAYGHVKHQVHSVESKTTIVTTAPTGGAQKGGVISEATISKPPYHQSHSISSL

SEQ ID NO: 12135 - protein, 176 aa, Neisseria meningitidis
YAAERITHDYPQATGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPSKIISGPISKPAYHESHSISSL

SEQ ID NO: 12136 - protein, 170 aa, Neisseria meningitidis
YAAERITHDYPQATGANNTSTVSDYFRNIRAHSIHPRVSVGYDFGDWRIAADYASYRKWNNNKYSVQIKEIKNVPPNRQDLKTENQENGTFHAVSSLGLSAIYDFKLNDKFKPYIGARVAYGHVRHSIDSTKKTTEVLTSTYGGADTKPTIYNGKSTQNAYHESHSIRRL

SEQ ID NO: 12137 - protein, 167 aa, Neisseria meningitidis
YAAERITHDYPQATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFDKFKPYIGARVAYGHVKHQVHSVETKTTIVTSKPNGGPVPSSVTKPPYHQSHSISSL

SEQ ID NO: 12138 - protein, 176 aa, Neisseria meningitidis
YAAERITHDYPQATGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12139 - protein, 174 aa, Neisseria meningitidis
YAAERITHDYPKPTGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGARVAYGHVKHQVHSVETETKIIFTTPTKGAKVGGTILDKSMSKPPYHESNSISSL

SEQ ID NO: 12140 - protein, 165 aa, Neisseria meningitidis
YAAERITHDYPKATGANNTSTVSDYFRNIRAHSIHPRVSVGYDFGDWRIAADYASYRKWNNNKYSVNTKEVRRNGGNSENLKTENQENGSFHAASSLGLSAIYDFKLNDKFKPYIGARIAYGHVKHQIHSVESKTTTVTSNNGGPIPQGPTPKPPYHESNSISSL

SEQ ID NO: 12141 - protein, 175 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQGNGSFHAASSLGLSAIYDFKLNDKFDKFKPYIGVRVAYGHVKHQVHSVESKNTIVTSKPTQGAAQGGPVPTGFVPKSAYHESHSISSL

SEQ ID NO: 12142 - protein, 174 aa, Neisseria meningitidis
YAAERITHNYPEPTGANNTSTVSDYFRNIRAHSIHPRVSVGYDFGDWRIAADYASYRKWNNNKYSVNTKVLKENKGNRENLKTENQENGSFHASSSLGLSAIYDFKLNDKFDKFKPYIGARVAYGHVKHQVHSVESRTTIVTTAPTGGAQKGGVISEATISKPPYHQSHSISSL

SEQ ID NO: 12143 - protein, 170 aa, Neisseria meningitidis
YAAERITHDYPQATGAKNTSTVSDYFRNIRTHSIHPRVSVGYDFGDWRIAADYASYRKWKESNFSTKKVTEEINDNYKETKTEHQGNGSFHATSSLGLSAIYDFKLNDKFKPYIGARVAYGHVKHQVHSVETKTTTVTSKPKGKNLKGGPVPLQHSSQPAYHESHSSSSV

SEQ ID NO: 12144 - protein, 171 aa, Neisseria meningitidis
YAAERITHNYPEPTGADKDKISTVSDYFRNIRAHSIHPRVSVGYDFGDWRIAADYASYRKWNSNKYSVNTKEVQENGNTRQDLKTENQENGTFHAVSSLGLSAIYDFKLNDKFKPYIGARVAYGHVRHSIDSTKKTTNVVTVAGAANIAPTIYYAPETQNAYHESHSIRRL

SEQ ID NO: 12145 - protein, 173 aa, Neisseria meningitidis
YAAERITHDYPKPTGTDKDKISTVSDYFRNIRAHSIHPRVSVGYDFGDWRIAADYASYRKWNNNKYSVNTKKVQENQGTRKDLKTENQENGSFHAVSSLGLSAIYDFKLNDKFKPYIGARVAYGHVKHQVHSVEKETEIVTTVPTGGAQTGGTILQGPTPKPPYHESNSISSL

SEQ ID NO: 12146 - protein, 171 aa, Neisseria meningitidis
YAAERITHDYPKATGANNTSTVSDYFRNIRAHSIHPRVSVGYDFGDWRIAADYASYRKWNNNKYSVNTKVLKENLGNRIELKTENQGNGSFHAASSLGLSAIYDFKLNDKFKPYIGARVAYGHVKHQVHSVETTTETIFTTPTGGATVGGKIPNKSSSKPPYHQSHSISSL

SEQ ID NO: 12147 - protein, 174 aa, Neisseria meningitidis
YAAERITHDYPQATGANNTSTVSDYFRNIRAHSIHPRVSVGYDFGDWRIAADYASYRKWNNNKYSVNTKVLKENKGNRENLKTENQENGSFHASSSLGLSAIYDFKLNDKFDKFKPYIGARVAYGHVKHQVHSVETETTIYTTAPTKGAKVGGTIPNKAISKPAYHESNSISSL

SEQ ID NO: 12148 - protein, 174 aa, Neisseria meningitidis
YAAERITHNYPEPTGANNTSTVSDYFRNIRAHSIHPRVSVGYDFGDWRIAADYASYRKWNNNKYSVNTKVLKENKGNRENLKTENQENGSFHASSSLGLSAIYDFKLNDKFDKFKPYIGARVAYGHVKHQVHSVETETTIYTTAPTKGAKVGGTIPNKAISKPPYHESHSTSSL

SEQ ID NO: 12149 - protein, 170 aa, Neisseria meningitidis
YAAERITHDYPKPTGANNTSTVSDYFRNIRAHSIHPRVSVGYDFGDWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12150 - protein, 173 aa, Neisseria meningitidis
YAAERITHDYPQATGANNTSTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRL

SEQ ID NO: 12151 - protein, 170 aa, Neisseria meningitidis
YAAERITHDYPQATGANNTSTVSDYFRNIRAHSIHPRVSVGYDFGGWRIAADYASYRKWKESNSSTKKVTEDKNDNYIETQTKHQGNGSFHAASSLGLSAIYDFKLNDKFKPYIGARIAYGHVRHQVHSVESKNTIITSKPKNGAAQGGPVPTGFVGKPAYHESHSIRRL

SEQ ID NO: 12152 - protein, 180 aa, Neisseria meningitidis
YAAERITHDYPKPTGTDKDKISTVSDYFRNIRAHSIHPRVSVGYDFGGWRIAADYASYRKWNDNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12153 - protein, 167 aa, Neisseria meningitidis
YAAERITHDYPKPTGTDKDKISTVSDYFRNIRAHSIHPRVSVGYDFGDWRIAADYASYRKWNNNKYSVNTKKVREKNGNREDLKTENQENGTFHAVSSLGLSAIYDFKLNDKFKPYIGARVAYGHVKHQVHSVESKTTTVTSKGGGPIIRGPVSQPPYHESNSIGSL

SEQ ID NO: 12154 - protein, 171 aa, Neisseria meningitidis
YAAERITHDYPKPTGTDKDKISTVSDYFRNIRTHSIHPRVSVGYDFGGWRIAADYASYRKWNNNKYSVNTKKVREKNGNREDLKTENQENGTFHAVSSLGLSAIYDFKLNDKFKPYIGARVAYGHVRHSIDSTKKTTEVLTSSHAPGTAPTIYNQGSTQNAYHERNSISSL

SEQ ID NO: 12155 - protein, 172 aa, Neisseria meningitidis
YAAERITHDYPKATGANNTSTVSDYFRNIRAHSIHPRVSVGYDFGGWRIAADYASYRKWNNNKYSVNTKEVERNNSTDNWKELKTENQGNGSFHAASSLGLSAIYDFKLNDKFKPYIGARVAYGHVKHQVHSVETETTTVFSKPKDTTVPGIISEKPISKPAYHESNSISSL

SEQ ID NO: 12156 - protein, 165 aa, Neisseria meningitidis
YAAERITHDYPKATGANNTSTVSDYFRNIRTHSIHPRVSVGYDFGDWRIAADYASYRKWKESNSSTNTENSETQQNRIKIETGHQGNGSFHAASSLGLSAIYDFKLNDKFKPYIGARVAYGYVKHQVHSVESKTKTVTSKPNGGPVKEGPTPKPAYHESNSISSL

SEQ ID NO: 12157 - protein, 170 aa, Neisseria meningitidis
YAAERITHNYPEPTGADNTSTVSDYFRNIRAHSIHPRVSVGYDFGDWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12158 - protein, 172 aa, Neisseria meningitidis
YAAERITHDYPKPTGTDKDKISTVSDYFRNIRAHSIHPRVSVGYDFGGWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYHESNSISSL

SEQ ID NO: 12159 - protein, 173 aa, Neisseria meningitidis
YAAERITHDYPKATGANNTSTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVETETTTVFSKPKGTTVPGIISEKPISKPPYHESNSISSL

SEQ ID NO: 12160 - protein, 170 aa, Neisseria meningitidis
YAAERITHDYPQATGANNTSTVSDYFRNIRAHSIHPRVSVGYDFGGWRIAADYASYRKWNNNKYSVNTKKVQENQGTRKDLKTENQENGSFHAASSLGLSAIYDFKLNDKFKPYIGARVAYGHVRHSIDSTKKTTEVVTSTHGGADTKPTIYNGESTQNAYHESHSIRRL

SEQ ID NO: 12161 - protein, 170 aa, Neisseria meningitidis
YAAERITHNYPEPTGANNTSTVSDYFRNIRAHSIHPRVSVGYDFGDWRIAADYASYRKWNNNKYSVNTKKVQENQGTRKDLKTENQENGSFHAASSLGLSAIYDFKLNDKFKPYIGARVAYGHVRHSIDSTKKTTEVVTSTHGGADTKPTIYNGESTQNAYHESHSIRRL

SEQ ID NO: 12162 - protein, 178 aa, Neisseria meningitidis
YAAERITHDYPKATGANNTSTVSDYFRNIRAHSIHPRVSVGYDFGDWRIAADYASYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12163 - protein, 179 aa, Neisseria meningitidis
YAAERITHNYPEPTGADKDKISTVSDYFRNIRAHSIHPRVSVGYDFGDWRIAADYASYRKWNNNKYSVNTKEVQRNNSTGTENWQELKTENQENGSFHAASSLGLSAIYDFKLNDKFDKFKPYIGARVAYGHVKHQVHSVRKETTTVFSKPRGITEPGKVVKGPTSKPPYHESHSTSSL

SEQ ID NO: 12164 - protein, 178 aa, Neisseria meningitidis
YAAERITHDYPKPTGANNTSTVSDYFRNIRAHSIHPRVSVGYDFGGWRIAADYASYRKWSNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12165 - protein, 178 aa, Neisseria meningitidis
YAAERITHNYPKPTGTDKDKISTVSDYFRNIRAHSIHPRVSVGYDFGDWRIAADYASYRKWNNNKYSVNTKELLRNNSSGIWQELKTENQENGTFHAASSLGLSAIYDFKLNDKFDKFKPYIGARVAYGHVKHQVHSVRKETKTTFSPPKQGATVPGKIVEGPFSKPPYHESHSISSL

SEQ ID NO: 12166 - protein, 172 aa, Neisseria meningitidis
YAAERITHDYPKPTGANNTSTVSDYFRNIRTHSIHPRVSVGYDFGGWRIAADYARYRKWNNNKYSVNTKNVQVHKSNGNREDLKTENQENGTFHAVSSLGLSAVYDFDTGSRFKPYAGVRVAYGHVRHSIDSTKKTTNVLTVPSNIPGGTPTIYNQGSTQNAYHESHSIRRL

SEQ ID NO: 12167 - protein, 171 aa, Neisseria meningitidis
YAAERITHDYPKPTGTDKDKISTVSDYFRNIRAHSIHPRVSVGYDFGGWRIAADYASYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNQGSTQNAYHESHSIRRL

SEQ ID NO: 12168 - protein, 174 aa, Neisseria meningitidis
YAAERITHDYPKATGANNTSTVSDYFRNIRAHSIHPRVSVGYDFGGWRIAADYASYRKWNNNKYSVNTKVLQENKGNRENLKTENQENGSFHASSSLGLSAIYDFKLNDKFDKFKPYIGARVAYGHVKHQVHSVETETTIYTTAPTKGAKVGGTIPNKAISKPPYHESHSTSSL

SEQ ID NO: 12169 - protein, 171 aa, Neisseria meningitidis
YAAERITHDYPKPTGANNTSTVSDYFRNIRAHSIHPRVSVGYDFGGWRIAADYASYRKWNNNKYSVNTKVLKETQDNWQELKTENQENGSFHAASSLGLSAISDFKLNDKFKPYIGARVAYGHVKHQVHSVETKTTTVTSKPNGKNLKGGPVSSREPSKPPYHESHSTSSL

SEQ ID NO: 12170 - protein, 172 aa, Neisseria meningitidis
YAAERITHNYPEPTGANKDKISTVSDYFRNIRAHSIHPRVSVGYDFGGWRIAADYASYRKWNNNKYSVNTKKVQENQGTRKDLKTENQENGSFHAASSLGLSAIYDFKLNDKFKPYIGARVAYGHVRYSIDSTKKTTDVVTVATNTPDGAPTIYNEPKTQNAYHESHSIRRL

SEQ ID NO: 12171 - protein, 171 aa, Neisseria meningitidis
YAAERITHDYPKATGANNTSTVSDYFRNIRAHSIHPRVSVGYDFGDWRIAADYASYRKWNNNKYSVNTKVLKENKGNRENLKTENQENGSFHASSSLGLSAIYDFKLNDKFKPYIGARVAYGHVKHQVHSVETETTIYTTAPTGGATVGGTIPNKAISKPPYHESHSISSL

SEQ ID NO: 12172 - protein, 172 aa, Neisseria meningitidis
YAAERITHDYPQATGANNTSTVSDYFRNIRTHSIHPRVSVGYDFGGWRIAADYARYRKWNNNKYSVNTKNVQVHKSNGNREDLKTENQENGTFHAVSSLGLSAVYDFDTGSRFKPYAGVRVAYGHVRHSIDSTKKTTNVLTVPSNIPGGTPTIYNQGSTQNAYHESHSIRRL

SEQ ID NO: 12173 - protein, 177 aa, Neisseria meningitidis
YAAERITHDYPKPTGANNTSTVSDYFRNIRAHSIHPRVSVGYDFGGWRIAADYASYRKWNDNKYSVNTKEVLRNNSTGTENWQELKTENQENGSFHAASSLGLSAIYDFKLNDKFDKFKPYIGARVAYGHVKHQVHSVRKETTTVFSKPSGSTTKPGEIPSSVTKPPYHQSHSISSL

SEQ ID NO: 12174 - protein, 176 aa, Neisseria meningitidis
YAAERITHDYPKPTGTDKDKISTVSDYFRNIRAHSIHPRVSVGYDFGDWRIAADYASYRKWNNNKYSVNTKEVRRNGGNSENLKTENQENGTFHAVSSLGLSAIYDFKLNDKFDKFKPYIGVRVAYGHVKHQVHSVETETKIIFTTPTGGAKVGGTILDKSMSKPAYHESHSIGSL

SEQ ID NO: 12175 - protein, 172 aa, Neisseria meningitidis
YAAERITHDYPKPTGTDKDKISTVSDYFRNIRAHSIHPRVSVGYDFGDWRIAADYASYRKWNNNKYSVNTKVLQENNGNREDLKTENQENGTFHASSSLGLSAIYDFKLNDKFKPYIGARVAYGHVRHSIDSTKKTTDVVTVATNTPDGAPTIYNVPKTQNAYHESHSIRRL

SEQ ID NO: 12176 - protein, 170 aa, Neisseria meningitidis
YAAERITHDYPQATGANNTSTVSDYFRNIRAHSIHPRVSVGYDFGDWRIAADYASYRKWQESNSSTKKVTKEINDNYQETKTEHQGNGSFHAVSSLGLSAIYDFKLNDKFKPYIGARVAYGHVKHQVHSVETKTTTITSKPKNGSPQGGPIIQTDPSKPPYHESHSISSV

SEQ ID NO: 12177 - protein, 174 aa, Neisseria meningitidis
YAAERITHDYPKPTGANNTSTVSDYFRNIRAHSIHPRVSVGYDFGDWRIAADYASYRKWNNNKYSVNTKEVRRNRGNSENLKTENQENGSFHAVSSLGLSAIYDFKLNDKFDKFKPYIGARVAYGHVKHQVHSVETETKIIFTTPTKGAKVGGTILDKSMSKPPYHESNSISSL

SEQ ID NO: 12178 - protein, 176 aa, Neisseria meningitidis
YAAERITHDYPQATGANNTSTVSDYFRNIRAHSIHPRVSVGYDFGDWRIAADYASYRKWNNNKYSVNTKEVLRNNNAGNWQELKTENQENGSFHAVSSLGLSAIYDFKLNDKFDKFKPYIGARVAYGHVKHQVHSVRKETKTTFSKPGAGATKPGKIVEGPTSKPAYHESHSISSL

SEQ ID NO: 12179 - protein, 176 aa, Neisseria meningitidis
YAAERITHDYPKATGANNTSTVSDYFRNIRAHSIHPRVSVGYDFGDWRIAADYASYRKWNNNKYSVNTKELQRNNSSGIWQELKTENQENGTFHAVSSLGLSAIYDFKLNDKFDKFKPYIGARVAYGHVKHQVHSVRKETKTTFSKPRVGATEPGKIVEGPTPKPPYHESNSISSL

SEQ ID NO: 12180 - protein, 165 aa, Neisseria meningitidis
YAAERITHDYPQATGANNTSTVSDYFRNIRAHSIHPRVSVGYDFGDWRIAADYASYRKWNNNKYSVNTKKVNEKNGNREDLKTENQENGSFHAVSSLGLSAIYDFKLNDKFKPYIGARVAYGHVKHQVHSVESKTTTVTSKGGGPIIRGPVSQPPYHESNSIGSL

SEQ ID NO: 12181 - protein, 170 aa, Neisseria meningitidis
YAAERITHDYPQATGANNTSTVSDYFRNIRAHSIHPRVSVGYDFGGWRIAADYASYRKWKESNSSTKKVTEEINDNYQETKTEHQGNGSFHASSSLGLSAIYDFKLNDKFKPYIGARVAYGHVKHQVHSVETKTTTITSKPKNGSPQGGPIIQTDPSKPPYHESHSISSV

SEQ ID NO: 12182 - protein, 171 aa, Neisseria meningitidis
YAAERITHDYPKPTGANNTSTVSDYFRNIRAHSIHPRVSVGYDFGGWRIAADYASYRKWNNNKYSVNTKVLKETQDNWQELKTENQENGSFHAASSLGLSAIYDFKLNDKFKPYIGARVAYGHVKHQVHSVETKTTTVTSKPNGKNLKGGPVSSREPSKPPYHESHSTSSL

SEQ ID NO: 12183 - protein, 176 aa, Neisseria meningitidis
YAAERITHDYPKATGANNTSTVSDYFRNIRAHSIHPRVSVGYDFGDWRIAADYASYRKWNNNKYSVNTKELQRNNNAGNWIELKTENQENGSFHAVSSLGLSAIYDFKLNDKFDKFKPYIGVRVAYGHVKHQVHSVETETKIIFTTPTGGAKVPGKIVEGPFSKPAYHESHSTSSL

SEQ ID NO: 12184 - protein, 170 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTVTSKPKGKNLKGGPVSLQHSSQPAYHESHSISSL

SEQ ID NO: 12185 - protein, 170 aa, Neisseria meningitidis
YAAERITHDYPKATGANNTSTVSDYFRNIRAHSIHPRVSVGYDFGGWRIAADYASYRKWKESNSSTKKVTEDIAGNYKETKTEHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12186 - protein, 169 aa, Neisseria meningitidis
YAAERITHDYPKATGANNTSTVSDYFRNIRAHSIHPRVSVGYDFGDWRIAADYASYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNVPKTQNAYHESHSIRRL

SEQ ID NO: 12187 - protein, 177 aa, Neisseria meningitidis
YAAERITHDYPQATGANNTSTVSDYFRNIRAHSIHPRVSVGYDFGGWRIAADYASYRKWNDNKYSVNTKEVLRNNSTGTENWQELKTENQENGTFHAASSLGLSAIYDFKLNDKFDKFKPYIGARVAYGHVKHQVHSVETETTTVFSKPKGTTVPGIISEKPISKPPYHESNSISSL

SEQ ID NO: 12188 - protein, 174 aa, Neisseria meningitidis
YAAERITHDYPQATGANNTSTVSDYFRNIRAHSIHPRVSVGYDFGGWRIAADYASYRKWNNNKYSVNTKVLKENLGNRIELKTENQGNGSFHAASSLGLSAIYDFKLNDKFDKFKPYIGARVAYGHVKHQVHSVETTTETIFTAPTKGAKVGGKIPNTPSSKPPYHESNSISSL

SEQ ID NO: 12189 - protein, 169 aa, Neisseria meningitidis
YAAERITHDYPKATGANNTSTVSDYFRNIRAHSIHPRVSVGYDFGDWRIAADYARYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNQGSTQNAYHESHSIRRL

SEQ ID NO: 12190 - protein, 174 aa, Neisseria meningitidis
YAAERITHDYPQATGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGARVAYGHVKHQVHSVETETKIIFTTPTKGAKVGGTILDKSMSKPPYHESNSISSV

SEQ ID NO: 12191 - protein, 170 aa, Neisseria meningitidis
YAAERITHDYPKATGANNTSTVSDYFRNIRAHSIHPRVSVGYDFGDWRIAADYASYRKWKESNSSTNAENRDIAQNYVKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12192 - protein, 173 aa, Neisseria meningitidis
YAAERITHNYPQATGANNTSTVSDYFRNIRAHSIHPRVSVGYDFGGWRIAADYASYRKWKESNSSTKKVTEEINNNYKETQTKHQGNGSFHAASSLGLSAIYDFKLNDKFDKFKPYIGARVAYGHVKHQVHSVESKNTIVTSKPTQGAAQGGPVPTGFVPKSAYHESHSISSL

SEQ ID NO: 12193 - protein, 126 aa, Neisseria meningitidis
YSQLAKDTAVVNASETNVADSLTAFSGLVNVYYDIAIEDMPITPYVGVGVGAAYISNPSKADSVKDQKGFGFAYQAKAGVSYDVTPEIKLFAGARYFGSYGASFDKADKDDTGIKNVVYSTFGAEA

SEQ ID NO: 12194 - protein, 175 aa, Neisseria meningitidis
YAAERITHNYPEPTGADKDKISTVSDYFRNIRAHSIHPRVSVGYDFGGWRIAADYARYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRL

SEQ ID NO: 12195 - protein, 176 aa, Neisseria meningitidis
YAAERITHDYPKATGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPGKIILGPISKPAYHESHSTSSL

SEQ ID NO: 12196 - protein, 172 aa, Neisseria meningitidis
YAAERITHDYPKPTGANNTSTVSDYFRNIRAHSIHPRVSVGYDFGDWRIAADYARYRKWNNNKYSVNTKEVQENGNTRQDLKTENQENGTFHAVSSLGLSAIYDFKLNDKFDKFKPYIGVRVAYGHVRHSIDSTKKTTNVVTVAGAANTAPTIYYAPETQNAYHESNSIRRL

SEQ ID NO: 12197 - protein, 176 aa, Neisseria meningitidis
YAAERITHDYPKATGANNTSTVSDYFRNIRAHSIHPRVSVGYDFGGWRIAADYASYRKWNNNKYSVNTKELQRNKEHGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12198 - protein, 175 aa, Neisseria meningitidis
YAAERITHDYPQATGANNTSTVSDYFRNIRAHSIHPRVSVGYDFGDWRIAADYASYRKWNNNKYSVNTKELLRNNSSGIWQELKTENQENGTFHAASSLGLSAIYDFKLNDKFDKFKPYIGARVAYGHVKHQVHSVRKETTTVFSKPSGSTTKPGEIPSLVTKPAYHESNSISSL

SEQ ID NO: 12199 - protein, 174 aa, Neisseria meningitidis
YAAERITHDYPKPTGANNTSTVSDYFRNIRAHSIHPRVSVGYDFGDWRIAADYASYRKWNNNKYSVNTKKVQENNGNRKDLKTENQENGTFHAVSSLGLSAIYDFKLNDKFDKFKPYIGARVAYGHVKHQVHSVESKTTIVTTAPTRGAPKGGTILQGPTPKPPYHESNSISSL

SEQ ID NO: 12200 - protein, 176 aa, Neisseria meningitidis
YAAERITHDYPKPTGANNTSTVSDYFRNIRAHSIHPRVSVGYDFGGWRIAADYASYRKWNDNKYSVNTKELQRNKEHGNWIELKTENQGNGSFHAVSSLGLSAIYDFKLNDKFDKFKPYIGARIAYGHVKHQVHSVETETKIIFTTPTKGAKVGGTILDKSMSKPPYHESNSISSL

SEQ ID NO: 12201 - protein, 174 aa, Neisseria meningitidis
YAAERITHNYPEPTGANNTSTVSDYFRNIRAHSIHPRVSVGYDFGDWRIAADYASYRKWNNNKYSVNTKVLKENKGNRENLKTENQENGSFHASSSLGLSAIYDFKLNDKFDKFKPYIGARVAYGHVKHQVHSVVTETTIYTTAPTKGAKVGGTIPNKAISKPPYHESHSTSSL

SEQ ID NO: 12202 - protein, 172 aa, Neisseria meningitidis
YAAERITHDYPKPTGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGVRVAYGHVRHSIDSTKKTTNVVTVAGAANTAPTIYYAPETQNAYHESNSIRRL

SEQ ID NO: 12203 - protein, 170 aa, Neisseria meningitidis
YAAERITHDYPKATGANNTSTVSDYFRNIRAHSIHPRVSVGYDFGDWRIAADYASYRKWNNNKYSVNTKELENKHNNKKDLKTENQENGTFHAASSLGLSAIYDFKLNDKFKPYIGARVAYGHVRHSIDSTKKTTEVVTSTHGGADTKPTIYNGESTQNAYHESHSIRRL

SEQ ID NO: 12204 - protein, 165 aa, Neisseria meningitidis
YAAERITHDYPKPTGANNTSTVSDYFRNIRAHSIHPRVSVGYDFGDWRIAADYASYRKWNNNKYSVNTKKVREKNGNREDLKTENQENGTFHAVSSLGLSAIYDFKLNDKFKPYIGARVAYGHVKHQVHSVESKTTTVTSKGGGPIIRGPVSQPPYHESNSIGSL

SEQ ID NO: 12205 - protein, 170 aa, Neisseria meningitidis
YAAERITHDYPKATGANNTSTVSDYFRNIRAHSIHPRVSVGYDFGGWRIAADYASYRKWKESNSSTNAENRDSIQNYVKIETKHQGNGSFHAVSSLGLSAIYDFKLNDKFKPYIGARVAYGHVKHQVHSVESKNTIITSKPTGNTPAGGPVPTGFVPKSAYHESHSISSL

SEQ ID NO: 12206 - protein, 170 aa, Neisseria meningitidis
YAAERITHDYPKATGANNTSTVSDYFRNIRAHSIHPRVSVGYDFGGWRIAADYASYRKWKESNSSTKKVTEDITDNYKETKTEHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12207 - protein, 172 aa, Neisseria meningitidis
YAAERITHDYPKPTGTDKDKISTVSDYFRNIRAHSIHPRVSVGYDFGGWRIAADYASYRKWKESNSSTKKVTEEIKDNYKETKTEHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12208 - protein, 170 aa, Neisseria meningitidis
YAAERITHDYPKATGANNTSTVSDYFRNIRAHSIHPRVSVGYDFGGWRIAADYASYRKWKESNSSTNAENRDSIQNYIKIETKHQGNGSFHAVSSLGLSAIYDFKLNDKFKPYIGARVAYGHVKHQVHSVETKTTIVTSKPKGKHLKGGPVPLRHSSQPPYHESNSISSL

SEQ ID NO: 12209 - protein, 167 aa, Neisseria meningitidis
YAAERITHDYPKPTGTDKDKISTVSDYFRNIRAHSIHPRVSVGYDFGDWRIAADYASYRKWKESNSSTKKVTEEINNNYKETQTKHQGNGSFHASSSLGLSAIYDFKLNDKFKPYIGARVAYGHVKHQVHSVESKTTIVTPKPSGGPVIEGPTPKPPYHESNSISSL

SEQ ID NO: 12210 - protein, 169 aa, Neisseria meningitidis
YAAERITHDYPKATGANNTSTVSDYFRNIRAHSIHPRVSVGYDFGDWRIAADYASYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNQGSTQNAYHESHSIRRL

SEQ ID NO: 12211 - protein, 191 aa, Neisseria meningitidis
  misc_feature (1)..(7): Xaa can be any naturally occurring amino acid
  misc_feature (9)..(10): Xaa can be any naturally occurring amino acid
  misc_feature (12)..(13): Xaa can be any naturally occurring amino acid
  misc_feature (30)..(30): Xaa can be any naturally occurring amino acid
  misc_feature (33)..(33): Xaa can be any naturally occurring amino acid
  misc_feature (38)..(38): Xaa can be any naturally occurring amino acid
  misc_feature (51)..(51): Xaa can be any naturally occurring amino acid
  misc_feature (60)..(60): Xaa can be any naturally occurring amino acid
  misc_feature (71)..(72): Xaa can be any naturally occurring amino acid
  misc_feature (76)..(76): Xaa can be any naturally occurring amino acid
XXXXXXXVXXQXXGEVLPLFTKVDGITYKXGNXDDSPXKASFIAGGGAFGXKMDDIRVDXEGVYSHLNKNXXTDAXFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 12212 - protein, 176 aa, Neisseria meningitidis
YAAERITHDYPKATGANNTSTVSDYFRNIRAHSIHPRVSVGYDFGDWRIAADYASYRKWNNNKYSVNTKELQRNNNAGNWIELKTENQENGSFHAVSSLGLSAIYDFKLNDKFDKFKPYIGVRVAYGHVKHQVHSVETETKIIFTTPTGGAKVGGTIPNKSMSKPAYHERNSISSV

SEQ ID NO: 12213 - protein, 176 aa, Neisseria meningitidis
YAAERITHDYPKPTGANNTSTVSDYFRNIRAHSIHPRVSVGYDFGGWRIAADYASYRKWSNNKYSVNTKEVQRNNNAGNWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12214 - protein, 174 aa, Neisseria meningitidis
YAAERITHDYPKATGANNTSTVSDYFRNIRAHSIHPRVSVGYDFGDWRIAADYASYRKWNNNKYSVNTKEVQRHSNGNWKELKTENQGNGSFHAASSLGLSAIYDFKLNDKFDKFKPYIGARVAYGHVKHQVHSVEKETTTTFSKAGLGATEPGKIPSLVTKPAYHESNSISSL

SEQ ID NO: 12215 - protein, 172 aa, Neisseria meningitidis
YAAERITHDYPEATGANNTSTVSDYFRNIRTHSIHPWVSVGYDFGGWRIAADYARYRKWNNNKYSVNTKNVQVHKSNGNREDLKTENQENGTFHAVSSFGLSAVYDFDTGSRFKPYAGVRVAYGHVRHSIDSTKKTTNVLTVPSNIPGGTPTIYNQGSTQNAYHESHSIRRL

SEQ ID NO: 12216 - protein, 174 aa, Neisseria meningitidis
YAAERITHDYPKATGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGARVAYGHVKHQVHSVESKTTIVTTAPTGGAPKGGTILQGPTPKPPYHESNSISSL

SEQ ID NO: 12217 - protein, 174 aa, Neisseria meningitidis
YAAERITHDYPQATSANNTSTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVKKETTTVFTAPTQGAQKGGVIPEATISKPAYHESHSISSL

SEQ ID NO: 12218 - protein, 177 aa, Neisseria meningitidis
YAAERITHNYPEPTGANNTSTVSDYFRNIRAHSIHPRVSVGYDFGGWRIAADYASYRKWNDNKYSVNTKEVLRNNSTGTENWQELKTENQENGSFHAASSLGLSAIYDFKLNDKFDKFKPYIGARVAYGHVKHQVHSVRKETTTVFSKPSGSTTKPGEIPSSVTKPPYHQSHSISSL

SEQ ID NO: 12219 - protein, 171 aa, Neisseria meningitidis
YAAERITHDYPKPTGANNTSTVSDYFRNIRAHSIHPRVSVGYDFGGWRIAADYASYRKWNNNKYSVNTKVLKETQDNWQELKTENQENGSFHAASSLGLSAIYDFKLNDKFKPYIGARVAYGHVKHQVHSVETKTTIVTSKPKGKHLKGGPVPLQHSSQPPYHESNSISSL

SEQ ID NO: 12220 - protein, 177 aa, Neisseria meningitidis
YAAERITHDYPKATGANNTSTVSDYFRNIRAHSIHPRVSVGYDFGGWRIAADYASYRKWNNNKYSVNTKEVQRNNNTGTDIWKELKTENQENGSFHAVSSLGLSVIYDFKLNDKFDKFKPYIGARVAYGHVKHQVHSVRKETTTVFTRPRGITEPGKVVKGPTSKPPYHQSHSTSSL

SEQ ID NO: 12221 - protein, 167 aa, Neisseria meningitidis
YAAERITHDYPKATGANNTSTVSDYFRNIRAHSIHPRVSVGYDFGDWRIAADYASYRKWKESNSSTKKVTEDIADNYKETKTEHQGNGSFHAASSLGLSAIYDFKLNDKFDKFKPYIGVRVAYGHVKHQVHSVKKETTTVTSKGGGPIIQGPVSQPPYHESNSIGSL

SEQ ID NO: 12222 - protein, 174 aa, Neisseria meningitidis
YAAERITHDYPKPTGANNTSTVSDYFRNIRAHSIHPRVSVGYDFGGWRIAADYASYRKWNNNKYSVNTKEVRRNGGNSENLKTENQENGTFHAASSLGLSAIYDFKLNDKFDKFKPYIGVRVAYGHVKHQVHSVESKTTIVTTAPTGGAQKGGVISEATISKPPYHQSHSISSL

SEQ ID NO: 12223 - protein, 170 aa, Neisseria meningitidis
YAAERITHDYPQATGANNTSTVSDYFRNIRAHSIHPRVSVGYDFGGWRIAADYASYRKWKESNSSTKKVTEEINNNYKETQTKHQGNGSFHASSSLGLSAIYDFKLNDKFKPYIGARVAYGHVKHQVHSVETKTTIVTSKPTQGAAQGGPIIQTDPSKPPYHESHSISSV

SEQ ID NO: 12224 - protein, 174 aa, Neisseria meningitidis
YAAERITHDYPQATGANNTSTVSDYFRNIRAHSIHPRVSVGYDFGDWRIAADYASYRKWNNNKYSVNTKEVRRNGGNSENLKTENQENGSFHAVSSLGLSAIYDFKLNDKFDKFKPYIGARVAYGHVKHQVHSVETETKIIFTTPTKGAKVGGTILDKSMSKPPYHESNSISSL

SEQ ID NO: 12225 - protein, 174 aa, Neisseria meningitidis
YAAERITHDYPKPTGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGVRVAYGHVRHSIDSTKKTTNVVTVAGAANTAPTIYYAPETQNAYHESHSIRRL

SEQ ID NO: 12226 - protein, 173 aa, Neisseria meningitidis
YAAERITHDYPKPTGTDKDKISTVSDYFRNIRAHSIHPRVSVGYDFGDWRIAADYASYRKWSNNKYSVNTKVLKENQGNRIKLKTENQGNGSFHASSSLGLSAIYDFKLNDKFKPYIGARVAYGHVKHQVHSVETKTTIYTTAPTGDATVGGTIPERPSSKPAYHESNSISSL

SEQ ID NO: 12227 - protein, 178 aa, Neisseria meningitidis
YAAERITHDYPQATGANNTSTVSDYFRNIRAHSIHPRVSVGYDFGGWRIAADYARYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12228 - protein, 174 aa, Neisseria meningitidis
YAAERITHDYPQATGANNTSTVSDYFRNIRAHSIHPRVSVGYDFGGWRIAADYASYRKWNNNKYSVNTKVLKENKGNRENLKTENQENGSFHASSSLGLSAIYDFKLNDKFDKFKPYIGARVAYGHVKHQVHSVETETTIYTTAPTKGAKVGGTIPNKAISKPPYHESHSTSSL

SEQ ID NO: 12229 - protein, 176 aa, Neisseria meningitidis
YAAERITHDYPQATGANNTSTVSDYFRNIRAHSIHPRVSVGYDFGGWRIAADYASYRKWNDNKYSVNTKELQRNKEYGNWIELKTENQGNGSFHAVSSLGLSAIYDFKLNDKFDKFKPYIGARIAYGHVKHQVHSVETETKIIFTTPTKGAKVGGTIPNKSMSKPPYHESNSISSL

SEQ ID NO: 12230 - protein, 177 aa, Neisseria meningitidis
YAAERITHDYPKPTGTDKDKISTVSDYFRNIRAHSIHPRVSVGYDFGGWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDPSKPAYHESNSISSL

SEQ ID NO: 12231 - protein, 170 aa, Neisseria meningitidis
YAAERITHDYPKATGANNTSTVSDYFRNIRAHSIHPRVSVGYDFGDWRIAADYASYRKWKESNSSTKKVTEEIKDNYKETKTEHQGNGSFHAASSLGLSAIYDFKLNDKFKPYIGARVAYGHVRHQVNSVDKETITLISKPKGNSPGGGRVVSSLPSKPPYHESNSISSL

SEQ ID NO: 12232 - protein, 174 aa, Neisseria meningitidis
YAAERITHDYPKATGANNTSTVSDYFRNIRAHSIHPRVSVGYDFGDWRIAADYASYRKWNNNKYSVNTKKVQENNGNREDLKTENQENGTFHAVSSLGLSAIYDFKLNDKFDKFKPYIGARVAYGHVKHQVHSVESKTTIVTTAPTRGAPKGGTILQGPTPKPPYHESNSISSL

SEQ ID NO: 12233 - protein, 176 aa, Neisseria meningitidis
YAAERITHNYPKPTGTDKDKISTVSDYFRNIRAHSIHPRVSVGYDFGDWRIAADYASYRKWNNNKYSVNTKVLKETQDNWQELKTENQENGSFHAASSLGLSAIYDFKLNDKFDKFKPYIGARVAYGHVKHQVHSVETKTTIVTSKPKGKHLKGGPVSSRELSKPPYHESHSISSL

SEQ ID NO: 12234 - protein, 172 aa, Neisseria meningitidis
YAAERITHDYPKPTGTDKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPKGGTPAGGPVVKTDPSKPPYHESHSISSL

SEQ ID NO: 12235 - protein, 176 aa, Neisseria meningitidis
YAAERITHNYPKPTGTDKDKISTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVKKETTTVFTAPTQGAQKGGVIPEATISKPAYHESHSISSL

SEQ ID NO: 12236 - protein, 176 aa, Neisseria meningitidis
YAAERITHDYPKPTGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12237 - protein, 170 aa, Neisseria meningitidis
YAAERITHNYPQATGANNTSTVSDYFRNIRAHSIHPRVSVGYDFGDWRIAADYASYRKWNNNKYSVNTKELENKHNNKKDLKTENQENGTFHAASSLGLSAIYDFKLNDKFKPYIGARVAYGHVRHSIDSTKKTTEVVTSTHGGADTKPTIYNGESTQNAYHESHSIRRL

SEQ ID NO: 12238 - protein, 176 aa, Neisseria meningitidis
YAAERITHDYPKPTGANNTSTVSDYFRNIRAHSIHPRVSVGYDFGGWRIAADYASYRKWNDNKYSVNTKELQRNKEHGNWIELKTENQGNGSFHAVSSLGLSAIYDFKLNDKFDKFKPYIGARIAYGHVKHQVHSVETETKIIFTTPTKGAKVGGTIPNKSMSKPPYHESNSISSL

SEQ ID NO: 12239 - protein, 174 aa, Neisseria meningitidis
YAAERITHDYPKATGANNTSTVSDYFRNIRAHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPKGKHLKGGPVPLRHSSQPPYHESNSISSL

SEQ ID NO: 12240 - protein, 171 aa, Neisseria meningitidis
YAAERITHDYPKPTGTDKDKISTVSDYFRNIRAHSIHPRVSVGYDFGGWRIAADYARYRKWYNNKNSVQIKEINNVPPNRKDLKTENQENGTFHAISSLGLSAVYDFDTGSRFKPYAGVRVSYGHVRHSIDSTKKTTEVVTTAGSNGAADTVLPGASTQNAYHESHSIRRV

SEQ ID NO: 12241 - protein, 171 aa, Neisseria meningitidis
YAAERITHDYPKATGANNTSTVSDYFRNIRAHSIHPRVSVGYDFGGWRIAADYASYRKWNNNKYSVNTKVLKETQDNWQELKTENQENGSFHAASSLGLSAIYDFKLNDKFKPYIGARVAYGHVKHQVHSVETKTTTVTSKPNGKNLKGGPVSSREPSKPPYHESHSTSSL

SEQ ID NO: 12242 - protein, 174 aa, Neisseria meningitidis
YAAERITHNYPEPTGANNTSTVSDYFRNIRAHSIHPRVSVGYDFGDWRIAADYASYRKWNNNKYSVNTKKVQENQGTRKDLKTENQENGSFHAASSLGLSAIYDFKLNDKFDKFKPYIGARVAYGHVKHQVHSVESKTTIVTTAPTQGALKGGTILQGPTPKPPYHESNSISSL

SEQ ID NO: 12243 - protein, 172 aa, Neisseria meningitidis
YAAERITHNYPEPTGADKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVSYGHVKHQVHSVETKTTTVTSKPKGGTPAGGPVIKNDPSKPPYHESHSISSL

SEQ ID NO: 12244 - protein, 173 aa, Neisseria meningitidis
YAAERITHDYPKPTGTDKDKISTVSDYFRNIRAHSIHPRVSVGYDFGDWRIAADYASYRKWSNNKYSVNTKVLKENQGNRIKLKTENQGNGSFHASSSLGLSAIYDFKLNDKFKPYIGARVAYGHVKHQVHSVETKTTIYTTAPTGDATVGGTIPERPSSKPAYHESNSISSW

SEQ ID NO: 12245 - protein, 178 aa, Neisseria meningitidis
YAAERITHDYPKATGADKDKISTVSDYFRNIRAHSIHPRVSVGYDFGGWRIAADYASYRKWNNNKYSVNTKELQRNKEHGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12246 - protein, 165 aa, Neisseria meningitidis
YAAERITHDYPQATGANNTSTVSDYFRNIRAHSIHPRVSVGYDFGDWRIAADYASYRKWKESNSSTKKVTEEINNNYKETQTKHQGNGSFHAASSLGLSAIYDFKLNDKFKPYIGARVAYGYVKHQVHSVESKTTTVTSKPNGGPVKEGPISKPAYHESHSISSL

SEQ ID NO: 12247 - protein, 170 aa, Neisseria meningitidis
YAAERITHDYPKATGANNTSTVSDYFRNIRAHSIHPRVSVGYDFGGWRIAADYASYRKWKESNSSTNAENRDSIQNYVKIETKHQGNGSFHAVSSLGLSAIYDFKLNDKFKPYIGARVAYGHVRHQVHSVESKNTIITSKPTGNTPAGGPVPTGFVPKSAYHESHSISSL

SEQ ID NO: 12248 - protein, 170 aa, Neisseria meningitidis
YAAERITHDYPKATGANNTSTVSDYFRNIRAHSIHPRVSVGYDFGDWRIAADYASYRKWKESNSSTKKVTEDIADNYKETKTEHQGNGSFHASSSLGLSAIYDFKLNDKFKPYIGARVAYGHVKHQVHSVETKTTTVTSKPKGDTPAGGPVIKTDPSKPAYHESHSIRRL

SEQ ID NO: 12249 - protein, 165 aa, Neisseria meningitidis
YAAERITHDYPQATGANNTSTVSDYFRNIRAHSIHPRVSVGYDFGDWRIAADYASYRKWKESNSSTKKVTEEINNNYKETQTKHQGNGSFHASSSLGLSAIYDFKLNDKFKPYIGARVAYGHVKHQVHSVESKTTIVTPKPSGGPVIEGPTPKPPYHESNSISSL

SEQ ID NO: 12250 - protein, 174 aa, Neisseria meningitidis
YAAERITHDYPQATGANNTSTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVKKETTTVFTAPTQGAQKGGVIPEATISKPAYHESHSISSL

SEQ ID NO: 12251 - protein, 177 aa, Neisseria meningitidis
YAAERITHDYPKATGANNTSTVSDYFRNIRAHSIHPRVSVGYDFGGWRIAADYASYRKWNDNKYSVNTKEVLRNNSTGTENWQELKTENQENGTFHAASSLGLSAIYDFKLNDKFDKFKPYIGARVAYGHVKHQVHSVETETTTVFSKPKGTTVPGIISEKPISKPPYHESNSISSL

SEQ ID NO: 12252 - protein, 179 aa, Neisseria meningitidis
YAAERITHDYPKPTGTDKDKISTVSDYFRNIRAHSIHPRVSVGYDFGGWRIAADYASYRKWNNNKYSVNTKEISRNNSNGNDTWQELKTENQENGSFHAVSSLGLSAIYDFKLNDKFDKFKPYIGARVAYGHVKHQVHSVRKETTTVFSKPSGSATKPGQIPSSVTKPPYHQSHSISSL

SEQ ID NO: 12253 - protein, 165 aa, Neisseria meningitidis
YAAERITHDYPKATGANNTSTVSDYFRNIRAHSIHPRVSVGYDFGDWRIAADYASYRKWKESNSSTNTENSETQQNRIKIETGHQGNGSFHAASSLGLSAIYDFKLNDKFKPYIGARVAYGYVKHQVHSVESKTKTVTSKPNGGPVKEGPTPKPAYHESNSISSL

SEQ ID NO: 12254 - protein, 178 aa, Neisseria meningitidis
YAAERITHDYPKPTGTDKDKISTVSDYFRNIRAHSIHPRVSVGYDFGGWRIAADYASYRKWNNNKYSVNTKELQRNNNAGNWIELKTENQENGSFHAVSSLGLSAIYDFKLNDKFDKFKPYIGVRVAYGHVKHQVHSVETETKIIFTTPTGGAKVGGTIPNKSMSKPAYHERNSISSV

SEQ ID NO: 12255 - protein, 175 aa, Neisseria meningitidis
YAAERITHDYPKPTGTDKISTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTTFLAPTQGATVPGKIVEGPFSKPAYHESHSISSL

SEQ ID NO: 12256 - protein, 172 aa, Neisseria meningitidis
YAAERITHNYPEPTGADKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPKGGTPAGGPVIKTDPSKPPYHESHSISSL

SEQ ID NO: 12257 - protein, 169 aa, Neisseria meningitidis
YAAERITHDYPKPTGANNTSTVSDYFRNIRAHSIHPRVSVGYDFGGWRIAADYASYRKWNNNKYSVNIKKGRETRDNREELKTENQENGSFHAASSLGLSAIYDFKLNDKFDKFKPYIGARVAYGHVKHQVHSVETKTTIVTSKPNGGPVKEGPTPKPAYHESNSISSL

SEQ ID NO: 12258 - protein, 167 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQGNGSFHAASSLGLSAIYDFKLNDKFKPYIGARVAYGYVKHQVHSVESKTTTVTSKPNGGPVKEGPISKPAYHESHSISSL

SEQ ID NO: 12259 - protein, 176 aa, Neisseria meningitidis
YAAERITHDYPKPTGTDKDKISTVSDYFRNIRAHSIHPRVSVGYDFGGWRIAADYASYRKWNNNKYSVNTKEVRENQGNREHLKTENQENGTFHAVSSLGLSAIYDFKLNDKFDKFKPYIGARVAYGHVKHQVHSVETKTTIYTTAPTGGSTVGGTIPERPSSKPAYHERNSISSL

SEQ ID NO: 12260 - protein, 178 aa, Neisseria meningitidis
YAAERITHDYPKPTGTDKDKISTVSDYFRNIRAHSIHPRVSVGYDFGDWRIAADYASYRKWNNNKYSVNTKELQRNKEHGNWIELKTENQENGSFHAASSLGLSAIYDFKLNDKFDKFKPYIGVRVAYGHVKHQVHSVETETKIIFTTPTGGAKVGGKIPNKPSSKPPYHQSHSISSL

SEQ ID NO: 12261 - protein, 170 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTITSKPKNGSPQGGPIIQTDPSKPPYHESHSISSV

SEQ ID NO: 12262 - protein, 170 aa, Neisseria meningitidis
YAAERITHDYPQATGANNTSTVSDYFRNIRAHSIHPRVSVGYDFGGWRIAADYASYRKWKESNFSTKKVTKEINDNYQETKTEHQRNGSFHASSSLGLSAIYDFKLNDKFKPYIGARVAYGHVKHQVHSVETKTTTVTSKPKNGSPQGGAVPSREPSKPPYHESNSISSL

SEQ ID NO: 12263 - protein, 176 aa, Neisseria meningitidis
YAAERITHDYPKATGANNTSTVSDYFRNIRAHSIHPRVSVGYDFGGWRIAADYASYRKWNNNKYSVNTKEVERNNISGNWKELKTENQENGSFHAASSLGLSAIYDFKLNDKFDKFKPYIGVRVAYGHVKHQVHSVESKTTIVTTAPTQGALKGGTILQGPTPKPPYHESNSISSL

SEQ ID NO: 12264 - protein, 164 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTVTSKPNGGPVPSSVTKPPYHQSHSISSL

SEQ ID NO: 12265 - protein, 174 aa, Neisseria meningitidis
YAAERITHDYPKATGANNTSTVSDYFRNIRAHSIHPRVSVGYDFGDWRIAADYASYRKWNNNKYSVNTKKVQENNGNREDLKTENQENGTFHAVSSLGLSAIYDFKLNDKFDKFKPYIGARVAYGHVKHQVHSVESKTTIVTTAPTRGAPKGGTILQGPSPKPPYHESNSISSL

SEQ ID NO: 12266 - protein, 176 aa, Neisseria meningitidis
YAAERITHDYPQATGANNTSTVSDYFRNIRAHSIHPRVSVGYDFGGWRIAADYASYRKWSNNKYSVNTKELQRNKEYGNWIELKTENQENGSFHAASSLGLSAIYDFKLNDKFDKFKPYIGARVAYGHVKHQVHSVKTETKTIFTAPTGGAQQRGTIPERPSSKPPYHESHSISSV

SEQ ID NO: 12267 - protein, 172 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12268 - protein, 176 aa, Neisseria meningitidis
YAAERITHDYPKASGANNTSTVSDYFRNIRAHSIHPRVSVGYDFGGWRIAADYASYRKWNNNKYSVNTKEVLRNNNAGNWRELKTENQENGSFHASSSLGLSAIYDFKLNDKFDKFKPYIGVRVAYGHVKHQVHSVRKETKTTFSKPGAGATKPGKIVEGPTSKPAYHESHSISSV

SEQ ID NO: 12269 - protein, 170 aa, Neisseria meningitidis
YAAERITHDYPKPTGTDKISTVSDYFRNIRAHSIHPRVSVGYDFGGWRIAADYASYRKWKESNYSKKVTEFKHQNGTKKEDKTEHQGNGSFHAASSLGLSAIYDFKLNDKFKPYIGARVAYGHVRYSIDSTKKTTDVVTVATNTPDGAPTIYNEPKTQNAYHESHSIRRL

SEQ ID NO: 12270 - protein, 176 aa, Neisseria meningitidis
YAAERITHDYPKATGANNTSTVSDYFRNIRAHSIHPRVSVGYDFGGWRIAADYASYRKWSNNKYSVNTKEVQRNNNAGNWQELKTENQENGSFHAASSLGLSAIYDFKLNDKFDKFKPYIGARVAYGHVKHQVHSVRKETTTTFSKAGAGATEPGKIISGPISKPAYHESHSISSL

SEQ ID NO: 12271 - protein, 172 aa, Neisseria meningitidis
YAAERITHDYPKPTGTDKDKISTVSDYFRNIRAHSIHPRVSVGYDFGDWRIAADYASYRKWKESNFSTKKVTKEINDNYQETKTEHQGNGSFHASSSLGLSAIYDFKLNDKFKPYIGARVAYGHVKHQVHSVETKTTTVTSKPKNGSPQGGAVPSREPSKPPYHESNSTSSL

SEQ ID NO: 12272 - protein, 172 aa, Neisseria meningitidis
YAAERITHNYPEPTGADKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPKGGTPAGGPVVKTDPSKPPYHESHSISSL

SEQ ID NO: 12273 - protein, 178 aa, Neisseria meningitidis
YAAERITHDYPEPTGADKDKISTVSDYFRNIRTHSIHPRVSVGYDFGDWRIAADYASYRKWNNNKYSVNTKEVERNNISGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12274 - protein, 171 aa, Neisseria meningitidis
YAAERITHDYPQATGANNTSTVSDYFRNIRAHSIHPRVSVGYDFGDWRIAADYASYRKWNNNKYSVNTKNVQVHKSNGNREDLKTENQENGTFHAVSSLGLSAVYDFDTGSRFKPYAGVRVAYGHVRHSIDSTKKTTNVVTVAGAANTAPTIYYAPETQNAYHESHSIRRL

SEQ ID NO: 12275 - protein, 170 aa, Neisseria meningitidis
YAAERITHDYPKATGANNTSTVSDYFRNIRAHSIHPRVSVGYDFGGWRIAADYASYRKWKESNSSTNAENRDSIQNYVKIETKHQGNGSFHAASSLGLSAIYDFKLNDKFKPYIGARVAYGHVKHQVHSVESKNTIITSKPTGNTPAGGPVPTGFVPKSAYHESHSISSL

SEQ ID NO: 12276 - protein, 173 aa, Neisseria meningitidis
YAAERITHDYPKPTGTDKDKISTVSDYFRNIRAHSIHPRVSVGYDFGGWRIAADYASYRKWNNNKYSVNTKEVLRNNNGNRKELKTENQENGTFHAVSSLGLSAIYDFKLNDKFKPYIGARVAYGHVRYSIDSTKKTTDVVTVATNTPDGAPTIYNEPKTQNAYHESHSIRRL

SEQ ID NO: 12277 - protein, 178 aa, Neisseria meningitidis
YAAERITHDYPKPTGANKDKISTVSDYFRNIRAHSIHPRVSVGYDFGGWRIAADYASYRKWNNNKYSVNTKELLRNNSSGIWQELKTENQENGTFHAASSLGLSAIYDFKLNDKFDKFKPYIGARVAYGHVKHQVHSVRKETKTTFSPPKQGATVPGKIVEGPFSKPPYHESNSISSL

SEQ ID NO: 12278 - protein, 172 aa, Neisseria meningitidis
YAAERITHDYPKATGADKDKISTVSDYFRNIRAHSIHPRVSVGYDFGGWRIAADYASYRKWNNNKYSVNTKKVQENQGTRKDLKTENQENGSFHAASSLGLSAIYDFKLNDKFKPYIGARVAYGHVRHSIDSTKKTTEVVTSTHGGADTKPTIYNGESTQNAYHESHSIRRL

SEQ ID NO: 12279 - protein, 176 aa, Neisseria meningitidis
YAAERITHDYPKATGANNTSTVSDYFRNIRAHSIHPRVSVGYDFGGWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSL

SEQ ID NO: 12280 - protein, 175 aa, Neisseria meningitidis
YAAERITHDYPQATGANNTSTVSDYFRNIRAHSIHPRVSVGYDFGGWRIAADYASYRKWNNNKYSVNTKEVQRNNNGNWQELKTENQENGSFHAASSLGLSAIYDFKLNNKFDKFKPYIGARVAYGHVKHQVHSVRKETTTAFLAPTGNAKVPGKIVQGPVSQPAYHESHSISSL

SEQ ID NO: 12281 - protein, 172 aa, Neisseria meningitidis
YAAERITHDYPKPTGTDKDKISTVSDYFRNIRAHSIHPRVSVGYDFGGWRIAADYASYRKWNNNKYSVQIKEIKNVPPNRQDLKTENQENGTFHAVSSLGLSAIYDFKLNDKFKPYIGARVAYGHVRHSIDSTKKTTEVLTSTYGGADTKPTIYNGKSTQNAYHESHSIRRL

SEQ ID NO: 12282 - protein, 170 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTVTSKPKGKNLKGGPVPLRHSSQPPYHESNSISSL

SEQ ID NO: 12283 - protein, 174 aa, Neisseria meningitidis
YAAERITHDYPKPTGANNTSTVSDYFRNIRAHSIHPRVSVGYDFGDWRIAADYASYRKWNNNKYSVNTKEVLRNQGNWQELKTENQENGSFHASSSLGLSAIYDFKLNDKFDKFKPYIGARVAYGHVKHQVHSVRKETTTTFSKAGAGATEPGKIILGPISKPAYHESHSTSSL

SEQ ID NO: 12284 - protein, 170 aa, Neisseria meningitidis
YAAERITHDYPEATGANNTSTVSDYFRNIRTHSIHPRVSVGYDFGGWRIAADYASYRKWNNNKYSVNTKKVQENQGTRKDLKTENQENGSFHAASSLGLSAIYDFKLNDKFKPYIGARVAYGHVRYSIDSTKKTTDVVTVATNTPDGAPTIYNEPKTQNAYHESHSIRRL

SEQ ID NO: 12285 - protein, 176 aa, Neisseria meningitidis
YAAERITHDYPKASGANNTSTVSDYFRNIRAHSIHPRVSVGYDFGGWRIAADYASYRKWNNNKYSVNTKEVLRNDNAGNWRELKTENQENGSFHASSSLGLSAIYDFKLNDKFDKFKPYIGVRVAYGHVKHQVHSVKKETTTTFSKPGAGATKPGKIVEGPTSKPAYHESHSISSV

SEQ ID NO: 12286 - protein, 176 aa, Neisseria meningitidis
YAAERITHDYPQATGANNTSTVSDYFRNIRAHSIHPRVSVGYDFGGWRIAADYASYRKWNNNKYSVNTKEVERNNISGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12287 - protein, 174 aa, Neisseria meningitidis
YAAERITHDYPKATGANNTSTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVETETTTVFSKPQGTTVPSKIVSKDPSKPAYHESHSISSL

SEQ ID NO: 12288 - protein, 177 aa, Neisseria meningitidis
YAAERITHDYPKATGANNTSTVSDYFRNIRAHSIHPRVSVGYDFGGWRIAADYAGYRKWNDNKYSVNTKEVLRNNSTGTENWQELKTENQENGSFHAASSLGLSAIYDFKLNDKFDKFKPYIGARVAYGHVKHQVHSVETETTTVFSKPKGTTVPGIISEKPISKPPYHESNSISSL

SEQ ID NO: 12289 - protein, 177 aa, Neisseria meningitidis
YAAERITHNYPEPTGANKDKISTVSDYFRNIRAHSIHPRVSVGYDFGDWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDPSKPAYHESNSISSL

SEQ ID NO: 12290 - protein, 176 aa, Neisseria meningitidis
YAAERITHDYPKPTGTDKDKISTVSDYFRNIRAHSIHPRVSVGYDFGDWRIAADYASYRKWNNNKYSVNTKVLQENNGNREDLKTENQENGTFHASSSLGLSAIYDFKLNDKFDKFKPYIGARVAYGHVKHQVHSVRKETTTVFSKPSGSVTKPGEIVQGPTSKPPYHESNSISSL

SEQ ID NO: 12291 - protein, 174 aa, Neisseria meningitidis
YAAERITHDYPKPTGANNTSTVSDYFRNIRTHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPKGKHLKGGPVPLRHSSQPPYHESNSISSL

SEQ ID NO: 12292 - protein, 177 aa, Neisseria meningitidis
YAAERITHDYPKATGANNTSTVSDYFRNIRAHSIHPRVSVGYDFGDWRIAADYASYRKWNNNKYSVNTKEVRRNNSNGTDTWKELKTENQENGSFHAVSSLGLSAIYDFKLNDKFDKFKPYIGVRVAYGHVKHQVHSVRKETTTVFSKPSGSTTKPGEIPSLVTKPAYHESHSISSL

SEQ ID NO: 12293 - protein, 175 aa, Neisseria meningitidis
YAAERITHNYPEPTGADKDKISTVSDYFRNIRAHSIHPRVSVGYDFGGWRIAADYASYRKWKESNSSTKKVTEEINNNYKETQTKHQGNGSFHAASSLGLSAIYDFKLNDKFDKFKPYIGARVAYGHVKHQVHSVESKNTIVTSKPTQGAAQGGPVPTGFVPKSAYHESNSISSL

SEQ ID NO: 12294 - protein, 174 aa, Neisseria meningitidis
YAAERITHDYPKATGANNTSTVSDYFRNIRAHSIHPRVSVGYDFGGWRIAADYASYRKWNNNKYSVNIKKGRETQDNREELKTENQENGTFHAASSLGLSAIYDFKLNDKFDKFKPYIGARVAYGHVKHQVHSVRKETKTTFSPPKQGATVPGKIVEGPFSKPPYHESHSISSL

SEQ ID NO: 12295 - protein, 175 aa, Neisseria meningitidis
YAAERITHDYPKATGANNTSTVSDYFRNIRAHSIHPRVSVGYDFGGWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDPSKPAYHESNSISSL

SEQ ID NO: 12296 - protein, 165 aa, Neisseria meningitidis
YAAERITHDYPQATGANNTSTVSDYFRNIRAHSIHPRVSVGYDFGDWRIAADYASYRKWKESNSSTKKVTEEINNNYKETQTKHQGNGSFHASSSLGLSAIYDFKLNDKFKPYIGARVAYGHVKHQVHSVESKTTIVTPKPSGGPIIEGPTPKPPYHESNSISSL

SEQ ID NO: 12297 - protein, 168 aa, Neisseria meningitidis
YAAERITHDYPKPTGANNTSTVSDYFRNIRAHSIHPRVSVGYDFGGWRIAADYASYRKWNNNKYSVNIKKGRETQHNREELKTENQENGTFHAASSLGLSAIYDFKLNDKFDKFKPYIGARVAYGHVKHQVHSVETKTTIVTSKPNGGPVPSSVTKPPYHQSHSISSL

SEQ ID NO: 12298 - protein, 178 aa, Neisseria meningitidis
YAAERITHDYPKPTGTDKDKISTVSDYFRNIRAHSIHPRVSVGYDFGDWRIAADYASYRKWNNNKYSVNTKELQRNNNTGIWQELKTENQENGTFHAASSLGLSAIYDFKLNDKFDKFKPYIGARVAYGHVKHQVHSVRKETTTTFSPPAQGATVPGKIVQGPTNKPPYHESHSTSSL

SEQ ID NO: 12299 - protein, 174 aa, Neisseria meningitidis
YAAERITHDYPQATGANNTSTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGDATVGGTIPERPSSKPAYHESNSISSL

SEQ ID NO: 12300 - protein, 175 aa, Neisseria meningitidis
YAAERITHDYPKATGANNTSTVSDYFRNIRAHSIHPRVSVGYDFGDWRIAADYASYRKWNNNKYSVNTKNVQKNDNGNRQDLKTENQENGTFHAVSSLGLSAIYDFKLNDKFDKFKPYIGVRVAYGHVKHQVHSVKKETTTTFLAPTQGATVPGKIVEGPFSKPAYHESNSTSSL

SEQ ID NO: 12301 - protein, 178 aa, Neisseria meningitidis
YAAERITHNYPEPTGADKDKISTVSDYFRNIRAHSIHPRVSVGYDFGGWRIAADYASYRKWNNNKYSVNTKEVERNNISGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12302 - protein, 173 aa, Neisseria meningitidis
YAAERITHNYPEPTGANKDKISTVSDYFRNIRAHSIHPRVSVGYDFGDWRIAADYASYRKWNNNKYSVNTKVLKETQDNWQELKTENQENGTFHAASSLGLSAIYDFKLNDKFKPYIGARVAYGHVKHQVHSVETKTTTVTSKPNGKNLKGGPVSSREPSKPPYHESHSTSSL

SEQ ID NO: 12303 - protein, 175 aa, Neisseria meningitidis
YAAERITHDYPKATGANNTSTVSDYFRNIRAHSIHPRVSVGYDFGDWRIAADYASYRKWNNNKYSVNTKELERNDSNGNWKELKTENQGNGSFHAASSLGLSAIYDFKLNDKFDKFKPYIGARVAYGHVKHQVHSVETETTTVFSKPQGTTVPSKIVSKDPSKPAYHESNSISSL

SEQ ID NO: 12304 - protein, 176 aa, Neisseria meningitidis
YAAERITHDYPKPTGTDKDKISTVSDYFRNIRAHSIHPRVSVGYDFGGWRIAADYASYRKWNNNKYSVNTKEVQRHSNGNREDLKTENQENGTFHAVSSLGLSAIYDFKLNDKFDKFKPYIGARVAYGHVKHQVHSVETKTTIVTSKPTGGATVGGTIPSSVIKPAYHERNSISSV

SEQ ID NO: 12305 - protein, 175 aa, Neisseria meningitidis
YAAERITHDYPQATGANNTSTVSDYFRNIRAHSIHPRVSVGYDFGDWRIAADYASYRKWNNNKYSVNTKELQRNNNAGNWIELKTENQENGSFHAVSSLGLSAIYDFKLNDKFDKFKPYIGARVAYGHVKHQVHSVETETTTVFSKPQGTTVPSKIVSKDPSKPAYHESNSISSL

SEQ ID NO: 12306 - protein, 171 aa, Neisseria meningitidis
YAAERITHDYPKATGANNTSTVSDYFRNIRAHSIHPRVSVGYDFGDWRIAADYASYRKWKESNSSTNAENRDIAQNYVKIETKHQGNGSFHAASSLGLSAIYDFKLNDKFKPYIGARVAYGHVKHQVHSVETKTTTVTSKPTTTSPNGGGPIIKTDPSKPAYHESHSIRRL

SEQ ID NO: 12307 - protein, 171 aa, Neisseria meningitidis
YAAERITHDYPQATGANNTSTVSDYFRNIRAHSIHPRVSVGYDFGGWRIAADYASYRKWNNNKYSVNTKKVQENQGTRKDLKTENQENGSFHAASSLGLSAIYDFKLNDKFKPYIGARVAYGHVKHQVHSVESKTTIVTTAPTGGAQKGGVISEATISKPPYHQSHSISSL

SEQ ID NO: 12308 - protein, 174 aa, Neisseria meningitidis
YAAERITHDYPKATGANNTSTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGGAKVGGTIPERPSSKPAYHERNSISSL

SEQ ID NO: 12309 - protein, 167 aa, Neisseria meningitidis
YAAERITHNYPEPTGADKDKISTVSDYFRNIRAHSIHPRVSVGYDFGGWRIAADYASYRKWKESNYSKKVTEFKHQNGNKQEDKTEHQGNGSFHATSSLGLSAIYDFKLNDKFKPYIGVRVAYGHVKHQVHSVESKTTTVTTNNGGPVPQGPTPKPAYHESHSISSV

SEQ ID NO: 12310 - protein, 174 aa, Neisseria meningitidis
YAAERITHDYPKATGANNTSTVSDYFRNIRAHSIHPRVSVGYDFGDWRIAADYASYRKWNNNKYSVNTKEVLRNQGNWQELKTENQENGSFHASSSLGLSAIYDFKLNDKFDKFKPYIGARVAYGHVKHQVHSVRKETTTTFSKAGAGATEPGKIILGPISKPAYHESHSTSSL

SEQ ID NO: 12311 - protein, 170 aa, Neisseria meningitidis
YAAERITHDYPQATGANNTSTVSDYFRNIRAHSIHPRVSVGYDFGDWRIAADYASYRKWKESNFSTKKVTKEINDNYQETKTEHQGNGSFHASSSLGLSAIYDFKLNDKFKPYIGARVAYGHVKHQVHSVETKTTTVTSKPKNGSPQGGAVPSREPSKPPYHESHSISSL

SEQ ID NO: 12312 - protein, 178 aa, Neisseria meningitidis
YAAERITHDYPKATGANNTSTVSDYFRNIRAHSIHPRVSVGYDFGDWRIAADYASYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESNSISSL

SEQ ID NO: 12313 - protein, 177 aa, Neisseria meningitidis
YAAERITHDYPKPTDANNTSTVSDYFRNIRAHSIHPRVSVGYDFGGWRIAADYAGYRKWNDNKYSVNTKEVLRNNSTGTENWQELKTENQENGSFHAASSLGLSAIYDFKLNDKFDKFKPYIGARVAYGHVKHQVHSVETETTTVFSKPKGTTVPGIISEKPISKPPYHESNSISSL

SEQ ID NO: 12314 - protein, 170 aa, Neisseria meningitidis
YAAERITHDYPQATDANNTSTVSDYFRNIRAHSIHPRVSVGYDFGGWRIAADYASYRKWNNNKYSVQIKEIKNVPPNRQDLKTENQENGTFHAVSSLGLSAIYDFKLNDKFKPYIGARVAYGHVRHSIDSTKKTTEVLTSTYGGADTKPTIYNGKSTQNAYHESHSIRRL

SEQ ID NO: 12315 - protein, 177 aa, Neisseria meningitidis
YAAERITHDYPKPTGTDKDKISTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTVFTAPTQGAQKGGVIPEATISKPAYHESHSISSL

SEQ ID NO: 12316 - protein, 172 aa, Neisseria meningitidis
YAAERITHDYPEATGANNTSTVSDYFRNIRTHSIHPRVSVGYDFGGWRIAADYARYRKWNNNKYSVNTKNVQVHKSNGNREDLKTENQENGTFHAVSSLGLSAVYDFDTGSRFKPYAGVRVAYGHVRHSIDSTKKTTNVLTVPSNIPGGTPTIYNQGSTQNAYHESHSIRRL

SEQ ID NO: 12317 - protein, 176 aa, Neisseria meningitidis
YAAERITHDYPQATGANNTSTVSDYFRNIRAHSIHPRVSVGYDFGGWRIAADYARYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12318 - protein, 176 aa, Neisseria meningitidis
YAAERITHDYPKASGANNTSTVSDYFRNIRAHSIHPRVSVGYDFGGWRIAADYASYRKWNNNKYSVNTKEVLRNDNAGNWRELKTENQENGSFHASSSLGLSAIYDFKLNDKFDKFKPYIGVRVAYGHVKHQVHSVKKETTTTFSKPGAGATKPGKIVEGPFSKPAYHESHSISSL

SEQ ID NO: 12319 - protein, 176 aa, Neisseria meningitidis
YAAERITHDYPQATGANNTSTVSDYFRNIRAHSIHPRVSVGYDFGDWRIAADYASYRKWNNNKYSVNTKEVLRNNNAGNWQELKTENQENGSFHAVSSLGLSAIYDFKLNDKFDKFKPYIGARVAYGHVKHQVHSVRKETKTTFSKPGAGATKPGKIVEGPTSKPAYHESNSISSL

SEQ ID NO: 12320 - protein, 174 aa, Neisseria meningitidis
YAAERITHDYPQATGANNTSTVSDYFRNIRAHSIHPRVSVGYDFGDWRIAADYASYRKWNNNKYSVNTKEVRRNGGNSENLKTENQENGTFHAASSLGLSAIYDFKLNDKFDKFKPYIGVRVAYGHVKHQVHSVETETKIIFTTPTGGAKVGGTILDKSMSKPPYHESNSISSL

SEQ ID NO: 12321 - protein, 176 aa, Neisseria meningitidis
YAAERITHDYPKATGANNTSTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSL

SEQ ID NO: 12322 - protein, 170 aa, Neisseria meningitidis
YAAERITHDYPQATGANNTSTVSDYFRNIRAHSIHPRVSVGYDFGGWRIAADYASYRKWKESNSSTKKVTEEINNNYKETQTKHQGNGSFHAVSSLGLSAIYDFKLNDKFKPYIGARVAYGHVKHQVHSVETKTTTITSKPKNGSPQGGPIIQTDPSKPPYHESHSISSV

SEQ ID NO: 12323 - protein, 170 aa, Neisseria meningitidis
YAAERITHDYPQATGANNTSTVSDYFRNIRAHSIHPRVSVGYDFGGWRIAADYASYRKWKESNFSTKKVTEEIKDNYQETKTEHQGNGSFHATSSLGLSAIYDFKLNDKFKPYIGARVAYGHVKHQVHSVETKTTTVTSKPKGDTPAGGPVIKTDPSKPPYHESHSISSL

SEQ ID NO: 12324 - protein, 176 aa, Neisseria meningitidis
YAAERITHDYPKASGANNTSTVSDYFRNIRAHSIHPRVSVGYDFGGWRIAADYASYRKWNNNKYSVNTKEVLRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSL

SEQ ID NO: 12325 - protein, 176 aa, Neisseria meningitidis
YAAERITHDYPKPTGTDKDKISTVSDYFRNIRAHSIHPRVSVGYDFGDWRIAADYASYRKWNNNKYSVNTKEVRENKGNREHLKTENQENGTFHAVSSLGLSAIYDFKLNDKFDKFKPYIGVRVAYGHVKHQVHSVETKTTIYTTAPTRGATVGGTIPERPSSKPAYHESNSISSL

SEQ ID NO: 12326 - protein, 170 aa, Neisseria meningitidis
YAAERITHDYPKATGANNTSTVSDYFRNIRAHSIHPRVSVGYDFGDWRIAADYASYRKWKESNSSTNTENSETQQNRIKIETKHQGNGSFHAASSLGLSAIYDFKLNDKFKPYIGARVAYGHVKHQVHSVETKTTTVTSKPTATSPQGGPIIQTDPSKPPYHESHSISSL

SEQ ID NO: 12327 - protein, 175 aa, Neisseria meningitidis
YAAERITHDYPKATGANNTSTVSDYFRNIRTHSIHPRVSVGYDFGDWRIAADYASYRKWNNNKYSVNTKEVLRHSNGNWQELKTENQENGTFHAVSSLGLSAIYDFKLNDKFDKFKPYIGARVAYGHVKHQVHSVKKETTTVFTAPTGGAKVPGKVVKGPTSKPPYHESHSTSSL

SEQ ID NO: 12328 - protein, 176 aa, Neisseria meningitidis
YAAERITHDYPQATGANNTSTVSDYFRNIRAHSIHPRVSVGYDFGDWRIAADYASYRKWNNNKYSVNTKEVLRNNNAGNWQELKTENQENGSFHAASSLGLSAIYDFKLNDKFDKFKPYIGARVAYGHVKHQVHSVRKETKTTFSKPGAGATKPGKIVEGPTSKPAYHESHSISSV

SEQ ID NO: 12329 - protein, 177 aa, Neisseria meningitidis
YAAERITHDYPKPTGTDKDKISTVSDYFRNIRAHSIHPRVSVGYDFGGWRIAADYASYRKWNNNKYSVNTKEVQRNNNGNWQELKTENQENGTFHAVSSLGLSAIYDFKLNDKFDKFKPYIGARVAYGHVKHQVHSVETKTTIYTTAPTGGAKVGGTIPERPSSKPAYHERNSISSL

SEQ ID NO: 12330 - protein, 176 aa, Neisseria meningitidis
YAAERITHDYPEPTGADKDKISTVSDYFRNIRAHSIHPRVSVGYDFGGWRIAADYASYRKWNNNKYSVNTKVLKENLGNRIELKTENQGNGSFHAASSLGLSAIYDFKLNDKFDKFKPYIGARVAYGHVKHQVHSVETTTEIIFTTPTGGATVGGKIPNKSSSKPPYHQSHSISSL

SEQ ID NO: 12331 - protein, 179 aa, Neisseria meningitidis
YAAERITHDYPKPTGTDKDKISTVSDYFRNIRAHSIHPRVSVGYDFGGWRIAADYASYRKWNNNKYSVNTKEISRNNSNGNDTWQELKTENQENGSFHAVSSLGLSAIYDFKLNDKFDKFKPYIGARVAYGHVKHQVHSVRKETTTVFSKPSGSATKPGQIPSLVTKPAYHESHSISSL

SEQ ID NO: 12332 - protein, 165 aa, Neisseria meningitidis
YAAERITHDYPKPTGTDKISTVSDYFRNIRAHSIHPRVSVGYDFGGWRIAADYASYRKWKESNYSKKVTEFKHQNGTKKEDKTEHQGNGSFHAASSLGLSAIYDFKLNDKFKPYIGARIAYGHVKHQIHSVESKTTTVTSNNGGPIPQGPTPKPPYHESNSISSL

SEQ ID NO: 12333 - protein, 170 aa, Neisseria meningitidis
YAAERITHDYPQATGANNTSTVSDYFRNIRAHSIHPRVSVGYDFGDWRIAADYASYRKWKESNSSTNTENSEHPQNHVKIETKHQGNGSFHAASSLGLSAIYDFKLNDKFKPYIGARVAYGHVKHQVHSVESKNTIVTSKPTQGAAQGGPVPTGFVPKSAYHESNSISSL

SEQ ID NO: 12334 - protein, 176 aa, Neisseria meningitidis
YAAERITHDYPKPTGTDKDKISTVSDYFRNIRAHSIHPRVSVGYDFGGWRIAADYASYRKWNNNKYSVNIKKGRETPDNREELKTENQENGSFHAASSLGLSAIYDFKLNDKFDKFKPYIGARVAYGHVKHQVHSVETKTTIVTSKPKGKHLKGGPIPLRHSSQPPYHESNSISSL

SEQ ID NO: 12335 - protein, 176 aa, Neisseria meningitidis
YAAERITHDYPKASGANNTSTVSDYFRNIRAHSIHPRVSVGYDFGGWRIAADYASYRKWNNNKYSVNTKEVLRNDNAGNWRELKTENQENGSFHASSSLGLSAIYDFKLNDKFDKFKPYIGVRVAYGHVKHQVHSVKKETTTTFSKPGAGATKPGKIVEGPFSKPAYHESHSISSV

SEQ ID NO: 12336 - protein, 165 aa, Neisseria meningitidis
YAAERITHDYPQATGANNTSTVSDYFRNIRAHSIHPRVSVGYDFGGWRIAADYASYRKWKESNYSKKVTEFKHQNGTKKEDKTEHQGNGSFHAASSLGLSAIYDFKLNDKFKPYIGARIAYGHVKHQIHSVESKTTTVTSNNGGPIPQGPTPKPPYHESNSISSL

SEQ ID NO: 12337 - protein, 173 aa, Neisseria meningitidis
YAAERITHNYPEPTGADKDKISTVSDYFRNIRAHSIHPRVSVGYDFGDWRIAADYASYRKWNNNKYSVNTKVLKENLGNRIELKTENQGNGSFHAASSLGLSAIYDFKLNDKFKPYIGARVAYGHVKHQVHSVETTTETIFTTPTGGATVGGKIPNKSSSKPPYHQSHSISSL

SEQ ID NO: 12338 - protein, 178 aa, Neisseria meningitidis
YAAERITHNYPKPTGTDKDKISTVSDYFRNIRAHSIHPRVSVGYDFGGWRIAADYASYRKWNNNKYSVNTKEVRRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSL

SEQ ID NO: 12339 - protein, 175 aa, Neisseria meningitidis
YAAERITHDYPKATGANNTSTVSDYFRNIRAHSIHPRVSVGYDFGGWRIAADYASYRKWNNNKYSVNTKEVERNNTSGNWKELKTENQENGTFHASSSLGLSAIYDFKLNDKFDKFKPYIGVRVAYGHVKHQVHSVRKETTTAFLKPSKGATEPGKIPSLVTKPAYHESHSTSSL

SEQ ID NO: 12340 - protein, 174 aa, Neisseria meningitidis
YAAERITHDYPQATGANNTSTVSDYFRNIRAHSIHPRVSVGYDFGDWRIAADYASYRKWNNNKYSVNTKKVQENNGNRKDLKTENQENGTFHAVSSLGLSAIYDFKLNDKFDKFKPYIGARVAYGHVKHQVHSVESKTTIVTTAPTRGAPKGGTILQGPTPKPPYHESNSISSL

SEQ ID NO: 12341 - protein, 176 aa, Neisseria meningitidis
YAAERITHDYPKASGANNTSTVSDYFRNIRAHSIHPRVSVGYDFGDWRIAADYASYRKWNNNKYSVNTKEVRRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSL

SEQ ID NO: 12342 - protein, 176 aa, Neisseria meningitidis
YAAERITHDYPQATGANNTSTVSDYFRNIRAHSIHPRVSVGYDFGDWRIAADYASYRKWNNNKYSVNTKEVLRNNNAGNWQELKTENQENGSFHAVSSLGLSAIYDFKLNDKFDKFKPYIGARVAYGHVKHQVHSVRKETKTTFSKPGAGATKPGKIVEGPTSKPAYHESHSISSV

SEQ ID NO: 12343 - protein, 173 aa, Neisseria meningitidis
YAAERITHNYPQATGANNTSTVSDYFRNIRAHSIHPRVSVGYDFGDWRIAADYASYRKWKESNSSTKKVTEDIADNYKETKTEHQGNGSFHASSSLGLSAIYDFKLNDKFDKFKPYIGARVAYGHVRHQVNSVDKETITLISKPKGNSPGGGRVVSSLPSKPPYHESNSISSL

SEQ ID NO: 12344 - protein, 172 aa, Neisseria meningitidis
YAAERITHDYPKPTGTDKDKISTVSDYFRNIRAHSIHPRVSVGYDFGDWRIAADYASYRKWKESNFSTKKVTEDIKDNYKETKTEHQGNGSFHATSSLGLSAIYDFKLNDKFKPYIGARVAYGHVKHQVHSVETKTTTVTSKPKNGSPQGGAVPSREPSKPPYHESNSISSL

SEQ ID NO: 12345 - protein, 170 aa, Neisseria meningitidis
YAAERITHNYPKPTGTDKDKISTVSDYFRNIRAHSIHPRVSVGYDFGDWRIAADYASYRKWNNNKYSVNIKKERETPHNRQDLKTENQENGTFHAVSSLGLSAIYDFKLNDKFDKFKPYIGARVAYGHVKHQVHSVETKTTIVTSKPNGGPVPSSVTKPPYHQSHSISSL

SEQ ID NO: 12346 - protein, 175 aa, Neisseria meningitidis
YAAERITHDYPQATGANNTSTVSDYFRNIRAHSIHPRVSVGYDFGGWRIAADYASYRKWNNNKYSVNTKELERNNTSGNWKELKTENQENGTFHASSSLGLSAIYDFKLNDKFDKFKPYIGVRVAYGHVKHQVHSVRKETTTAFLKPSKGATEPGKIPSLVTKPAYHESHSTSSW

SEQ ID NO: 12347 - protein, 178 aa, Neisseria meningitidis
YAAERITHDYPKATGADKDKISTVSDYFRNIRAHSIRPRVSVGYDFGGWRIAADYASYRKWNNNKYSVNTKELQRNKEHGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12348 - protein, 169 aa, Neisseria meningitidis
YAAERITHDYPQATDANNTSTVSDYFRNIRTHSIHPRVSVGYDFGGWRIAADYARYRKWYNNKNSVQIKEINNVPPNRKDLKTENQENGTFHAISSLGLSAVYDFDTGSRFKPYAGVRVSYGHVRHSIDSTKKTTEVVTTAGSNGAADTVLTGVSTQNAYHESHSIRRL

SEQ ID NO: 12349 - protein, 172 aa, Neisseria meningitidis
YAAERITHNYPEPTGADKDKISTVSDYFRNIRAHSIHPRVSVGYDFGDWRIAADYASYRKWKESNSSTKKVTEDIADNYKETKTEHQGNGSFHAASSLGLSAIYDFKLNDKFKPYIGARVAYGHVKHQVHSVETKTTTVTSKPNGKNLKGGPVSLREPSKPPYHESHSTSSL

SEQ ID NO: 12350 - protein, 179 aa, Neisseria meningitidis
YAAERITHNYPEPTGADKDKISTVSDYFRNIRAHSIHPRVSVGYDFGGWRIAADYASYRKWNNNKYSVNTKEISRNNSNGNDTWQELKTENQENGSFHAVSSLGLSAIYDFKLNDKFDKFKPYIGARVAYGHVKHQVHSVRKETTTVFSKPSGSATKPGQIPSLVTKPAYHESHSISSL

SEQ ID NO: 12351 - protein, 166 aa, Neisseria meningitidis
YAAERITHNYPEPTGADKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPNGGPVPSSVTKPPYHQSHSISSL

SEQ ID NO: 12352 - protein, 175 aa, Neisseria meningitidis
YAAERITHDYPQATGANNTSTVSDYFRNIRAHSIHPRVSVGYDFGGWRIAADYASYRKWNNNKYSVNTKEVERNNTSGNWKELKTENQENGTFHASSSLGLSAIYDFKLNDKFDKFKPYIGVRVAYGHVKHQVHSVRKETTTAFLKPSKGATEPGKIPSLVTKPAYHESHSTSSL

SEQ ID NO: 12353 - protein, 169 aa, Neisseria meningitidis
YAAERITHDYPQATGANNTSTVSDYFRNIRAHSIHPRVSVGYDFGDWRIAADYASYRKWNNNKYSVNTKELENKNNNKRDLKTENQENGSFHAASSLGLSAIYDFKLNDKFKPYIGARVAYGHVRHSIDSTKKTTEVLTSSHAPGTAPTIYNQGSTQNAYHESHSIRRL

SEQ ID NO: 12354 - protein, 177 aa, Neisseria meningitidis
YAAERITHDYPEPTGADKDKISTVSDYFRNIRTHSIHPRVSVGYDFGDWRIAADYASYRKWNNNKYSVNTKEVLRHSNGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12355 - protein, 178 aa, Neisseria meningitidis
YAAERITHDYPKPTGTDKDKISTVSDYFRNIRAHSIHPRVSVGYDFGDWRIAADYASYRKWNNNKYSVNTKEVQRNNSNGTTWKELKTENQENGSFHAVSSLGLSAIYDFKLNDKFDKFKPYIGVRVAYGHVKHQVHSVRKETTTVFSKPSGSTTKPGEIPSLVTKPAYHESNSISSL

SEQ ID NO: 12356 - protein, 172 aa, Neisseria meningitidis
YAAERITHDYPKPTGTDKDKISTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPKGGTPAGGPVIKTDPSKPPYHESHSISSL

SEQ ID NO: 12357 - protein, 178 aa, Neisseria meningitidis
YAAERITHDYPKPTGTDKDKISTVSDYFRNIRAHSIHPRVSVGYDFGGWRIAADYASYRKWNNNKYSVNTKELQKNNSSGIWQELKTENQENGTFHAASSLGLSAIYDFKLNDKFDKFKPYIGARVAYGHVKHQVHSVRKETTTTFSPPAQGATVPGKIVQGPTNKPAYHESNSISSL

SEQ ID NO: 12358 - protein, 168 aa, Neisseria meningitidis
YAAERITHDYPQATGANNTSTVSDYFRNIRAHSIHPRVSVGYDFGDWRIAADYASYRKWNNNKYSVNIKKERETPHNRQDLKTENQENGTFHAVSSLGLSAIYDFKLNDKFDKFKPYIGARVAYGHVKHQVHSVETKTTIVTSKPNGGPVPSSVTKPPYHQSHSISSL

SEQ ID NO: 12359 - protein, 176 aa, Neisseria meningitidis
YAAERITHDYPKPTGTDKDKISTVSDYFRNIRAHSIHPRVSVGYDFGDWRIAADYASYRKWNNNKYSVNTKEVRRNRGNSENLKTENQENGTFHAASSLGLSAIYDFKLNDKFDKFKPYIGARVAYGHVKHQVHSVETETKIIFTTPTGDAQVGGTIIDKPMSKPPYHQSHSISSL

SEQ ID NO: 12360 - protein, 167 aa, Neisseria meningitidis
YAAERITHNYPEPTGADKDKISTVSDYFRNIRAHSIHPRVSVGYDFGGWRIAADYASYRKWKESNYSKKVTEFKHQNGTKKEDKTEHQGNGSFHAASSLGLSAIYDFKLNDKFKPYIGARIAYGHVKHQIHSVESKTTTVTSNNGGPIPQGPTPKPPYHESNSISSL

SEQ ID NO: 12361 - protein, 178 aa, Neisseria meningitidis
YAAERITHDYPKATGTDKDKISTVSDYFRNIRAHSIHPRVSVGYDFGGWRIAADYASYRKWNNNKYSVNTKELQKNNSSGIWQELKTENQENGTFHAASSLGLSAIYDFKLNDKFDKFKPYIGARVAYGHVKHQVHSVRKETTTTFSPPAQGATVPGKIVQGPTNKPAYHESNSISSL

SEQ ID NO: 12362 - protein, 174 aa, Neisseria meningitidis
YAAERITHDYPKATGANNTSTVSDYFRNIRAHSIHPRVSVGYDFGGWRIAADYASYRKWNNNKYSVNTKVLQEKNGNRKELKTENQENGTFHAASSLGLSAIYDFKLNDKFDKFKPYIGARVAYGHVKHQVHSVKKETTTVFTAPTQGAQKGGVIPEATISKPAYHESHSISSL

SEQ ID NO: 12363 - protein, 172 aa, Neisseria meningitidis
YAAERITHDYPQATGANNTSTVSDYFRNIRTHSIHPRVSVGYDFGDWRIAADYASYRKWNDNKYSVNTKNVQVNKSNGNRQDLKTENQENGTFHAVSSLGLSAVYDFNTGSRFKPYAGVRVAYGHVRHSIDSTKKTTNVLTVPTNIPGGTPTIYNQGSTQDAYHESHSIRRL

SEQ ID NO: 12364 - protein, 170 aa, Neisseria meningitidis
YAAERITHDYPQATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTVTSKPKNGSPQGGAVPSRESSKPPYHESNSISSL

SEQ ID NO: 12365 - protein, 176 aa, Neisseria meningitidis
YAAERITHDYPQATGANNTSTVSDYFRNIRAHSIHPRVSVGYDFGGWRIAADYASYRKWSNNKYSVNTKELQRNKEYGNWIELKTENQENGSFHAASSLGLSAIYDFKLNDKFDKFKPYIGARVAYGHVKHQVHSVRKETTTTFSKAGAGATEPGKIILGPISKPAYHESHSTSSL

SEQ ID NO: 12366 - protein, 176 aa, Neisseria meningitidis
YAAERITHDYPKATGANNTSTVSDYFRNIRAHSIHPRVSVGYDFGGWRIAADYASYRKWNNNKYSVNTKELQKNNSSGIWQELKTENQENGTFHAASSLGLSAIYDFKLNDKFDKFKPYIGARVAYGHVKHQVHSVRKETTTTFSPPAQGATVPGKIVQGPTNKPAYHESNSISSL

SEQ ID NO: 12367 - protein, 176 aa, Neisseria meningitidis
YAAERITHDYPKPTGANNTSTVSDYFRNIRAHSIHPRVSVGYDFGGWRIAADYASYRKWSNNKYSVNTKEVQRNNNAGNWQELKTENQENGTFHAVSSLGLSAIYDFKLNDKFDKFKPYIGARVAYGHVKHQVHSVRKETTTTFSKAGAGATEPGKIISGPISKPAYHESHSISSL

SEQ ID NO: 12368 - protein, 170 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVRHQVNSVDKETITLISKPKGNSPGGGRVVSSLPSKPPYHESNSISSL

SEQ ID NO: 12369 - protein, 177 aa, Neisseria meningitidis
YAAERITHDYPKPTGTDKDKISTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVESKTTIVTTAPTQGAPKGGTILQGPTPKPPYHESNSISSL

SEQ ID NO: 12370 - protein, 178 aa, Neisseria meningitidis
YAAERITHDYPKPTGTDKDKISTVSDYFRNIRAHSIHPRVSVGYDFGGWRIAADYASYRKWNDNKYSVNTKELQRNKEYGNWIELKTENQGNGSFHAVSSLGLSAIYDFKLNDKFDKFKPYIGARIAYGHVKHQVHSVETETKIIFTTPTKGAKVGGTIPNKSMSKPPYHESNSISSL

SEQ ID NO: 12371 - protein, 172 aa, Neisseria meningitidis
YAAERITHDYPKPTGANNTSTVSDYFRNIRAHSIHPRVSVGYDFGGWRIAADYASYRKWNNNKYSVNTKKVREKNGNREDLKTENQENGSFHASSSLGLSAIYDFKLNNKFDKFKPYIGVRVAYGHVRHSIDSTKKTTEVLTSSHALGTTPTIYNTPKTQNAYHESHSIRRL

SEQ ID NO: 12372 - protein, 174 aa, Neisseria meningitidis
YAAERITHDYPQATGANNTSTVSDYFRNIRAHSIHPRVSVGYDFGGWRIAADYASYRKWNNNKYSVNTKVLKENLGNRIELKTENQGNGSFHAASSLGLSAIYDFKLNDKFDKFKPYIGARVAYGHVKHQVHSVETTTETIFTTPTKGAKVGGKIPNTPSSKPPYHESNSISSL

SEQ ID NO: 12373 - protein, 173 aa, Neisseria meningitidis
YAAERITHDYPQATGANNTSTVSDYFRNIRAHSIHPRVSVGYDFGGWRIAADYARYRKWNNNKYSVNTKNVQKNDNGNRQDLKTENQENGTFHAASSLGLSAIYDFKLNDKFDKFKPYIGARVAYGHVRHSIDSTKKTTNVVTVAGAANTAPTIYYAPETQNAYHESHSIRRL

SEQ ID NO: 12374 - protein, 176 aa, Neisseria meningitidis
YAAERITHDYPKATGANNTSTVSDYFRNIRAHSIHPRVSVGYDFGGWRIAADYASYRKWSNNKYSVNTKEVQRNNNAGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12375 - protein, 178 aa, Neisseria meningitidis
YAAERITHDYPKPTGANNTSTVSDYFRNIRAHSIHPRVSVGYDFGDWRIAADYASYRKWNNNKYSVNTKEVGRNNNNNIDIWKELKTENQENGSFHAASSLGLSAIYDFKLNDKFDKFKPYIGARVAYGHVKHQVHSVRKETTTVFSKPSGSVTKPGEIVETPTSKPAYHESHSISSL

SEQ ID NO: 12376 - protein, 176 aa, Neisseria meningitidis
YAAERITHDYPQATGANNTSTVSDYFRNIRAHSIHPRVSVGYDFGGWRIAADYASYRKWNNNKYSVNTKEVKRNNISGNWKELKTENQENGSFHAASSLGLSAIYDFKLNDKFDKFKPYIGVRVAYGHVKHQVHSVKKETTTTFLAPTGDAKVPGKIVEGPFSKPAYHESHSTSSL

SEQ ID NO: 12377 - protein, 170 aa, Neisseria meningitidis
YAAERITHDYPQATGANNTSTVSDYFRNIRAHSIHPRVSVGYDFGDWRIAADYASYRKWKESNSSTKKVTEEIKDNYKETKTEHQGNGSFHAASSLGLSAIYDFKLNDKFKPYIGARVAYGHVRHQVNSVDKETITLISKPKGNSPGGGRVVSSLPSKPPYHESNSISSL

SEQ ID NO: 12378 - protein, 177 aa, Neisseria meningitidis
YAAERITHDYPQATGANNTSTVSDYFRNIRAHSIHPRVWVGYDFGDWRIAADYASYRKWNNNKYSVNTKEVQRNNSTGTENWQELKTENQENGSFHAASSLGLSAIYDFKLNDKFDKFKPYIGARVAYGHVKHQVHSVRKETTTVFSKPRGITEPGKIVKGPTSKPPYHESHSTSSL

SEQ ID NO: 12379 - protein, 176 aa, Neisseria meningitidis
YAAERITHDYPKASGANNTSTVSDYFRNIRAHSIHPRVSVGYDFGGWRIAADYASYRKWNNNKYSVNTKEVRRNNNAGNWRELKTENQENGSFHASSSLGLSAIYDFKLNDKFDKFKPYIGVRVAYGHVKHQVHSVKKETTTTFLAPTGDAKVPGKIVEGPFSKPAYHESHSISSL

SEQ ID NO: 12380 - protein, 170 aa, Neisseria meningitidis
YAAERITHDYPKPTGTDKDKISTVSDYFRNIRAHSIHPRVSVGYDFGGWRIAADYASYRKWNNNKYSVNIKKEKETPHNRQDLKTENQENGTFHAVSSLGLSAIYDFKLNDKFDKFKPYIGARVAYGHVKHQVHSVETKTTIVTSKPNGGPVPSSVTKPPYHQSHSISSL

SEQ ID NO: 12381 - protein, 172 aa, Neisseria meningitidis
YAAERITHDYPKPTGTDKDKISTVSDYFRNIRAHSIHPRVSVGYDFGDWRIAADYASYRKWKESNFSTKKVTKEINDNYQETKTEHQGNGSFHASSSLGLSAIYDFKLNDKFKPYIGARVAYGHVKHQVHSVETKTTTVTSKPKNGSPQGGAVPSREPSKPPYHESNSISSL

SEQ ID NO: 12382 - protein, 178 aa, Neisseria meningitidis
YAAERITHDYPKPTGTDKDKISTVSDYFRNIRAHSIHPRVSVGYDFGDWRIAADYASYRKWNNNKYSVNTKELLRNNSSGIWQELKTENQENGTFHAASSLGLSAIYDFKLNDKFDKFKPYIGARVAYGHVKHQVHSVRKETKTTFSPPKQGATVPGKIVEGPTPKPPYHESNSISSL

SEQ ID NO: 12383 - protein, 176 aa, Neisseria meningitidis
YAAERITHNYPQATGADKDKISTVSDYFRNIRAHSIHPRVSVGYDFGDWRIAADYASYRKWNNNKYSVNTKEVLRNQGNWQELKTENQENGSFHASSSLGLSAIYDFKLNDKFDKFKPYIGARVAYGHVKHQVHSVRKETTTTFSKAGAGATEPGKIILGPISKPAYHESHSTSSL

SEQ ID NO: 12384 - protein, 170 aa, Neisseria meningitidis
YAAERITHNYPEPTGADNTSTVSDYFRNIRAHSIHPRVSVGYDFGDWRIAADYASYRKWKESNSSTNAENRDNAKNYVKIETKHQGNGSFHAASSLGLSAIYDFKLNDKFKPYIGARVAYGHVKHQVHSVETKTTTVTSKPTATSPQGGPIIQTDPSKPPYHESNSISSL

SEQ ID NO: 12385 - protein, 174 aa, Neisseria meningitidis
YAAERITHDYPKPTGANNTSTVSDYFRNIRAHSIHPRVSVGYDFGDWRIAADYASYRKWNNNKYSVNTKKVNEKNGNSENLKTENQENGSFHAVSSLGLSAIYDFKLNDKFDKFKPYIGARVAYGHVKHQVHSVETETKIIFTTPTKGAKVGGTILDKSMSKPPYHESNSISSL

SEQ ID NO: 12386 - protein, 170 aa, Neisseria meningitidis
YAAERITHDYPKATGANNTSTVSDYFRNIRAHSIHPRVSVGYDFGGWRIAADYASYRKWKESNFSTKKVTKEINDNYQETKTEHQGNGSFHASSSLGLSAIYDFKLNDKFKPYIGARVAYGHVKHQVHSVETKTTTVTSKPKNGSPQGGAVLSREPSKPPYHESNSISSL

SEQ ID NO: 12387 - protein, 176 aa, Neisseria meningitidis
YAAERITHDYPKPTGTDKDKISTVSDYFRNIRAHSIHPRVSVGYDFGGWRIAADYASYRKWNNNKYSVNIKKGRETQDNREELKTENQENGSFHAASSLGLSAIYDFKLNDKFDKFKPYIGARVAYGHVKHQVHSVETKTTIVTSKPKGKHLKGGPVSLQHSSQPPYHESNSISSL

SEQ ID NO: 12388 - protein, 173 aa, Neisseria meningitidis
YAAERITHDYPKPTGTDKDKISTVSDYFRNIRAHSIHPRVSVGYDFGGWRIAADYASYRKWNNNKYSVNTKVLKETQDNWQELKTENQENGSFHAASSLGLSAIYDFKLNDKFKPYIGARVAYGHVKHQVHSVETKTTTVTSKPNGKNLKGGPVSSREPSKPPYHESHSTSSL

SEQ ID NO: 12389 - protein, 177 aa, Neisseria meningitidis
YAAERITHDYPKPTGTDKDKISTVSDYFRNIRAHSIHPRVSVGYDFGGWRIAADYASYRKWNNNKYSVNTKEVLRNNNGNRKELKTENQENGTFHAVSSLGLSAIYDFKLNDKFDKFKPYIGARVAYGHVKHQVHSVKKETTTTFLAPTQGATVPGKIVEGPFSKPAYHESHSISSL

SEQ ID NO: 12390 - protein, 165 aa, Neisseria meningitidis
YAAERITHDYPQATGANNTSTVSDYFRNIRAHSIHPRVSVGYDFGDWRIAADYASYRKWKESNYSKKVTEFKHQNGNKQEDKTEHQGNGSFHATSSLGLSAIYDFKLSDKFKPYIGVRVAYGHVKHQVHSVESKTTTVTTNNGGPVPQGPTPKPAYHESHSISSV

SEQ ID NO: 12391 - protein, 170 aa, Neisseria meningitidis
YAAERITHDYPQATGANNTSTVSDYFRNIRAHSIHPRVSVGYDFGGWRIAADYASYRKWKESNFSTKKVTEEIKDNYKETKTEHQGNGSFHATSSLGLSAIYDFKLNDKFKPYIGARVAYGHVKHQVHSVETKTTTVTSKPKGGTPAGGPVIKTDPSKPPYHESHSISSL

SEQ ID NO: 12392 - protein, 175 aa, Neisseria meningitidis
YAAERITHDYPQATGANNTSTVSDYFRNIRAHSIHPRVSVGYDFGDWRIAADYASYRKWNNNKYSVNTKEVLRHSNGNWQELKTENQENGSFHAVSSLGLSAIYDFKLNDKFDKFKPYIGARVAYGHVKHQVHSVRKETTTTFSKAGAGATEPGKIISGPISKPAYHESHSISSL

SEQ ID NO: 12393 - protein, 174 aa, Neisseria meningitidis
YAAERITHDYPKATGANNTSTVSDYFRNIRAHSIHPRVSVGYDFGGWRIAADYASYRKWSNNKYSVNTKVLKENQGNRIKLKTENQGNGTFHASSSLGLSAIYDFKLNDKFDKFKPYIGARVAYGHVKHQVHSVETKTTIYTTAPTGDATVGGTIPERPSSKPAYHESNSISSL

SEQ ID NO: 12394 - protein, 176 aa, Neisseria meningitidis
YAAERITHDYPKPTGTDKDKISTVSDYFRNIRAHSIHPRVSVGYDFGGWRIAADYARYRKWNNNKYSVNTKVLKETQDNWQELKTENQENGSFHAASSLGLSAIYDFKLNDKFDKFKPYIGARVAYGHVKHQVHSVETKTTIVTSKPKGKHLKGGPVPLQHSSQPPYHESNSIRRL

SEQ ID NO: 12395 - protein, 176 aa, Neisseria meningitidis
YAAERITHDYPKATGANNTSTVSDYFRNIRAHSIHPRVSVGYDFGGWRIAADYASYRKWNNNKYSVNTKELQRNKTHGNWIELKTENQENGSFHAASSLGLSAIYDFKLNDKFDKFKPYIGARVAYGHVKHQVHSVETTTETIFTTPTGGATVGGKIPSKSSSKPPYHQSHSISSL

SEQ ID NO: 12396 - protein, 165 aa, Neisseria meningitidis
YAAERITHDYPQATGANNTSTVSDYFRNIRAHSIHPRVSVGYDFGGWRIAADYASYRKWKESNYSKKVTEFKHENGNKKEDKTEHQGNGSFHAASSLGLSAIYDFKLNDKFKPYIGARVAYGHVKHQVHSVESKTTTVTSKGGGPIPQGPTPKPPYHESNSISSL

SEQ ID NO: 12397 - protein, 170 aa, Neisseria meningitidis
YAAERITHDYPEPTGADKDKISTVSDYFRNIRTHSIHPRVSVGYDFGDWRIAADYASYRKWNNNKYSVNIKKERETPHNRQDLKTENQENGTFHAVSSLGLSAIYDFKLNDKFDKFKPYIGARVAYGHVKHQVHSVETKTTIVTSKPNGGPVPSSVTKPPYHQSHSISSL

SEQ ID NO: 12398 - protein, 176 aa, Neisseria meningitidis
YAAERITHDYPKPTGTDKDKISTVSDYFRNIRAHSIHPRVSVGYDFGDWRIAADYASYRKWNNNKYSVNTKVLKENLGNRIELKTENQGNGSFHAASSLGLSAIYDFKLNDKFDKFKPYIGARVAYGHVKHQVHSVETTTETIFTAPTKGAKVGGKIPNTPSSKPPYYQSHSISSL

SEQ ID NO: 12399 - protein, 199 aa, Uncultured Wolbachia sp.
GPISDEETSYYVRLQYNGEILPLFTKVDGITYKKDSSDYSPLKASFIAGGGAFGYKMDDIRVDVEGVYPYLNKNDVTDAKFTPDTIAVSLTAISGLVNVYYDIVIEGMPITPYIGVGVGAAYISTPLKDAVNDQKSKFGFAGQVKAGVSYDVTPEVKLYAGARYFGSFGAHFDKDAAAGKDKGELKVLYSTVGAEAGVA

SEQ ID NO: 12400 - protein, 213 aa, Brucella sp. BO1
MRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGDAGYSWAKKSKDGLEVKQGFEGSLRARVGYDLNLVMPYLTAGIAGSQIKLNNGLDDESKFRVGWTAGAGLEAKLTDNILGRVEYRYTQYGNKNYDLAGTTVRNKLDTQDIRVGIGYKF

SEQ ID NO: 12401 - protein, 771 aa, Brucella sp. BO1
MKSVIAGANAGRRPVLKTLWLTSALIVPIVWLPSSAAAQGAKPAATELPAVEITAPQASRRQAQAPRDRSRSATGRSRRSAQRAAQAPQPAQPTQRAVFERGTDPVRGFVPSVSASGTKTDTRLIETPQSISVISRDNLDARGIDTVAQALQYTAGVAVQTFGGDPRYDQARIRGFETNGFSNFRDGLRDTANGSAYFSVFRNEPYGVERIDVVKGPSSVMYGQSPPGGLIDLISKRPTDQAFGEVVGLVGSADRLQGAFDVGGPVDKDKTVLYRLTGVLRDSDAQVAKFSDKIKDDRAYIAPAITWRPTNDTTLTFLSDYQHDVTGIASPVSVATVRGGKVVDMRPLPLYLGDPSYNTFDQTQYRIGYQFEHRFSDDLIVRSRARYGHVDLEYRSITLAGTPLDTQTVFARNARRVLENSDSFGTDNHVIAKTTTGPLQHTMLFGTDYQAFKLEGESFGGLAPSLDVLNPVYGQAVAMPTLRLQSYKQNLNQAGVYLQDQIKLQNWILTLGGRYDAAQQTILNRLTGVPQLNDDTAFTKRAGLTYLFDNGLAPYVSYSESFLPTGGVDFNSNAFKPTKGKQYEGGIKFQPNRDLLFTAAVFDLTQDNVLTADPNHLNYSIQTGQVNSRGLELEMLAKPVPGLNVLASYTLQNLKNTQSNNGDVGKMPVLIPRHMASAFADYTLQSGPLAGWGFGAGFRYIGESYMDILNTFTNDAYTVFDAGLHYRQPKGINLALNVKNIADKDNAMCTATGGCQYIAPRVITATASYRW

SEQ ID NO: 12402 - protein, 712 aa, Arthrospira maxima CS-328
MSKRQISGRRFPVLALSLCSIAGVASFPAPAAEFDDELPAVEVRSRRHPNDPRAESVSTATRTASDPRDVPQTIDSVPVEETLSYGGRTLADALAGVPGVSNTSDTRFDSFRIRGFSAAGDLLLDGMRDDAQYVRSLGNIERVEVLKGPAAALYGRGSGGGVINRITKQPLPENFGHVSAATGSYGRLGASIDLNRMLSSAWSVRLNAGREHAGSFRDHVDGTRQYVAPSIKWRDARRSWLLQFEYDAYRRVPDRGMPAPVAALDAAGKPVTFSLPSAPRATFFGAAGRDTIRDENMNWRSVFTHALDDDWELRHTLGVLNLRSTFDNTYVTQSYVAKPRDYRQVQRARYLQDMTHLNVQTGVELGGKVATGPAQHHLLFGIEYGWQKRTPTLWQADAAPIPVTGPDRFALVGSTPRPYAMNRHRVSDYAIFAQDRVDLGRAWKLLGGLRGERFDVDSTNALNGLHARRTTAAWSPRLGVVWSPVGAHSLYASYSKNFAPVGGDLIGITPDARGNANDLGPQYTRQYEIGVKSDWRGGALSTTLALFQLDLYNRRIADPVRPGFFDLTGLERNRGVELGVAGRLAGDWFVRGGIGWQQARVVDAEPKYAGKRSAGVSASNGSLFVSHAPLRGFFAELGMVYEGARYADRDNLLELPVYVRWDGKAGYRTRDLEVTLAAVNLTDRDYYANATGLAQIMPGAPRTFTLTATYKF

SEQ ID NO: 12403 - protein, 419 aa, Arthrospira maxima CS-328
MNGMSTNRTNPILIGMLAVFVSNIGHASALEQSGQSILPFLENGNYAEANFFAVDSSVSGIVNDRADLVRDHQSRDTGDIAESTQFYTAALKLQLTDQLSFGMLYDQPFSADIKYPARSNNSYFDNDVSHQGTFVKADTQNLSLLFGYSPYQHFQIYGGPVYQTVKANVALRGNAYTQAFNGYNAKFKQQGEVGWLLGGSYQLPDIALKAAITYRSKIKYQFQVEEDIFGEPLKLVENEKTQLETPASLNIDFQTGISEKSLVYMNLRWVNWKEFETRPPQYGALSEILMKELTNGEYIQGFKLDSYQNDQYSATLGIAHQFTEKWSTSTDVSWDSGTGNPASTMGPIKGSWSLGLGVQFNPAKNYFITGSLKYFWLGDTKTEDGTYYLPIEGIKPYAEQANFKNNHAIAYGLKFGYWF

SEQ ID NO: 12404 - protein, 144 aa, Arthrospira maxima CS-328
STDQLRGVRAGYRVTDLPIELPSWIGSPDVHLEAALNHWQDSNNTADNITAFTISPILSWHVAGAERPLYIEAGIGGSYFDKTRIADRHLSTQFQFEDRVSLSWQYSPSSEARVALGYTHYSNADIKRPNDGLDFLWMSWVLPF

SEQ ID NO: 12405 - protein, 1056 aa, Arthrospira maxima CS-328
MSKLTLGLVAALAAAPVFAQSTSAGVAGLVTSSGGQPVPNAEVTITHVESGTVSRATTDASGRYNARGLRVGGPYTITITASGAGNTTREGVYLNLDKVNQVDAALGSDLATLGTVQAIAGNYGSDIFSANKMGTGTNVTREEIESLPSINRNLQDYVRLDPRVAQTDKARNEISIAGQNPRYNAIRVDGISTNDAFGLESNSLPTPRQPFSMDVIDEISVDVANYDVTINGGTGGVINAVTKSGTNEFHGSVYGTYRDNDWSGKNQNGIRPQLFDNEATYGLTLGGPIVKDKLFFFANYEKYKGKGVFNGNSGFGPTGSGASNTVNISQAQVDEIVDISRNVYGFDPGTLALPALDSDSEEKGFKLDWNISDKHRGSFRYGKSEQSTANLNGFSTSSLALNSYHYVRDFELETYTAQLFSDWTEDFSTEAKVSYRDYSAIRTAASQLPAINVRVGANSVNLGTEANTQANELRTKTWNAFFAGNLFLNDHTVKFGFDYEDNDIFNLYGPRVFGSYSFESIAAYRANRPVSYRYSSSNTRNIDDIAANWGLRNLGLFVQDTWAVNSNLTLTFGLRYDKQLVPNSPQFNQTAFDAFGVRNDATIDGNDLWQPRFGFNYTFDADRPTQLRGGVGLFQGAAASVWLSNPFSNTGLAYTDYNFRNASQITRGNIRFTPDVNNQPTGTGGATQSVDFVDKDLGQPSVWKANLAFDAELPWHGIIGSLEGVVTRVNEAIYYQQLNLGAPTAVGQDGRQIYWNAVGRNRANWDNQGRVSGNALARANSDQRFNDAIIARPTSEGATQSFTVGLNKPFNDSDWSWSLAYTYSNAKEVSGLTSSTSGSQLLNTAAFQANEEVNATSAYEIKDSFLGTLQWKHNFFGDYATKLGLVYQGRSGRPYSYTFDNDANGDGRANDLLYIPKGRGDVLFGSAAEENAFWNYVNNDQYLSTHQGQLAGRNAVRNSWVNQFDLHIEQELPGFFDGNKAQIWLDVMNVGNFLNKNWGRVDEYAFPGFKRVVEYGGIDAATGKYVYRFNEPAQSTVYDDKGISRWALQLGFRYQF

SEQ ID NO: 12406 - protein, 746 aa, Arthrospira maxima CS-328
MASKPMTCAFALALSCTVSPMALAQEASATQTASQAAKTHETNADIVVTAQRREQSLLDVPLAVTALGSDSLAQRGITNSAQLGDAVPNLQINSPYGNTQPNFSLRGIGVANEYNSNQASPVGVYLDDVYLAPRTSHGMGLFDLDRIEVLRGPQGTLFGRNTTGGAINFITKKPDLSGTNGYLQAGYANFDTFTAQGAAEATVSEDKLGLRVAVNYAKGDGQVKNVFPGGRDAMSTDTLQGRVSMRAMPSEALAITLRAYAGRDRGTQAAVHGLGPFRTGLGFFEINENRVGTNRTDAWGFSANVALELSDTLSLTSITSYDGGSQNLQQAADGSPLDILDINWRSQYRQFSEELRANYSGNGVNFVGGLFYGWDRNITDNTFNLPLPPAGGFFQHYRQVRNSYAVFGQADIDVADKLVLTLGARYTHDTSRYDDAYAYLFVGEVGAAPFPIATTVPCTGVAGTCAYDPAARFALSDKNNALTGRVALSYTFDSGTLVYASYNRGYRAGAVNGGGYTSSAGIGYIKPERVNAYELGIKGRAGGRLLTYAASAFYYDYTNQQLQDTRAGPVSFLVNAPKSEVYGLELETTLRPVDGFRLDASVGLLHSKYKRLTLQGADLSGNSLPFAPRMTAQVGFEWDMLQVGGGTLSFAPNMAYSSRQYFSPFNAENAPGTAQVNSELQQGANAKVNATLSWSTDVITLRAFANNLFNRKTFGYGLDLRGAGFPYNFLVPSAPRTYGASIRYSF

SEQ ID NO: 12407 - protein, 334 aa, Burkholderia sp. H160
MKKTLLALSVSVAAMATGVNAAELYNQDGTSLEMGGRAEARLSMQDGDVADNSRIRLNFLGTQAINDNLYGVGFWEGEFTTNEQGGVDGSSNLDTRYAYAGLGGEFGEMTYGKNEGALGVITDFTDIMAYHGNSAADKLAAADRSDNMFSYKGQFENLAVKASYRFADRQETNGEFTDNGQDGYSLSAIYAVADTGLELGAGYADQSEANEYMLAASYTMSDLYFAGVFTDGEKEASNNSTVDYTGYELAGAYTLGQTVFTSTYNTAETNNETSANNFAVDASYYFKPNFRGYVSYNFNLIDAGDKLGSTVAGNSVATKADAEDELALGLRYDF

SEQ ID NO: 12408 - protein, 199 aa, Burkholderia sp. H160
MKKVGYAALASLIAGGAYAGGYVAPVVEQPVVAPAPVTITPESDWTGFYAGLQYGKGSGDLGNRGALADFGDYDGYGLHAGYQRDLGRFVLGGELDYNKISPDENYDDGDLTRLRLRAGADMGRFLPYVTLGAAKISVDDFSETGLTYGLGADFKVTERFTVGAEYSRSDFKDVLEDETGISGRDLDTDLVQLRASYRF

SEQ ID NO: 12409 - protein, 1520 aa, Burkholderia sp. H160
MSSEKDKKNSCSKFSLSVVAAILASMSGLSNCSDLYAVGSSADHPAYLIPQAGLLLDHIKDIFIGPKDSQDKGQYKLIIGEAGSFQDSNAETLPQKVEHSTLFSVTTPIIVQGIDQQDQVSSQGLVCNFSGDHSEEIFERESFLGIAFLGNGSKDGITLTDIKSSLSGAALYSSDDLIFERIKGDIELSSCSSLERGGACSAQSILIHDCQGLTVKHCAAGVNVEGVSASDHLGFGGGAFSTTSSLSGEKSLYMPAGDIVVATCDGPVCFEGNSAQLANGGAIAASGKVLFVANEKKISFTDNQALSGGAISASSSISFQNCAELVFKSNLAKGVKDKCSLGGGALASLESVVLKDNLGITYEKNQSYSEGGAIFGKDCEIFENRGPVVFRDNTAALGGGAILAQQTVAICGNKSGISFEGSKSSFGGAIACGNFSSENNSSALGSIDISNNLGDISFLRTLCTTSDLGQTDYQGGGALFAENISLSENAGAITFKDNIVKTFASNGKMLGGGAILASGNVLISKNSGEISFVGNARAPQAIPTRSSDELSFGAQLTQTTSGCSGGGALFGKEVAIVQNATVVFEQNRLQCGEQETHGGGGAVYGMESASIIGNSFVRFGNNYAVGNQISGGALLSKKVRLAENTRVDFSRNIATFCGGAVQVSDGSCELINNGYVLFRDNRGQTFGGAISCLKGDVIISGNKDRVEFRDNIVTRPYFEENEEKVETADINSDKQEAEERSLLENIEQSFITATNQTFFLEEEKLPSEAFISAEELSKRRECAGGAIFAKRVYITDNKEPILFSHNFSDVYGGAIFTGSLQETDKQDVVTPEVVISGNDGDVIFSGNAAKHDKHLPDTGGGAICTQNLTISQNNGNVLFLNNFACSGGAVRIEDHGEVLLEAFGGDIIFNGNSSFRAQGSDAIYFAGKDSRIKALNATEGHAIVFQDALVFENIEERKSSGLLVINSQENEGYTGSVRFLGSESKVPQWIHVQQGGLELLHGAILCSYGVKQDPRAKIVLSAGSKLKILDSEQENNAEIGDLEDSVNSEKTPSLWIGKNAQAKVPLVDIHTISIDLASFSSKAQETPEEAPQVIVPKGSCVHSGELSLELVNTTGKGYENHALLKNDTQVSLMSFKEENDGSLEDLSKLSVSDLRIKVSTPDIVEETYGHMGDWSEATIQDGALVINWHPTGYKLDPQKAGSLVFNALWEEEAVLSTLKNARIAHNLTIQRMEFDYSTNAWGLAFSSFRELSSEKLVSVDGYRGSYIGASAGIDTQLMEDFVLGISTASFFGKMHSQNFDAEISRHGFVGSVYTGFLAGAWFFKGQYSLGETHNDMTTRYGVLGESNATWKSRGVLADALVEYRSLVGPARPKFYALHFNPYVEVSYASAKFPSFVEQGGEARAFEETSLTNITVPFGMKFELSFTKGQFSETNSLGIGCAWEMYRKVEGRSVELLEAGFDWEGSPIDLPKQELRVALENNTEWSSYFSTALGVTAFCGGFSSMDNKLGYEANAGMRLIF

SEQ ID NO: 12410 - protein, 825 aa, Burkholderia sp. H160
MSVQKHTFHFKRKRLVLNKITQSLFISLIGCAGYSSLVYAESTSATSGAVVKEVITSNSQLNNKADDVIQLADVIVTTRRREEKAQNVPTPISILSAKTLETQKLSKLEDLQQALPSLNVAFLNPRQSSVAVRGLGNNPASDGLEASVGVYLDNVYLGRPGMAVFDLLDIAQLELLRGPQGTLFGKNTTAGLLNISSKQPTFDPDHSAEISFGSRNYLQAKGTFSDALSENVAGRLSFYKTTQDGFIHNTYNNNDYNNTDREGVRGQILWKPQENFNLRLIADYNKQDDNQGAMVLYYAGPTFNSTVYGNNYNRYLENATQSGAKNLYTNWKDKQIHSDAPQHMSVEQGGGSAEANWSLDSGKKITSISAYRFWNFTPTNSDFISSNALTNAGVSVRDKQYSQELRLTSAGNQKVDWVTGLYYFQQQLDNTTFSLYGDTADAFYLYNVPSVRTLIANGQSNILNNRDSYSYGTTETKSSALFGQSTWHATPKLDITTGARVTYEDKSASIYRIDPIGGTSVSGLSVAERNLLNAQLGAYDSGELKQHGLSYSGLLTGSYRVNPSTLAYATYSHGEKSGGFNLSIGSAPTAGANSLKVDPEKADNYEIGLKQNFLNNTLQLNSNIFWIDVSDYQTTSYEQVGSSVVSVLANAGKVRSRGIELDATYQPIRRLTLNFNGSLNDTTYTEYKNAPAPSNISIPTGVNTQDLSGERVYGVPKWVANFNFRYDLAEHNNWQPYVSGSYAWRDWSYGSLDNNPYSVIKAYGLTNASLGARHRIGENELDVALWVKNLTNETYVTNTWNSSNGIVLASLGQPRTIGATLKLSF

SEQ ID NO: 12411 - protein, 1143 aa, Burkholderia sp. H160
MKLTTVLLIAIVMQVSAGSYAQKISLSESNTSIQKVFDKIRAQSGYDFLFSRAALKNARPVSISVRNTELKQVLDQVFQGQPLEYTIIKKSVVVSVRETSVVDRVLNLFSATDIKGQVLDENGRPVNRASVKVKSTGKVVVTDDFGRFTINVPDDNAILVVSYVGYITKEVPVTSSLVIVLDLNQNKLEEMVVVGYGSAKRKDLTGSVASVDVNEIRNVPFATIDQALSGKAAGVQVVQADGSPGGVAKIRIRGGTSLLGGNDPLYIIDGVQMQIQNRYIQSAAEVVSPVESFGLDGGDNTISGSFARGLNSLGGLNINDIESIDILKDASATAIYGSRAANGVVIITTKKGRFNQKASLDANYYIGQSSPVKEKLLNRDQYIMILKEAAQNLNDVRAAYTPPRAPTALANSILNDPNYFGTANTDWLDLVLRNGITQNADLSLRGGGAGSRYYTSVTYNKNNGVVKGTDYTRLAGKLSLDNDINSKLRFNTNLDYGYTTNNITNGIYTQALFAPPTIEPYNADGSVRTISSAENGSYGFEGFQNPLALLTAINRANSFTLIGSLAGEYDILKELKFRSSVAVNYNNYRQTNYQPSTALISASFGTQLLNGIATQAQSQESNIFYENTLTWTKEFNENHRINVLGGTSWQISRSSSFSASGQGFPDDVYLNNLSSAATTLPATGLSAQNSLLSFYARANYSLFDKYIFTFTGRSDASSKFPAKNRVGYFPSGGVAWRISQENFLKDVKWINEIKLRASTGRTGTQNIGDNLFYTLYSPVSYAGLNGLSPNQLGNDQIKWESTLQKDAGIEFQLLNSRLHGEFGYYEKSTSGILFPATVASSSGFTGVTANLADINNRGLELQIGGDFIRHKNWQWSGTLNVSGNRSKVKELSNDFADPTNPKVYNYGSTVLKVGEPVGLFYGFTNDGLIRTQQELDEYKASFPTWASYYPYLGIGDSKYVIDPQLRFMKSEVIGHAEPKYYGGYTNNISYKNFTLTTLATFSYGGQISYVADIQNADLSQRTNKGVRILDRWTPDNMDASRPRLVLGQGFSYGTASSQNIYDASFIRLKSVTLNYQLSKDLLNRLKMNQASLYVSATNLFTVTNYPGADPETSNNPYSLIGGYSDSAGYPTVRQLSFGVRLGF

SEQ ID NO: 12412 - protein, 475 aa, Burkholderia sp. H160
MNTALAQQIANEGGVEAWMIAQQHKSLLRFLTCGSVDDGKSTLIGRLLHDTRQIYEDQLSSLHNDSKRHGTQGEKLDLALLVDGLQAEREQGITIDVAYRYFSTEKRKFIIADTPGHEQYTRNMATGASTCELAILLIDARKGVLDQTRRHSFISTLLGIKHLVVAINKMDLVDYSEETFTRIREDYLTFAGQLPGNLDIRFVPLSALEGDNVASQSESMPWYSGPTLLEVLETVEIQRVVDAQPMRFPVQYVNRPNLDFRGYAGTLASGRVEVGQRVKVLPSGVESNVARIVTFDGDREEAFAGEAITLVLTDEIDISRGDLLLAADEALPAVQSASVDVVWMAEQPLSPGQSYDIKIAGKKTRARVDGIRYQVDINNLTQREVENLPLNGIGLVDLTFDEPLVLDRYQQNPVTGGLIFIDRLSNVTVGAGMVHEPVSQATAAPSEFSAFELELNALVRRHFPHWGARDLLGDK

SEQ ID NO: 12413 - protein, 825 aa, Burkholderia sp. H160
MKLQALWLFVMLISASWTAAQDCTYIIEGTVKDYHDNSSLELATIYIENLQRTVSTDVNGYFIIKGLCTGTYNLSIAHIDCEPKKITVNLTSSQKIEVLLEHHVEDLQTIQVIADVHDDHTNTQATTRIKKETLQNYSGATLGDALTSVAGVNSLKTGNSVVKPVVHGLYGSRVAIVNDGIRQQDQEWGIEHAPNIDVNTASNIQVIKGASALRYGGDAIGGTIVIEPARVISKDTLSGSLISQLQTNGRGGSITGSINNYRKSGWYQQATVTYKRLGDYDAPDYVLSNTGSETTAFNLGFGYKTFEYGANLKYSYYETSLGILRASHIGNAADLVRSINSGTPTVVNDFTYDIDVPRQEVAHHSLRLSAFKRFAGLGKLEADYSLQFNNRKEYDIRRGSNAGRASLDMDLTTHIAAVNMLFDSNNKTIINAGIDAMYQVNTPDANTGVRRLIPDYDATKVGAYISLNHQLRDNWILDAGLRLDSYKIDADKFYFQTRWESLGYDEQFPQFEIRTEGNQLLTNPVLDYGLYAFTVGTKYFFNDHYDIAVNLSSANRAPNPSELFSDGLHHALATIELGRLDLEKEQSYKLNSTFHINHGKLDLELNPYVNFVKDFIQLVPTSIETTTRGAFPVYQYEQLDARLLGIDVSASYDVFAKKEAEVTEEGGLNLNQQRLLNFNSKFSYIHGTDVDADMALIDMPPAQFNNTVTWFNAINTGLDFHLTNQTTLEQTRFPDNDYEVNVPLETGGFEMREVNISQPPSAYSLWDAGVSYSFFSKKNPKIKKSILRLSIHNIFNTNYRNYLNRQRFYADDIGRDIQLQFICNI

SEQ ID NO: 12414 - protein, 742 aa, Burkholderia sp. H160
MIALPLHMGFAQNSISGTVTSTEQKEPLEQVALYFPELEKGTTTDSAGYFIFRSIPNGDFELIISSIGFETQSIHVNLNNQEEKTLNISMLPSAIEMEEVIVSTPFHKLQSENVMKVERANLKELKSNGAITLSDGITKIAGVETISTGVGIGKPVIRGLSANRVLVYSQGIRMENQQYGDEHGLGLNEAGIDNVEVIKGPASLLYGSDAMGGVLYFNPEKFALPNETKGDVNMNYYTNTEGVGINAGLATSSEHFKFLVRGGHTSHVDYKTGDGSRLTNSRFRENDLKTGVGYQTTNVTSELRYNLNYSKLGIPEEMGTQTKTRTLAMPFQEISNHMLSSKSKFFLENSLIETTIGYTFNKRKEFEEHHHEEEEEEEEEGHEEEGPALHMNLSTLSYSIQYHLPKWDNLETIVGIQGMNQKNENFGEEMLIPDASTNDIGVLLTSHIHFKDESGLQLGLRYDRRNLDTEATGDGAFENLNLDFNSFNAAIGYKFNVLEHVISRVNFATGFRAPNLAELTSNGTHEGTNRYELGNSDLTHEKNIQTDISLEYSNEHVEFFINGFYNSINDYIFIQPNGTVLEEEDVFEYTQENAELYGGEMGFHIHPHPLDWLHYESSFEMVVGKKKTGDNLPLIPANSLSNTLRFESNSSTTRVKNKYAFITLKSVFDQNKTGEFESATDGYSLLNIGFGGNFSINKTLCEVRLSGNNILDKSYVSHLSRLKVDGINNIGRNISLGVTVNL

SEQ ID NO: 12415 - protein, 920 aa, Burkholderia sp. H160
MLNHKRTALSIAMAVAMAPTLAAAQTAAPSDAPASTQQNAGAVTELDKVQVTGLRRAIEGAISVKRDSTSIVEAISAEDIGRLPDVSIAESLARLPGLAAQRVAGRAQVISVRGLSPDFSTTLLNGREVVSTGDNRSVEFDQYPSELVSGVTVYKTPDAGLVGQGLSGTVDMQTARPLSYNERVIAIGGRYQRNSLGKAANVDPYGNRFNVSYIDQFADRTIGLTIGYAHTDMPIQENQVGLYEPWQQVNAQRQRPGVADGVYFSDGIKALRRTGNQKRDGVMATLQYRPSNAWTSTLDAFHTEAEQIDTANQFELNLSNYNGGYTPGLNITDVRVNDRNTFLGGNASGVYPLVRGMYNKREDKIDAFGWNNEITAGAVKIIADLNYSKATRDELNLENNLQLAPMPQLDTVGVAVNGNGFSQLSPGLNYSNPDALFLTNTIYGSGYGKVPRVEDVLKGARLQASFPMPEALSWFSDLDVGVNYAHREKQKTQPEGNITLGAQGEATVAADLQYAPVNLGFAGIGALPAWNVPATVSRYMLFNPSDDASFLVSKAWTVEEKITTAWLRANLDTEWGVVGVRGNIGVQLQSADQSSQANYWDASQPVGSEVRPIDDGKTYRDWLPSLNLAFQFPYEQTLRFALAKQVARPRVDQLRASLEFGVDTSTGRPGASGGNPMLDPWRANALDISYERYFADRAYIAAAFFYKDLKSYIYTQSRDNYDFSALVAGYVPPPGSAPVLTTGTFSAPFNGKGGTLRGLELTASLPLDLVFAPLEGFGIQASATFNDSDVQIRDPESASSVGDGAISLPGLSKRVYNLTAYYEHKGFEARVSQRRRSDFIGEIGNFNGNRTLRYVVGENITDAQISYNFADTSSLAGLTLLLQASNLSNSPYRTYAETKDRPLEYIEWGRTFVLGVNYKF

SEQ ID NO: 12416 - protein, 741 aa, Burkholderia sp. H160
MKKIALLVLLLAVSEMASGTEIPLNSSANGASEVSATEITVTGKKGDILQRVTGKESELLNPSQMSVYKAINLMPSLSQQSVDPYGLADIVNYHESFRFRGVEATSGGVPATTVNVEALPLTGRPGGGATIYDLENFSNINIYTGVMPANAGLGLADVGGKINMEIRRPEESFGVLLKQGIGSQNFYRTFMRIDSGSLPGKVKSFISFSDSAADKWKGEGNSERTNVMAGVTKEFSDNVKLETFVTYSKGDIHAYKPLSYAQLCNPESAYTNDYGTNPDSYDYYGYNRNKFEDWMVMANLEVKTGEHSKLNVKPYYWSDKGYYLETITLANSQNRIRRWDIDHDLKGVLAEYTTRLSDIDLDFGYLYHTQVRPGPPTSWKNYKVVNGKLVFDQWNILSNSSSHELHSPFLEATYRFGAYKLEGGVKYINYTLPSIITCNTTGVGDLSYDAALASDPAINTKASALDTKSFSRLFPNLTLTRTVGDNATIHAAYGENYVTHVDIYPYYISQFSSFDSKGITFQQLWSEREMETSKNVELGMNVQGSNWSIAPTIYYALHKNKQAVLYDPALNAIYPMNNADARGYGFELEAEYKPVDNLSCYGSFSWNRFSFSQEINSDAPGGGIIKVKGEQVPDAPEFLAKGMVSYKTGNLTISPIVRYTSVRYGDVLHKEKIDGTTLFDLDLTWSRKMPGFKQVDCSLSFLNIFDKQYVSMISTSDYKTLKTSYQSGAPFTMLATVAFHY

SEQ ID NO: 12417 - protein, 791 aa, Burkholderia sp. H160
MNKQSNLQSANARKINSYKALLAGTAVLAVVSPAAAQEAASEDPGEIVVTATRQSETISKVPLSIAAYSQEKLDQQGVRRVDDVARLTPGVTFSRGDQRNAGAANISIRGISSAAGSSTTGIYIDDTPIQIRNVGFSAFTPFPAVFDLQRVEVLRGPQGTLFGAGSEGGTVRFITPSPDFDEMKFYARSELATTKSGEASFEAGAAISVPLVKDKLAARVSGYYRRDGGYIDRVDYTSGNVLDKNSNWQDTKVASASLAWKATDAVTVTPSVYFQETWNNDAGTYWEVLSDAGKGQFNNGNAVANWNRDRFVLPALKIEAELGDVSLISNTSYFYRDQKAQNDYTVFEAALWTGNPFYPAGMYAPAFQYNRQSNFTQELRLQSNNPDSPLRWVIGGFYAHNRQTARQFVQDTFLPDLFESVTGVPFVAVFGQGLVDDKYTFVLDKAASTDEQIAGFGQVDYNLTEQFKLTAGLRVAHTKFSTSAQFVGPVVGPDVDDTGKQSETPVTPKFGLSWQANEDNLVYATASKGFRIGGYNPAVGLPCGVSSSPVAGTALGNLGLSDRPQQFGSDSVWSYEIGSKNKLFGRALTLESSAFLIDWSNIQQQVQLNACGFNFTQNLGKARSKGFDVQFQLKAAAGLTLGGSIGYTKAEFTQTVKGGPAATLNLVTKGDDIPLNPWQIVLNAQYDFAVGGKDAYVRADFQHLSRQNADTPARNPANGVADLTIPGVAEVNNLNLRAGVRFDLVELAVFANNVTDATPLLLRQHDVGFSTLYRNATLRPRTIGLTATVRY

SEQ ID NO: 12418 - protein, 402 aa, Burkholderia sp. H160
MKKTLVASALAAVIFVPTASAIEIYKDDKNAVEIGGYVDARIINTQGETEVVNGASRINFGFTREMSDGWKAFTKLEWGVNPFGNSEIVYSSESNFESKSGDFLNNRLGYVGLGHDTYGTLTIGKQWGAWYDVVYNTNYGFVWDGNASGTYTYNKADGAVNGTGRGDKVVQYRNSFGDVSFALQAQLKNDTFYTCESISGLGTDCEQRWNDGDESQEVDYGYTYGGAITYQATDMLTLTAGINRGEFDVRFHTGEQITATDLIYGVGATWGSFDQDGFYAAANFNKNENHDTDNLGRLIKDSYGIESLFSYKFENGLRPFISYNVLDAGSDYVIQPNNVDPNDVFKRQFVVAGLHYVWDSNTVLYVEARKDFSDFTSADKAQEARMSISEEDGVAIGIRYTL

SEQ ID NO: 12419 - protein, 731 aa, Burkholderia sp. H160
MKFAKRRNGRVTLGAHVLGSLTIGMAVSATPAMATEGQTQVVDKKVEHIEVNGEYLGYNTRKVQSGKFTEDLLNTAKTVTVINQDLIKDMGAQSFTDALRATPGITLGTGEGGNPYGDRPFIRGYDAQSSTFINGMRNVGSQSRETFNIEQIEVLKGPSSVYNGRGAVGGSINIVTKKAQSEDFINADVAVGTDSLKRASVDVNHVIADEAAVRINMMAHDADTPGRDEVTGNRWGVAPSVTFGLTTPTKVTLEYYHFENHDIPDYGIPYDQATGEPADVDPDNFYGLLSRDFRDTMDDTASVLISHDFNNDMQFTSTSIYSRNSNYYIVTNPDDTTGNVANGYVWRNTKSRHSVTKTLATQLQLSGEAKLAGMTNRFAVGTELSNERTSNLSYTVDTGNGRNAGCDQAMLDNYNCTLLDNPNPHDPWVGTITLGTDATVTETDTRSLYAFNTIELTEAWMVNAGIRWDDYSTSAENSTSQFSNDTDFFNYQLSVLYKPAENGSIYAAWGTSSNPPGTSNGDGADRLGSTNADLEPEDTESYELGTKWDFFAGRLSLNGSVFQIEKNNARVATSGDRNSPQENVGEQKVKGFELGFSGDFTEHWHGFGGYTYLDATLESNGYNQAQNGNRFPNTAKNSLSLFTTYDVTEDFTVGTGAYYMGKVYGNTANTLSIPSYWRFDLTSSYKMSQFLTLRLNVQNLTDERYYDKAYTAHFANMAPGRLVMLSADMHF

SEQ ID NO: 12420 - protein, 677 aa, Burkholderia sp. H160
MKHRSTPLIAALATLGLATPTFAQTESLDNFVVSATREARDPFEVAASVDKINQNTLEKAASFQVNLSETLTRVPGLVINNRNNFAQDLQISIRGFGARATSGVRGVRLFSDGIPATMPDGSGQISHFSLSSTESIEVLRGPFSSLYGNSSGGVILLTTENPRVGTELEVNQIFGTDSTRRSGIKLNKGNEEVGIVIDASTFRTDGYRDHSKARRDNFNSKMVWNLSSDTRLSWVLNYVDIPLAQDPAGLTAAQLASNRRQAGNNTVANNTNKTVEQSQTGIVLEHKFSPSTNVTFSPYYGDRKIRQVLASTAVIDLKNEYSGADLRFAHQTSVLDRPLFLNAGLTVGELEQSRLGFFGASTTPNRDEANTASQFDQYLQAEYFFTDKFSVLGGVRNSSIEIESNDQFLSNGDGSGSKKYDEITSNLGFTYRLQPNINTYISYGEGFETPTLLETAYLSVAPPSPNFNTQLDAAKSEQLEVGVKAKFGATKVNAALYTVDTENEIVVLAANGGATSFQNAGSTSREGAELALQHAFNTQWQANAAVNYIRATYDTSVNSIQAGNSLPSIPKKTFFGEVVYKPSNLYEAATELRYVDKLFANDANDAFAPSYSVVNLRASKDWPLDGGWNVRTYARVDNVFDKEYVGSVIVNQGAGQFFEPASERQFLLGVTVGLMWK

SEQ ID NO: 12421 - protein, 821 aa, Burkholderia sp. H160
MKLKVFSIFFFFSLLMNAQYSLSGKVTSSETGEPVPNAEIWNKSTGNLEVANNEGEFEISNLKEGSYIFAVFSYEFEIIETEITINKNTTTNFQLSPLAESLSEVLIINRKEQLFALRKLREVEGTAIYAGKKSEVVLLDKVSGNLAANNARQIYSQVVGLNIYDNGDAGLQLNIGGRGLDPNRTQNFNTRQNGYDISADVLGYPESYYTPPPEALREIQVIRGAASLQYGTQFGGLINFKFKEPVPDKKIELVSRQSVGSYDMFTTFNSLSGTVGKFSYYTYYNYKGGKGFRPNSEYDSHNAFAHLGWKFNDRTNISVEYTYLDYLAQQPGGLTDSQFYENPDFSNRERNWFDVNWNLFALKLKHELTDKTDLSLNVFGLNASRKALGFRQNRVALTDDLEEPRELLVDDFSNWGAEARMLTRYNLFNEESVLLLGSKYYQAFNEQQQGPGSTSFEPDFNFASEYFPNYERQSQFEFPNKNLAFFGENIFKLTNNFSITPGFRFEYINTESDGFYKNIINDNAQNTLLNETVEDDRKFERSFILLGVGSSYNLNASNELYANLSQNYRSVTFNDIRVVNPSFQVDPNINDEEGFTSDIGIRGRLKDFLSYDASIFALRYNDRIGETLKPEERVNASGQLEETGRLVRFRGNIGDAFIYGLETFADWNLRNSFFSSAEDYKLNVFVNAAFTKSEYISSEEVNVEGNEVEFIPAVNLKTGLNFGYKNFLTGLQYTYLGRQYTDATNAPQVKTENNRGIEGAVPAYGILDFSASYSLGKFKLEAGVNNLLDNSYFTRRATGYPGPGIIPAQPITWYTTLQVKL

SEQ ID NO: 12422 - protein, 493 aa, Burkholderia sp. H160
MKMKNFSKTLIASLVAFSSAGASAAAFQLAEISTSGLGRAYAGNAAVADNASVVATNPALMTLFKQTEISAGGIFVDADVNIDGKLNATGADASHKNVIPTAIVPNAYIVSPINERLSIGGGVNVNYGLISEFDPNYSAGFLGGRTSLSAVNVNFSAAYDLGYGFVLGAGLNAVHAKAELGRFLGAGAARFAPAKQFLEDKKVQVQSAIQGLKALEAGIAAGNTALEAQKTQVLAQVNGLLKSQNLNQTITNSAQLERLVNGIQNTNASSTIHKLKGDKWALGWNVGLVYNINERNRLGFTYHSEIDLKFKGKYSNTVPVVIPKMVDTITGGAEIDGTLRLRLPAFWEVSGYHKLTDKLAAQYSYKRTDWSKFQSLEAYDMQGNRLLHKTENFNDSQRIALGLSYDVNEMLTLRTGVAFDESASVTHPSISIPDTDRAWYSVGATVRFTPNLSADVGYSHLRGSNLTFSEDGLATFKSKARANLYGLNVNYKF

SEQ ID NO: 12423 - protein, 797 aa, Burkholderia sp. H160
MKDRQTMWTSARNRIVRRYPPPASGQPAFRQGARTVTLSLTLSPVVAGLVFGLGAASAADRPQAETEAGTKTETKAGTRTAPKTAPKAGTRAAATPRKGPAQDAAKAKGERILVTGRKSPTVASSGTKTDTPLVDTPQSVTVIDRHEMDIRGVLSLSQAVRYTAGITPDQRGSTATRYDLFALRGFTIPNFLDGLKLQDSPTGYATAQIDTSRLDRIEILKGPASALYGQSSPGGLVAMSSKLPTSATSYGSLVATGGSFDLYRVDGDVGGALTGNGFVRYRLYGTANGSHSQLSQTQSRRYSISPAVTFGGDGDTTLTLLGNVQDDPQNASYGSVPLEGSLKRAAFGYIRQNFYDGDPNFEEFNRRQWATTYIFNHRFNADWAFSSRGRHDDVKTVYESVYSEGVYLDPDYERDYAQEALGNFSRGTAYAREHLRNLAFDNQLTGHFSTGPLRHALMLGFDYQESEATELDGFGSAPSINVLHPVYRQQITPPAISNNYLTDQHQIGVYAQDQVDLGNLHLTGSLRNDWYRSHQQDTIGGSYSSQNPEMITWRAAGLYHFKFGLAPYISYSTSFQPQSGVVSSNGGQSTRQADPTVGKQLEGGFKYQIPGLPILLTAAGFHIEQTNVLVAVPNSNYSTESGKVRSDGFEFEAHVNVYKGLTVVATANTQKVRDLSTGKPLIQVGKGGETLFGYYTMPSGRLKGLGFGGGLRHVDSAFGGTASYGDITVPSYTLFDASASYDLANLGHAFIGWKVQASVRNLFNKRYVASCYGYAPYDEWCWYGERRTAQASLGFSW

SEQ ID NO: 12424 - protein, 145 aa, Burkholderia sp. H160
KADNMTVYPLIARVGFNMNRLLGIEGAKSTLQLALEPQVNLISGPQDGVEAGCGIGLRYFRKLASPVDLFFEASFAPMFLSVDSIEQGKAGFNFLDHFGSGLQYRISDKTAVFGGYRWRHISHAGLVDRSNMGINSNAIIAGVSW

SEQ ID NO: 12425 - protein, 1010 aa, Burkholderia sp. H160
MKVKAIVAIQIATGLSMGIISISAYSSLREQVGNIQVQDKTDTIKLRDQKGSDDQYDRDESNIYISKEAVERYKGTNPADVLNHGVGVYSGDARNSGALDPNVRGIQGQGRVPVTVDGTEQAITVWRGYNGANNRNYVDPNMISSITVVKSPMLDRDIRTSVGGGVAVKTLSIDDVVPSDERFAIDLKLETRTNSTKPRINEFTLGTDYRDDSAIKDSLASKENYRTRIYYRDPKASVEPDQPGNSNFFNLKDSAVRVALGLRQEKFNLLFAYSHRNQGNYLAGRHGADYFREPIITTDIDNSKKMVDPNIPFVADVYLPTKEVGNTSSNSETFLQKMNLQLSESQKISLGYVHTKSHYGEIMPSQIRFHDLAGEIPQWPLANISLGSFYANYGFKSEKQSLLDLQLGYWLTKTDLNSNTAGGLPREAIELDWSVNSLSRKNPNIDGTLVDGIKLNQINNRQGLTLSNKSQFTPNFDMTLIGNFIREEINSNDDIYALDAIVAKKNTFRAIPREGKRQEFSGAIKLDWRPTNWLNVNAGIQYQNYWSRDLLRERRLKAKDHNFAVYQIPQAMNFEYSRPFTEEEARKVREYVDSKGRTFDGYNDIGFWPDSSIGTSKIEWFVAEALSLPAYSLKSAEHYYTVKEEYEGFRIIGSEYIKWRVDEDGKFTTENNPFYDGGIDLSEEVIDPISQKKVKAIIAYRAPHKELEHILVNENEKYKNPGKRINSAWSPSIGGSVYLSDNDRVFARYAETVRMPSIFEDTIGFSGAGDGVIRTRSFKPERSHTFEIGYVRNLQSWLNAENAADFRINYYHNIIDNAFDRDGNLVFSQMDQHRTAGLEVLARYDNGHFFGDLGIDYRLKNEVCDNASMARLDPLNKFNASVCTEGGFPLGYLRTQLQPKYSIHTNVGMRFFNESLEVGGRVRYHAKTENKDEANMIRRFGPSYAPLNNNPMSWNAVFVTDAYVTYQVNKNLLVELLASNVLNEYYIDPLTRSMMPAPGRSLRLSVTSHF

SEQ ID NO: 12426 - protein, 426 aa, Burkholderia sp. H160
MKKTPWWVGVCLCPLFSQVVHAEFIADSKAELTLRNFYFDRDYKKDPYPYTAARDWAQGLIFKGQSGYTEGTVGFGVDVLAMAGFNLMGSRADDYARSGLLPVNTDNSRDDYYGKIGITGKAKFRKNELFVGDLVPQLPTIFSSPARLFPQTYRGIRFVSNEIPNLQLEGFYVDEVRQRDSIRYTDVGTDNINHRFNKAATTDSFYTLGGSYQLKDYRLRAYHAELKDIYQQQFLGFNGKQPLNDQLNFLSDVRFFNSEETGSKKIGEVDNRHISGLFGLNYQNHTVSLGYMQSFGSTGLPFLSGTESPVVLDFMSSDYSNKDEKVYSIRYEYDFKNARIGDVSLNGLRFMTRYAKGEDIDLLQYGDQRFKEDSLEFDLGYKIPEGKLKGLGMRARFSHYRNDMPTNMTFHSANETRLNVDYTFKF

SEQ ID NO: 12427 - protein, 1753 aa, Burkholderia sp. H160
MNHSFRSIWSETTGCWVAVAETARARGKRSGSSSGTRHRAAHAATHRTSLRIVAFGALLAALSAGSAHASTCGGGTAVANGGTCAPGSFSPTVNDNLAGSATVSGGDTVGVSGAWTGAGGDPGYTLTPIGSTTIVSGNPNQPLLSLGGKTHSVSTPDSITGTRTSVATYDSSAFSASTAGATEVPVYHDVNGNQYVNTRIGTVTATGGTLNVSIGNAANAPDAAGNAISMAAKGTDLTFADGTGATTSTVNWNSRNQIQFTTGDYLANGGAIGSRQLDVPAYAGTFTAFDGSTWKVTDATSLAAYNDFLVRSVQSGALGSQAAYDSAFSQAVTFSQQTFQYQNNVSSGDKNTLPIDFLSAMHGTGANATLQIGKDGQIDFRGTNTIVSSSAVLAENGAHFINDGRLSGDFTLVRLLSGASGVNNGVISSGYASGDDFDTSGSTPPNNFDFHAYTEGNGVFANGAGTSFVNNGVMNVGAWTLDGNQPNLQNYAVAVTGGATASNAGTINVGVNATTLDSQVIGGLVAGGSFTNEAGGTIYLGRSAQYAPGGTANDVALAAHAYGILLGDSGTARNLGTIVIGSQTQNGAAMASIGSTSGTLTNAGTIVVNGAASGTPLANVGMLAANTAATVTNTGTITLNGVNGIGIMVVGTGAQATSALSSGTINVAGGLDPASGTRNYGVWAEGPSATATLNGALNLTGTGAIGVHARSGATINVGANAVPAFMSGTSQIGFYAYGAGSKINVAAQHLSVDTDDSTLFRVAGGAAYTGTSTAGALTTDVNGQRAHGVLATDAGTVLSTGNAIYNVNGANGIAIAVEGGAQGTIDAGATINLNAAGAIAGVVDGQAHDLTGANAGAPVATTLTNHAAVTSSTAGVTGFVAQNLGTLENRETVLLTGAGSTGVVIGTLGTASNASTIRVSDGTGALVQGASATLTNTGSIEADDGIAGVHLTGAGASVALSGAGTVIANGSADGVLIDSTVTGGGLAAGATSIAVGGSGKGIDNQGTNATIALSGTQIGTTGAGADGLSSTGAGARIAADAATVVRTTGDNARGFFVSGADSTLAANGTTVATTGAGSAAIVTTGGATALLSGTKITTSGTTADGLVAQNGGRIGDTGSTIASAAGNGATADSGGVLALTGTTLKGATAGVLTSDTLANGATSSVLVDGGSVTSATGPAFAARGGTADIAVRNGTVVTAGNGTLLDLSNGNHATFTASAVNLAGDIVSDASSTGNVFLANGTTLTGKIDPVALTIDNTSTWRMTGSSVLSSLNNAGLVAFAAPTGSPTLASSYKTLTTGSYVGNGGTIALNTFLGADASPTDRVIVNGGAASGTTGLKIANTAGTGAQTKGDGIPVVVTANGGTTTASAFQLAGPVQAGAYEYRLYRGGQSDANGWYLRSQLDPSDPGDPIHPSGGGDGGGNGNGNGGTLAYRPGVSGYALTPLLNADYGFSTLGKLHERVGDIYNLEKQQPGNRDGVWGRIGGQSLDANAGRFAADERTFFAQLGKDWTLDQAPNGGGSTHAGVTASIGVSNASFSDMARADTANLSTSTGSVEMHAQSLGGYWTKYLSDGTYFDSVGQVTHYGNRYRDSYGNEASQNGFGIALSQEVGKPFAIGALPVAVEPQAQLMYQYLKLNGFNDNVSAVSGTTTNALRGRVGVRIFRPNLQSDSGGGAATPYFTADVLHDFLSPGQTVVGGTPFATHLGRTWYELGVGVTAGFGKSGELYANAKIARNIGGDYRRGIVGQVGYRYSW

SEQ ID NO: 12428 - protein, 364 aa, Burkholderia sp. H160
MVNCCCRNIEKLPMKTLKTLIAVTISLCSYNAYADDNGDLETRIAKLENNASPSQFKNSQVSLYGSIRPTLSYLDNGQENSWDVRDALSRVGIMASTEFADGWSAIAHGEWSVDIANSGNFGKARQAYAAIASPYGQVGIGKQRPAQYTLVAEYVDIFNHGNSPYAYDYDNPFFVDNFVTYKLVTGGFTWMAGAQVDGDSGESGTDIVNVGVGYDLQRLHIGLGYISQNTLDSNDIEGDNQTLGGVVAYTFSNDLYLAASYQEKQYNYDAGSMNKDRSGSTLDTALAYPFSDDYTVKLGYFMFKDGIDDNTSADYNGFNTTLEWNPVANVRVHLEYLDKNFDNREDDRAVTIGFKYDFNLTWRD

SEQ ID NO: 12429 - protein, 696 aa, Burkholderia sp. H160
MKRLSTFFISLTIAMMVLSTVGSALADDSVVLDPVKITESVPVTETLAEPKKVVVVTEQPVQPVSLTEALDKEFFVEFQKSGEYSSEPYIRGRGTKGVPVYLEGMRLNSGHSDSTNLFNLIDVETVEVYRGPSGATLGMGAMSGAVVVKFSDPEFADSAAFVTSGFFKAKTSMFSTSGYSAALGGRAYNDRFNIAVSGGLSDYDDYEDGEGDDVEHSQYETSNYNVSMAVKITDDSHVYVRYMKDKADSEDPFSRYQNNGVWFYTDRPNDDGETLFIGYKDAELGGLQNVHLQLFGSDLHYDMDMKKEAAIPEVRELFRDSETRGGKLSAQKELGNHLLSFSGKYTKMEVTNGVRMFNGATQSWSDWVSAFGITDGEISSTMVNVADDMVYGKAFFNVAAGYEFVRRKVHSNVNSTALSGLVPSELLDQVQQKDTDERDHLLSVSATAGYEFCSAFVPYVKLSNASRTPYFNESYGNNPNNGSMVPNQDLDNESVWGVDVGFDGRIGGLYYTSALYYQDYTDYIELVQTGYQTTAGLPIKRYVNLDDATVYGAEALLGYDFGADLFVEAAYLYTYGKNEMDDQPLAYIAPQKLTLTIGQQRKTGLSWFIEEVMVDEQDRISTVNGEVETPGYAITNLAVSYAFADIGWMTAPVVAFELNNVLDRDYRQHLDKVSATSWYLPDEAGINGVLSVQVGF

SEQ ID NO: 12430 - protein, 770 aa, Burkholderia sp. H160
MQRTTMQTRHLTIAVAIAFSAAATAHAATAADTGASTEAALSAQTLDTVSVIGQGETRQVQRITTVDKQVLPPGTSGQKILDRLPGVSVQSNDAFGANEESQTISLRGFDKSRLGYTLDGIPLGDNSYGNYNGLSIARAIIAENLAGAELSQGIGSLGVASTSNLGGTIQYFSMDPSTEFGGRASVTVGDNSQRRGYLRVDTGDINGFSAYVSGVHQDQDMWAAPYQNQTTRQFNAKAVWNVGDHRFGAFVATSRASQANYAYLSKDMLARGLGWDWNIYAPDWDRAVAAAYCAPGTYNKARCKFSGGVNSIDDAYYQSRALRDDNLYSVDADLRLGEQGRLKLLAYHHDNRGQGHWWAPGQPSYPGTDRMLPISIRSTNYTINRDGLTAALSWTVGIHELEAGLWYEQNDHNVSRNFYYISGPFLDDLYLKNPDRLLFNQDFDIRTRQFYVQDRMRFLDQRLTVDVGIKSPNTRMRANAQPGVETSIASGTLTAKESVLPQVGLGFKLNANNELFASYAENIAAFVGGGSGGPLQVSPESFAASAGLEPEKSKSLEAGFRTFGEKYQASIAGYNVKFDNRLLSLNPCSSIEVGTRPECVTRFINVGSVKSYGAELTFILKPIDGLQWYNALSWNKTTYEDDYTSGGAIVPVAGKITVDTPQRMASSEISWNRDGFFASLRAKYTGKRYYTYTNDQSVPGVTTFDAGAGYDFGPGLGLRNVRVSLNATNLTNKRYAGQLSSFAPTDPKGTRYAIHASAPRQLFMTVAAEF

SEQ ID NO: 12431 - protein, 376 aa, Burkholderia sp. H160
MKKSLIVLGIAAGLVGLAQAENTTTLYGAIGASTSMKDGLTHEEGSYSQKTVKDIIGDKDDKKDNKNLIKDVKDTWDENIWDLNTSPAKFGIKGTEDLSNGLQAFYKMEFGFDPDEGVNSTRYAYIGLKGDFGTLTLGKSNALYGDLTTYNDIFENGFFDENAHYGNLTKKTRVAKQIRYDSPDMSGMHFGIAGILDGSHNVVETSDSKSFVGFQTGLWYEQNGLYASVAYSNLDGDYQNCLDHGKDKKECSGFTKGSTEVIGANVGYENDQFRIGLGAEHAASLGEKYNLAGAYYMGPNTFRAGFAVSDSDDFNRVISNQGTVGKGETAYTYALGYQYNFSKRTFTYIDGTYIDYSDNKVADDGYLINVGLRHDF

SEQ ID NO: 12432 - protein, 389 aa, Burkholderia sp. H160
MRPIPTLLALSLAALPAFASAADFDNWPTKYAFGDGTELAATANIAYDYNDFSSGSGLEDDDAVRRKEFGATLKKKGVYDAMVYYDFQSDTWLDVFVRFESKAFFGRDIGRFRFGYMKTPVGLDANTSSRAGSFLETALPVQAFYEGRRTGVEWVLERPQYLLQAGAYGGKDLQGDNPGTTQAVRAVWTPVKAPGDVIHLGLAYSQENPRGYSDGRDVHHEASARLRARPEAGLTDIRYVDSGALVTADQIRRTGLEGIWIRGPFSLQAEALRATVTRHDGKPDYTGSGQYAMASWVLTGESRPYNAGAVANIKPAHDYGAVELVARYSRMDLDDGSILGGRQHDLTLGANWYLTSHFKFQANYVKVDASRRGVHSTPEIFELRAQMHF

SEQ ID NO: 12433 - protein, 251 aa, Burkholderia sp. H160
MVSSFANCVFRAPPTIGRRRSLRHAGVIRRFLRSHWLLEPLVLCAVLGVLVVGANAADLDTYETPLYAPTPQSLWAGPYLGFEGGVSQTVTELKSGGRTKDFSRVDAAFGLFGGYNWEVSRFVLGVEGGAAYLGAREKGTHPTLGAIETGSKWTINAKARVGMPIKNVMPYLSLGIAATEHSLKANGTERNSVSVGPVLGGGVEVAVMDAWHLRADYSLTGILDETARFGGTKVDQTAGNHRLMIGLSRSF

SEQ ID NO: 12434 - protein, 299 aa, Burkholderia sp. H160
MRKKIYSINVILVFTLLLLSIQSFAISIDNNIIDQNLGLYLSAQYKPSISHFKNFSVQEVNKKVDLIALKNDVTHITEEILKDPTNFNTHYSAKFKNSFTGFSGAVGYYSAQGPRLEVEGFYENFDITDCSNCTINDANRYLALAREKDNNQVQPKAHDSSSTDSNNSSNNTKKSYFTFMKNNGISIASVMINGCYDFSLNNIKISPYVCAGIGGDFIEFFEVMHIKFSYQGKLGVSYLISPSISLFVDGYYHSVINNKFKNLHVTYAYILKDSPTITSAIAQLNIGYFGGEVGLRFVF

SEQ ID NO: 12435 - protein, 809 aa, Burkholderia sp. H160
MKTTNLFFLTLFIYMLGLSNLAAKDISKISGKILDQNGQAVPYANVALIAIGDGHLVDGTVSDEEGRFIVESTKTSEVKLVISSIGFKPFESEPFQLKPGLIKEMGEVQIQDEATGLEEVTVRSTRPEIIIQPDKTVVNVEGTVMAEGSTALDVIGRSPGIYVDQDGIINLNGRSGVVVMINDRQTYMSATDLANFLRAMPADNIKSIEVINNPSARFDAEGSAGVINIVLKKNTVDGIFGNVQAGGQYNGFWAPIAGVSLNVKKGKWSTNADLNYNHNANLNELDIERNFDVLEGVSNFMQESRIRQRNKNLFFNGAANYEINSDHNIGLNIQASDFDNVTTNPSLTAISTPGVAENTFLDSYNDSKGGGNRYFGNLHYGGNLDTLGTKITADIDFTRMNSGSESLLSTTTWEGEDVENGERGKLNTINDMYYNIFTAKVDFVKPIWNGTLETGVKGSWVKSDNNLDLTLSIEDGPFEPTPNSNHFIYNENVLAAYASFKGKISDKLSYQAGLRGEFSDIEGNSVTLDQINTQNYFNLFPSAFLQHKVSDNYQIVYNANRRITRPNYRLLNPFVYYIDPLTSERGNPNLKPQYSNNFEMNHVVKGAYQFTLGYSETTDAFMQVFIQDDEERTTTTFTDNFDKTRNANFRAMVPVQIREWWGTSNMLQVNYNRYKSLIGDDYLDTEQTSFMVRTQHNVNLPKGFKLEVVGMYLGPQIWGQGELKGFGWVDAGVTKTIMKDKLTIAVNGTDLFRTQVIRAKVDFADIDTSFRQYRSNQGVRFTLRYRFSKGESFRVNKSTGSSEERDRLN

SEQ ID NO: 12436 - protein, 456 aa, Burkholderia sp. H160
MRKRNMILVAGLLAFTSVWGQNTTSGWEDESGKIPVKAYFESGKLHFASKNENFHLWFDNRIYLDAAVYSPTSNVDDLTSKTNKDLEDDDNQFRFSNGVSIRRARFGVKATLYKKWFAELDLDFAYNEVEIKDMYLGYKFNNHFFVKAGNFKVPMSMERTTSSKYLMASERPMAVEAFADGRRLGLVGTGWGKHWWASAGVFGREVDLIQKERNRGNDGYALATRVAVSPIYNEDMTIHVGGYFNYQTPSGSGLENKTVLFRTFPESRVDRRRFVQAEISNVNHYYTTGFELGFRYRKLLTYGEYIYNNISRYTYGANNQKTDLKNAVFNGWYATASYMILGENRQYSPDEAEFGPMKMRRKGGNLEVAARISNINMNDFHDPAAYITGGKATSYSASLNWYPVRNVVIGLNYIYMNNDKYADSKGQITKGGKPLSEVMPSGIDFNVFQLRTMISF

SEQ ID NO: 12437 - protein, 911 aa, Burkholderia sp. H160
MNRSLLATTIASCLVLTACGGGGGGGNVRSNAPQDTIIAPAPTPPPPAADPPPKTAPAPTPAPQRYQGVGSNLLVPTNADLAQQAGAKGKGVKLAVLDDNLVQSYTPISGKVDSFNDYTASPGTPESSANALRGHGTIVSALVLGSAQDGFAGGVAPDADLFYARICAENSCGTQATRRAAVDLAAAGVRIANLSIGTSYPDAAASANAALAWKYALTPLVQADALIVASTGNEGAAEASYPAATPVQEASVRNNWLAVGAINIDSAGNAAGLTSYSNHCGAAAQWCLVAPGSYTVPALAGSELGGQIAGTSFSTAAVSGVAAQVLGVYPWMTASQLQQTLLTTATDLGDPGVDALYGWGLVNAAKAIKGPGQFASDWAINVTSGYDSTFSNDISGVGSLTKSGAGKLTLSGTNTYTGGTTILDGVLSLTGSLRSDLLVANSATFEAHGGVINGNYSLVNSTGTTAIELGKALTVTGQASLKGNLLLLPEAAGYPVGSTEKIVNAGVLHGTFDRVQYANHFFWNAALSYNPTTVTATLTRNSSAASAQAAGAPQSVVNGGNQVDSLVKVLDTRVASGDTDNLGGLISATGALIAASDAQVAASLPTLAGQVHGIERTLGFQSALNDGRVAADRLPYLADTTTLTTWMQGSYLDGDLSRSGFDSADYTQQATTFGVDLPMGNAGTIVGAAVTSGQDRAHIAASSSRLRSDRYAMTAYLYQPMGQAYLSAIGSYGMSNVETERNVQAGSIGERLQDRRHDTNWSARAEIGLMPHAGLSPFVAAGVVSQTQDAFSEASMTGLGLSANRDTLRAGYGEVGVRGHLAHGKWGFDGLVAYRSLLGNPNSDFSAWFTGLPEARFNVAGEPVSKQSLRASAGVRYQLNDTFSIYGNLGTERSRSDANSINANVGLRWQF

SEQ ID NO: 12438 - protein, 357 aa, Burkholderia sp. H160
MKKQLITLLALGAGSAGAIAQTTPVTTGVTLYGLIDTTIRYSTNEDAAGHGRVQMTDGVLTGSRWGLRGTEDLGSGLKSWFILESGFSPDTGTSQQGGRLFGRTAVVGLEGDFGKLALGRQYTLAHEVLSSYEAMAFANNSIVGYQGSNYTGLRYDNTVKYIKSFGGLQIAGAYTFGEVAGSVKNSSAAAGSLVYSSGPIEVGAVYQQTYNVSSAFFGAVPAAQASKQTVWGLGGTYKAGRSQYYLGYTNNHLDVADYRNNVGYVGTRFALNDALAFIGTFQYDWLRHAGQSGKRLTTAGMLDYSFSKRTDIYLEVDYTHLQGAWIALNSAPAFNNSGNTYGNGSRLGVMAGVRHKF

SEQ ID NO: 12439 - protein, 635 aa, Burkholderia sp. H160
MKKRTIPVLLLGLACHAGMAQKPQRDTLSLTNKIHQIDEVVVTGARHETDVRHLSQTVSVVGRAQIESALQPSLLPVLTEQVPGLFVTSRGIMGYGVSTGAAGGISLRGLSGGTARLMVMIDGHPQYAGIFGHPIADAYQSFLAERVEVLRGPASVLYGSNAMGGVINIVTRKMQEDGVDTHLHAGYGSYNTLETELTNRVRKGRFSSVVSGSYNRTDGHRTDMGFEQYGGYAKLGYEVVEHWNLHGDVDVTHFNASYPGPITAPLLDGDQRITRGVTSFAMENRYKKTSGAWSFFYNWGNHWINDGYTPSAGEGPQDARFNSRDHMMGVSLYQSTRFFEGNRITFGFDWFRYGGHAWNEYVSGENAGTSADLVDKQEDELAGYVDLRQDIRSWLTFNAGLRVDHHSRVGTEWVPQVGLAFHLPQAMELKASASKGFRYPILREMYMFPPQNPDLQPESMWNYELAFSQRLMHGRLQYGVNLFFIDGKNLIQTLPNPHGSGMLNQNSGEIENAGVEVQAAYRIDCHWSVDGNYSYLHMKNPVIAAPEHKLYVGTSFSQGRWNVSTGLQYIAGLYTQTDPVVTEDFVLWNLRATFRVNRWLDIWARGENLLAQKYEINAGYPMPRATVMAGINLNF

SEQ ID NO: 12440 - protein, 402 aa, Burkholderia sp. H160
MKKSLLALAALGAFAGVAHAQSSVTLYGIIDEGFNYTSNVQTAAGAGRTGNHLYNLSSGVMQGSRWGLRGAEDLGGGLKAVFVLESGFDVNSGKSGQGGSLFGRQAYVGLSSQFGTVTLGRQYDSVVDFVGPLEAGDQWGGYIAAHPDDLDNFNNANRVNNAIKYTSANYAGLTFGGMYSLGGVAGATGRNQIWSLGAGYNNGPLVLGAGYLNVRDPNQSFWGNTPSGLANPNNNIGRTTVTGVQGNPVISGFASASSYQVGGAGGAYTFGAATVGLTYSFIQFGNLGAANVTAPAYKGTATFNNGEINFKYQLTPALVLGAAYDYTRLADFNGHGGAHYNQGALGADYFLSKRTDVYLIGVYQHASGTDSTGQSAVASINGLTPSNSNNQTTVRVGIRHKF

SEQ ID NO: 12441 - protein, 381 aa, Burkholderia sp. H160
MKKTLMVAALSGVFATAAHAQSSVTLYGLIDAGITYTNNQHGHSNWQMTSGSVNGSRFGLRGAEDLGGGLKAIFTLENGFGINDGTMKQGSRLFGRQAFVGLASDQFGAVTLGRQYDSMVDYVGPLALTGTQYGGTQFAHPFDNDNLNNSFRVNNSVKYQSANYAGFKFGALYGFSNQADGFANNRAYSAGASYSFAGFNLAAAYLQLNSNGATSGAAFNSGGAVSSDNTFFAGRQQTWGAGANYTFGPATAGLVYTQTNLSSLNGISQGASGVSGGVGLNGSSAHFQNFEANARYALTPALSVAGSYTYTRASIEGQRPHWNQFNLQTAYALSKRTDVYLQGEYQQVSENSLVNANINGLGASSSNEKQVSVTAGLRHRF

SEQ ID NO: 12442 - protein, 383 aa, Burkholderia sp. H160
MKKTLIVTALSGVFVTAAHAQSSVTLYGLIDAGITYTNNQGGHSSWSERSGQINGSRWGLRGTEDLGGGLKAIFVLENGFNIANGTLGQNGREFGRQAFVGLSQEQFGAITLGRQYDSVVDYIGPLSLTGTQFGGTQFAHPFDNDNLNNSFRINNAVKYTSVNFGGLKFGALYGFSNSSQFSNNRAYSAGVSYTYAGFNIGAGYLQLNNDISGLTSAAVTNGAGAVAGDNTFVGKRQRVFGGGLNYTFGPATAGFVFTQSRVNRALGISAGASGVSTGLGLNGTFARFNNYEVNARYALTPALSLAGSYTYTAGFLDGRHPGWNQFNLQTDYALSKRTDVYVQGVYQRVSTDGLGIGAYVNGLGGASSSNKQIAVTAGLRHRF

SEQ ID NO: 12443 - protein, 241 aa, Burkholderia sp. H160
MKLKQAVTGIAALACMTTAAHAQSAGSFYVTTGWFHLAPQSNSEPLKVTSIGGSPTNITEANTGASLSSADTIGITAGYFVTDHIAAELVVGYPPSFDLEGSGSLAQFGKLGQAKQWSPTLLFKYYFNAPTAAFRPYLGVGVSRIWFTDEKITNSAFEANVLHGPTSVTTDSSWEPVFNAGFTYAFNQHWFAGFSVSYLPLSTTAKLSTAANTPVGTLNVQSQTKIKLNPIVTYVNIGYRF

SEQ ID NO: 12444 - protein, 787 aa, Burkholderia sp. H160
MQHYLSIMILILLLPVAHAQTGAAGSTSTAINWHLSAQPLSTALQQLAEHSNTSIMFDAATVRNIQAPSLRGQYTPLEALKKLLSGSGLQAEETVPGRFSIVQAATTVQQLPEMTVTGAPDPDSPYSTQYKVPDTTTATRTKTPIMETPMSIQVVPKSVMNDQQAITLEQSLRNVSGVFHGIGQGGVEFLNIRGFQTWDYYRNGVRFTSAQTQTGYREVANLERIEVLKGPASILYGRIEPGGMVNLVPKTPQATPYYSLQQQFGSYNLFRTTLDATGGLNQDSSLLYRLNFAYEDKGSFREFVDNHHFFVAPVLQWQISDRTQITAEMEYKTGKYSVDYGFPAIGNRPANLPINRQLGESFNSAKFDEITAGFHWSHAFNDNWEIKHRFYLQRTDEGDDVVIPSALRTDNRTLDRFYAGFRNAKVDTYTTNMDLTGHVETFGTQHTLLMGGDYYNFRNRRLMISNFDFPSIDIFNPVHSGTAIRDSANDSPYDRRDDWFGLYFQDQIKLPYNVHVLAGFRYDNAEIKNISGRKSAQDKISPRVGVLWQPIPALSFYGNYIENFGAPNLGTSGLDGQPLPAETAQQWEAGIKTEFFDGRFSATLAWFQLTKQNIATPHPDPQLALQRISVLTGEARNQGVEFDITGELLPGWQLIANYTYIDSEITKTNNNMQLGNRFPNVPEHAGNIWTTYAFQNETLRGLKIGGGVTLRGKREGNPENDFQMPGYAVFNLMTSYAMKMGKTRVTAQLNVNNLFNEEYFPGSGGFNRARIFVGTPRVFLGSLRVEY

SEQ ID NO: 12445 - protein, 359 aa, Burkholderia sp. H160
MVKHAVVAAVIGMGVASGAWAQSSVVLYGSMDAGVAYVNNVGGHAKWAMIQGNTQPDRWGLKGKEDLGDGLSAIFQLENGFYTNNGQFATANTIWNRAAFVGLSAERYGTLTLGRQTPLSFDYLDPLSTAYLALSWYAFHPGNIDGLAATGNVPYNNSIKYRSPTFAGFSAAATLALGNTTNFSTGKSVGVALNYANGPFKASAVYSNEHDRSILISQTGITSFQGQNTANGYLASKVENIGAGASYQIGDFLVHGLYTRVKMQSNGFSDTFQSYDAGVNYRSSAFNTIAGGAATTTLAGRRWTQVELGDIYALSKRTQLYANVLYEHGSGGAKAAFFTAGVSSTANQVIVLTGIHHSF

SEQ ID NO: 12446 - protein, 386 aa, Burkholderia sp. H160
MNKKILSCLAISLAALQSTDSDAQSSVTLYGLADNGIDFVNNSAGKQLLAMRDGTSTGIYGSRWGLIGHEDLGGGLETIFRLESGFNLPSGTAAQGGREFGRQAYIGLASSRLGTVTFGRQYDSVVDFMQFASTTSELGTFAAHGTDVDNLVNSFRIDNAVKYTSPTVSGFRLGVLMNFSGTNAANSPHTIPIWSVGADYSVAGAHVAASYLYANRPAQVFTTGDGHFIANTTGAAIGASGPWSYIGNPDHMSIIAAGGTYNFGNITLGGIYTRSLFAQANGTSSDVSFDNYDVSVRYQLNPAWRFIGGYLFTVGHIEYLGQTLKYHRFILGSRYALSKRTEVYGLVSFQQAAGDAHYADLYQGALASMSTTNRQIGGRIGIVHRF

SEQ ID NO: 12447 - protein, 746 aa, Burkholderia sp. H160
MSMRSMRPFAPFLLSGCCLLSQAVQAANEGSTQPVLELEPQSVIATAKEETKQAPGVSVITAEDIQKRPPANDLSQIIRTMPGVNLTGNSTSGQRGNNRQIDIRGMGPENTLILVDGKPVGSRNSVRYGWRGERDSRGDTNWVPADQVERIEVIRGPAAARYGNGAAGGVINIITKQAGIQTHGNATIYSSFPTHKDEGATQRMSFGLNGPLTDSLSYRVYGNVAKTDSDDADINAGHESLRTGNQVGTLPAGREGGRNKDLNGLLSWHLTPDQSLDFEAGFSRQGNIYTGDTQNTNSNSTVKNLLGHETNRSYRETYSVTHRGEWDFGSSMAYLQYEKTRNTRINEGLAGGTEGIFSNSEFYTAVLRDLTAHVEVNLPLRAGFEQTLTLGSEWSQQKLDDPSANTQSTSEGGAVGGLSSSNRSTQSSAQIFSLFAEDNIELQPGTMLTPGLRLDHHSIVGDNWSPSLNLSHALSDTLTLKAGIARAYKAPNLYQLNSDYLLYSRGQGCYGQSTSCYLQGNDKLKAETSVNKELGLEYKADGWVAGLTYFRNDYKNKVESGLAPVSRASGGSGAYRNSAIYQWENVPKALVEGLEGTLTIPLASQLTWNNNFTYMLQSKNKETGDYLSVTPRYTLNSMLDWQATQDLSLQATVAWYGQQTPKKYDYHGDRVTGSATQQLAPYAIAGVSGTYALTRNLSLTAGVDNLFDKRLFREGNAQGVNNIAGAGAATYNEPGRTLYTSLTASF

SEQ ID NO: 12448 - protein, 1116 aa, Burkholderia sp. H160
MKKRRVFMLCLFALSMVLSAWALPPDEKKVTLDLKDVPMETFLNTVKQKAGINMLYNSQMFKGVEPVTVKATNEPWKELLDRVLSPKGFTYATKDGIVVIKKKDQKTRTLEGKVVDEQGGELPGVTVLILGKERNIGTMTDADGAFSLGLPEGDVTIRLSFVGMQTLEIHTGKLNLDKVHTFKLKPDSKQLEEVVVTGYAKISKNSFTGTSVTVTADQLMSVSKTNVLGALQTFDPSFRIAENNLAGSNPNNVPELYIRGRSGIGTTQLDAQSLSKTSLKNNPNLPTFIMDGFEISVQKLYDMDPSRIASITILKDAAATAMYGSRAANGVVIITTVTPKAGKVNIDYNFTGTLEYPDLTDYNMMNAREKLETEVAAGLFKANPEQGFSEQSRLDALYNQKLNNVVRGVDTYWLSKPLRTVFNHKHSLYLDGGTEDLRWGADFSYNSGEGVMKGSYRDRMAGGLSLSYRLGAFQVRNYFSYTYTKSQESPYGSFSDYTSKLPYDEYIDENGRYLETTYPWTGGSGEVNPLYEATLKNYDRSKSWELINNTELLWNIDSYWLLKGQFSVTKSNSDARTFLDPRSKKNDDLLGLNNVVSGQLDIATSNSLSWDATATLSYNRNIKKHNLNFLVGINATSSTGDSFGITYKGFPSGELSSPGYGNKVSGLPSNSDSKSRLFGALGTFNYSFDNIYLADVSVRFDGNSEFGADQRFAPFFSGGLGLNLHNYKFMKQFEWMDRLKIRGTYGITGKVDFSPYEAQTIYKVVTDNWFKTGLGASLMALGNNGLGWEKTHNMDLGLDVDMFKGLLQMNFSYYRKKTVDLVNSVTLPSSTGFTSYKDNIGEVMNKGVEIQLRSNILNAKDWFVAVFANMAHNENKITKISDSLKEYNKRVQEKYAKYDSGKGDSKYSETYLQYVEGGSLTSIFGVRSLGINPADGKEIYLRPDGTITYDWNAADQVVIGNEEPKLQGTFGFNLRWKQFSLYSTFMYEFGGQRYNSTLVSKVENAHIQSSNVDRRVLTGRWQKPGDCTPYGRLQTDGVVAVTRPTSRFIQDYNVLTFNSLTLGYDFNAEWLKKARIGLLRVELSGNDLFRVATVRAERGLDYPYSRSFAASVKMSF

SEQ ID NO: 12449 - protein, 204 aa, Burkholderia sp. H160
MMKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 12450 - protein, 536 aa, Burkholderia sp. H160
MKRIGIIMSVLALCGGTAFSQSQLDAFKYSQTELNGTARYLGMGGAFGALGGDISAMNTNPAGLAIYKSSEVVTTLSLSSASAKTDWLGSKVDNSRTKVSFDNIAYVGYFPTANDEGIVSWNVGFSYNRLKNYSRNYTMATGGDLNTSLSDYVAMRAAGMPSGLLGEDKDYNPYNNQDLGDWLSILGYNAGYMDSYNDNDKEYYSAFGDNNADGQWSPYLLQGGQLKVSERGSVDQYDLAFGINISELVMLGATVAITDLNYRYQSSYDEEFTNGNNLYLDNYLDTDGTGYSFNVGAIVRPADFLRLGVAYNSPTWYKMTDRYYGEAGSYLTFMDKGEMKERKLDAATPNNAYYDYEFRSPDKWIFSAAAILGTTALISVDYELMNYKNMRMYQTDGSSNVYTNQDITDNFKSMNTIRVGAEVKVTPQFAVRAGVAYSDSPIKDKLKNGEKEVFTVGTIPNYTIDKGVMNYTVGIGYRFTPNFYTDLACVFRTHKEDVYAFSNMFAGDDPKPFLEAQPATMKTNTTRVALTLGYKF

SEQ ID NO: 12451 - protein, 367 aa, Klebsiella pneumoniae
MKVKVLSLLVPALLVAGAANAAEIYNKDGNKLDLYGKIDGLHYFSDDKSVDGDQTYMRVGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSPSGEGALSPTNNGRTALKQNGDGYGTSLTYDIYDGISAGFAYSNSKRLGDQNSKLALGRGDNAETYTGGLKYDANNIYLATQYTQTYNATRAGSLGFANKAQNFEVVAQYQFDFGLRPSVAYLQSKGKDLEGYGDQDILKYVDVGATYYFNKNMSTYVDYKINLLDDNSFTRNAGISTDDVVALGLVYQF

SEQ ID NO: 12452 - protein, 1114 aa, Klebsiella pneumoniae
MFRKTTGVAAFSRTAALTTASGLALVAAHPALAQDTDGDITEESAGGTPEELDDENVIIVTGFAESLKTAQSIKERADTVVDVITAEDIGALPDRSVAETLQRVPGVNIGRFEKTSDPTRFSVEGTGVIIRGLPYVRSELNGRDIFSANGGIALSFEDVSPELVGRVEVFKNTTADMIEGQISGLVNLVTRKPLDNPGLNLAGSIEANYGDLRQEWSPTFNILASDTFDTAAGTFGLQLSYSNSALKSRTDASQLVDYCYRPADLSSGCIRAQAVDSGGIQGDVLLGPDEFPPADSVLVPQFANVRSTTLDRDRQAYSVVGQFETLDGRLLMTAEYLRSDTSFFTEEFALLGRIDDGVATNQPRPGTSYEFDANGNFVSGVLTQNVDDAYATPFGIGGIPLDALRFLRGTDSTTEDYSFDIEAEFTDRFRGKFEAQHVSSELTRNAVFGATSTWADIGIDLSGETPDIQFLQPSGALPADVPQDYFGSGYYTYYWFALDSRERNDGNLFSLSGDFEYDISDEGFLKKARFGARWAARDRVNRNTNFSTWGNLSAPWTGRAGCLPWGQNPSTFEPCTYEPGRFFTGLPGQADAIGGGAYTDEFPGFSQLRSPFADNFQRGEAGTPIEGGSAFFFGGDDFLGEYLAGTTDEQVAQINAFSGSGPFGVATYGVNNRSRTLLDGTVVQCDPFCPGEISDVTEITNAAYARADFGSDFGSWTMSGNIGVRYVETKVSNDSTIAFPDPAQFDDVDNGGNGDGIVQPTEISTPCAAIPVDSEGRPEYCDLAGARLAEFASLYTGELISDTRDIVFDHWLPSLNVRFDNNNGIVIRGAVSKGISRPDLNLFNAGGTLAFSGNADSGPLLQLQTGNRNLRPVESWNYDLSLEWYFAEVGSLTAAFFLKDIDGIVQNGIGLANYSAPDAGSQDVIIRGPANDISGTLKGVEIAHQQVYDFLPGFLDGLGTQFSYTYVDASDFPNPNISGIGSPSVNSSGGPVNNGPFVAGTPLQGVSEHTINATIFYERGPFSARAAYNWRSDFLVTTRDDLFPYSPIFQEAGGQLDGSIFYTVNENLKLGVQGVNLLDEVTKLSTKVDYDGTRPISAAFRNDRRYTFIARFNF

SEQ ID NO: 12453 - protein, 394 aa, Klebsiella pneumoniae
MHNKKIANPRFLPLALAAAVALVGTQQAAAEIVLYDKDDTTFSTDGYINAFYVNSDVDREGEQFDRRQSRVKMGFLPNWIGFNFGKQIDDLKLGGRSSFWVTINDSEANGTDTAIDVRQFYGTVSSPEWGEVLVGKDFGLFSRSNIFLDELLAGYGNVSDTLGLVDGNGVSFGNIGTGYPYPFPTSQITYRNNNLAEGLRLAVGIMDPVDTNDDSPTGKAYQENPRFESEVSYQFDLGGSTIYTWVNGAYQTSENTDDTVDKVTSKGLGYGVQAKFGGLSLTGSGFQAKGINPFFTNNLGEPTLRDIDSDGYLLQGSYTWGKNRVALSYGKTEDDGNGLGVAADYETRGIAYFRTINDNLKLVAEYNQYQIDAAAGSGLNEDTDTFAVGAVLSW

SEQ ID NO: 12454 - protein, 298 aa, Klebsiella pneumoniae
MKRKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNERDVRHENGDGWGLSTTYDLGMGFSAGAAYTSSDRTNDQVNHTAAGGDKADAWTAGLKYDANNIYLATMYSETRNMTPFGDSDYAVANKTQNFEVTSTSLIFVCVRQSLS

SEQ ID NO: 12455 - protein, 706 aa, Klebsiella pneumoniae
MNVAISRKRPGLLYALAVALPFTAQAEETVVVTATPPASASAPTEGYSASTSLGATKTDQPLITTAQSVSVVTRQQIADQGANTISQALEYTPGVYSSFGGGATRFDAISLRGYHGGDVDNLFLDGMRLMSDGGSHNVLQIDPWFIERVDVIRGPSSALYGQSVPGGVVNLTSKRPQFSQQGHIRLTGGTQNTKGAAFDYTDAINDQWAWRLIGMTRSSDTQYDHTREERYAISPSLLWQPDSDTSLLLRAYLQKDPSGGYHGSLPLDGTRYAHNGRKLSPSTNEGDPGDGYQRRQQIYSYEFDHQFTDVWSVYSAGSYTHTNVSLDQVYQVGWIDDSDMLARGYSGSRGSLDGWSTDNRLRADFNTGDLAHTLILGAEYHRFRNDLWTGAGGAAPLNPFSGYTAQTGHTVTYSDDNNRRYYQTGLYLQDEMVWNRWHVDVSARYDRIVSQQVSDTQGTSNRRSDDHISGRASLLYALDNGLSPYLSYSQAITPAMLPGADGKPLKPTTAEQVEAGLKFQPPGSSDLYSIAIYDLTQKDVATRDPNIATATYIPAGKVHSQGVELEAHHQITPQLSTIASYTWNRLRFQDTKDGTDNNTPQLTPDQMASFWARYQFPAGISVGAGVRYIGKQWADDANTARLPSVTLMDAMMRADLGVWSPTLKGAYVQVNANNIGDREYISGCYGTGNCYWGAERSVIATVGYDF

SEQ ID NO: 12456 - protein, 383 aa, Klebsiella pneumoniae
MKRKVLALVIPALLAAGAVHAAEIYNKDGNKLDLYGKIDGLHYFSDDSSKDGDQTYVRFGFKGETQINDQLTGYGQWEYNVQTNTSEGDGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNDSDDMRYDNGDGFGISTTYDIGMGFSAGAAYTTSDRTNEQVNAGGTIAGGDKADAWTAGLKYDANNIYLATMYSETRNMTPYGKTDTGYAGGVANKTQNFEVTAQYQFDFGLRPAVSFLMSKGKDLSYNNVNGDDKDLVKYADVGATYYFNKNFSTYVDYKINLLDDDDQFYKDAGISTDDIVALGMVYQF

SEQ ID NO: 12457 - protein, 761 aa, Klebsiella pneumoniae
MEKNASLPFGSFNSLALFTGLCLGASPAAGIAAENSVKNSEETLVVEAAPPSLYSPGASADPKFNKPLVDTTRTITVIPEQVIKDQGVTNLTDALKNVPGVGAFYAGENGSSTTGDAIFMRGVDTSNSIYVDGIRDIGSVTRDTFNTQQVEVIKGPAGTDYGRSAPSGSINMISKQPRLDSGIDGSASIGSAWSRRGTLDLNQAFSDNAAFRLNLMGEKTHDAGRDRIENERYGIAPSLAFGLDTPTRLYLNYLHVRQNNTPDGGIPTVGLPGYSAPSPKYAALNSTGKVDTSNFYGTDSDYDKSTTDSGTLRFEHDLTENTTVRNTTRWSRVKQEYLLTAVMGGANNITAPDINDVNTWSWSRLVNTKDVSNRILTNQTNITSTFDTGSIGHDVSAGVEFTRENQTNYGVNARTAPAVNLYHPVSNLSIGGLDRNGANANGQTDTFGIYAFDTLTLTERIEINGGLRLDNYHTKYDSATACGGSGRGAIACPPGQSTGSPVTTVDTAKSGNLVNWKAGALYRLTEQGNVYVNYAISQQPPGGSSFALAASGSGNSANRTDFKPQKAKSSELGTKWQIFDNRLLLSAALFRTDIENEVAANDDGTWSQYGKKRVEGYELSATGNLTPDWTIIAGYTQQHATVTEGQNVAQDGSSALAYTPKHAFTLWTQYQATSDLSVGGGVRYVGSLRRGSDGAVGTPDHTEGYWVADAKLGYRVNSNLDLQLNMYNLFDTDYVASINKSGYRYHPGEPRTFMLTANVHF

SEQ ID NO: 12458 - protein, 904 aa, Klebsiella pneumoniae
MKKKYNVRSQATPKIGKTILKLSTLSLSMMCLTMAQAAETEQSSTDEKPTKVVKVAVTVSSIKGVAAQSASPITVVKVDEILKQGVTTTEEALAKISANQSSFVTAQNVGASGTVGSAADLRGIGANKTLILLNGRRLAANAYDSGVTNLNIIPLAMLDRIEVLRDGASAIYGTDAIGGVINFITKKQFTGLNISGGLTQPEQNGGDTQDVSVFGGYGDLDENGFNIFGVVDYRHGNDVMAKDRKVSKRGGLLPELGITKGSSGSFPANFYDTKTGTEGNPYAATGCGNNPLVYAQGGFCRYNSQAVIGIVPKTEDISALGRATFKLNDNINAVAEYVYARNEITTSVAPDVFFDLTLNPDSKYYPGNGITPAMNKVSGPLELYIRSQAGNRVSSSINESHRIFGGLEGEAYGWDINTGITYAHSEAEDRLNSGYLNYKKTQEALNNGILNPFGPQAPEDAGLWDTLGVTGTYLKADVDSTTVDFTASRPIFTLPAGDVGFAIGASYRHDEWTSNVVSEVASQAPSTGVDPDEPTNKGKRDIKAVFTELHIPLHKTLEAQLAARYDDYSDFGDTFNPKFALRWEPIKQLMFRTSYSTGFRAPTLWEVNAPNSITNTSAYYNDPVLCPNGPPKNPGDTLPPGGVASRDCETQFDRKNGGNKDLDPEESKSFTAGLVLEPIKNLVLTLDYFNIEVENQIAALPEGDIFNNPTKYADKFVRNPDGTLNHIITTQDNMGDLKTSGVDVSLNYITPMTATGRFGFGIDGTYVIKYKYQNEKDGEWISSLGAYVGDAPIIRWKHTANLYWNYQNWGVNFQQQFTRGYDDQNSSSSVAEGYRDHKVSDYTIYNISGTYKGFKNLEVTAGIKNIFDEDPPASNVGDNFQMGYDPRYADPLGRTYFVRGTYKF

SEQ ID NO: 12459 - protein, 727 aa, Klebsiella pneumoniae
MRSPQYSVPTTLALVISSLLAPNAFAEESEQDTETMIVRSTAEEALKQQPGVSIITAEDIAKQPPVNDLSDIIRKMPGVNLTGNSASGSRGNNRQIDIRGMGPENTLILIDGVPVTSRNAVRYSWRGERDTRGDSNWVPAEMVERIEVLRGPAAARYGSGAAGGVVNIITKRPTNTWHGSLSFFTNQPENNKEGTTNRANFNLSGPLAGEALTMRLYGNINKTEPDAWDINHAQNGSYAAGREGVRNKDINALLSWKMTPQQILDFSYAYSRQGNIYAGDTQYSNGNLSPNGLVDSLYGHETNRLYRQSWGLTYNGLWDWGQSKAGVYYEKTNNTRLQEGSTGRVEGMINSEDYATSRLESWRTTSEFNVPFFWLADQTLTLGMEWNHDQLDDPASMQATNSNGETIPGTSGDPTQRSTKNSATLTGIYLEDNIEAVPGTNLIPGIRFDYHNQFGNNWSPSLNLSQELGDMVTLKAGIARVFKAPNLYQSSKGYLLSTRGNGCPNTIAEGSCYLLGNPDLDPEISINKEIGIEFNLNGYAAGVTWFRNDYKNKIVSGTEVLGYTSSGNNILQWQNGGKAVVEGLEGNLLIPVLRDVLSWRTNATWMLKSESKETGNPLSVIPKYTVNTMLDWQVNDALSANVNWTLYGRQKPRQYAEIRNETGTLATTEVGAYSIVGIGTQYQLNRDIRLNAGISNLFDKQLYRENAGASTYNEPGRAYYAGVTLSF

SEQ ID NO: 12460 - protein, 422 aa, Klebsiella pneumoniae
MKKELPLIALGIIAAAPAFASQQSTSQGFIEDSHLDLFLRNAYIKRDYRDGLPDKAEWGQGIIATFESGFTQGPVGFGVDGIAQYAVRLDGGRGRSGAGGIDFFAQDDDGRAKSDLAKFGATAKMRFSNTVLSYGSQRPMLPIVYADDSRLLYESYTGTMLTSREIDGLEINAGYLTDQQRKSDDSHNSGLKSLTFGGASYQFNDQLSGALYASHVEDVLNKQYLGLNYKQPFAADQQLIVDFNGYNSRLDQEYADANDTGRSNSIWSLAASYIWDIHTFKVAYQQSSGSTGYHYGGYQNQGGVGDGGNTIWLANSYWSDFNGEDERSWQASYGLDFAGLGVPGLSWTTAYVRGDNIKTAETSNGKEHEWFNQVQYQVQNGMAKDLKLRLRYSVLRVSSNASDYNVSGNEVRFYVEYPFNVF

SEQ ID NO: 12461 - protein, 212 aa, Klebsiella pneumoniae
MLKRSITAVALGAAIVAFAGSAFAADMMGATDYSYNDPVAAGPHDWSGNYVGAQVGASSSRVPGPFTNRTGALGGVVVGKNMQSGNVVFGGELEGNFAEAEHRIGNGGSLQQSWNGNAKGKVGYAFDKTLVYGTAGYGVTRFKAKDNTTSAPGWEGGALVGAGVEQALSGPLSVKAEYDFQRFNDVKSRVNGVEQRNNLKNHSIKAGLNYKF

SEQ ID NO: 12462 - protein, 787 aa, Klebsiella pneumoniae
MYKSTPSAAWCKKGLLVTSLFAAIYQTSAIAADTSAVSGEAVDDTSEQMTVTAPAPVQKAGSEHSISARELENKGANDFSSIMRYEPLISAAGASGGSGNGKSGFDRGGYTGYNIRGMESNRVGIDVDGIAQPNATGRGYVGRAGLNTFGIGRDYIDPYMYGSVDIQSGATSTETANSAIGGNVSFRPKSADDYLRPGKTSAFGYRSGYDSADRSWHNGVTVAGGDEFLRGILVYSRRDGQETENNSGTVDAYPANWHSDAFLASGIWQPNDEHKLTSTFDYYHKTNHTHYDTWDSSGNSTIGTANQTSQTRRWGLSLKDDWTPMNDYLDSVSTKIYYQHTEAHDWTYMPDSVTRRMQTVNSNYDTDTWGLQTALAKTLGRHDLSAGFNASTSKTQRPFSQSPIPSVYSEIMQPEADSRSYTLGGFVQDKINFDLDSHNFAIIPGVRVVHQSTKPENLSDLAANSSVLSESSVANLYGKNSDTQVLPSLTFQYDLTPRLMTYLQYQRGAQFPNASQLYGSWNLGSSYAGSQQYALIGNTDLKTETSDNLEWGLKGEVTEGITLRTALFYNSYKNFIAYTRYTRANNPGQFTNVPSNIYTIYQAENRDKAYIYGSEISTKFNFGTWFEQVDGLSATLALGYSEGKSKSSYSGDKYVDLDSVAPMKAIVGVAWDDPAKRYGTALTATFVKGKQATATNRESYSNSGSAITDASSDYMRVPGYGMLDWTAYWQVAKNVRLNGGVYNLTDRKYWDYLSSRNIETGTNQDANDKALAVMPGRTWQLGVNVDF

SEQ ID NO: 12463 - protein, 442 aa, Klebsiella pneumoniae
MGMSQKTRFTQSALAVAVALVSTQAWSAGFQLNEFSASGLGRAYSGEGAIADDAGNASRNPALIMMFDRPTMSAGAVFVDPGVNVSGTSPTGKSLKADNIAPTAWVPNFHFVAPINDQFGWGASITSNYGLATEYNDDYAAGSMGGKTDLTTANFNLSGAYRLDSNWSFGLGFDAVYAKAKIERYAGDLGQIVAGSGALPPALAGQVAKIPADTQIAHLNGNAWGFGWNAGILYELDKNNRYGLTYRSEVKIDFDGNYRSSLPAAYNQILGNFGLPAGTSGQTTNGSLTLNLPEMWELSGYNRVAPQWAVHYSLTYTSWSQFQELKATGSNGQTLFYKEEGFKDAYRLALGTTYYYDDNWTFRTGIAFDDSPVPANNRSISIPDQDRLWLSAGTTYAFNKDASVDVGVSYMHGQHVEIKEGPYTFRSEGTAWLYGANFNYRF

SEQ ID NO: 12464 - protein, 761 aa, Klebsiella pneumoniae
MTQPGLVRAFSIGRTVATFGGVIRPTTWNRGVGLLERASMPDLLVTHRSPHVRRIRVLAPLLWALASSTVMAAPAPETQEVPDTNGQPPTDAPTRERTKAEDAGRTVVTGSRRPRPARDVPATTTVLPRPEIDRSPTLTQDSLVRTVPSAATFRRTPSLVSDPTAQGLNLRGLAPSGVARSLVLLDGIPVNDPFGGWIFWRSLPRLGLERIEVVPSGGSALYGSGALGGVVQLVSRDITGTQLDADATYGNAHTGMLAARGAEMWGPVRASLEAELLDSDGYSIVSAAQRGAIDADTPSSHAVLNGRVEADATDSLTLSARAGLFREDQNGGTRLTTARVELAHFGAGARLRTAHGGTFTLDLFGRVQRFEQDRARITQDRSSEALAASQDVPANDQGASLIWTGPSWTALGTHVLTAGLDVRRMAGTSREQLFPPSPSETSLRLRDTGGTQLSGGVFIEDLYTPSPVLELSAALRMDVWRNQNGEQRLERANGAVDTTRFDDRTEQQLSPRLGLRVRPLEGLTLRASAYRAFRAPTLNELYRPFQVGTILTAANAHLGAERLWGAEAGVEAESSSLGLTTRVTGFWNVLDDPITNVTLEQPLPDGSTRQRENLGQARVRGVEASVDWKLARQWTALLAYTFVDPVVTRSPGQPGLVGKQLAQDPRHRGTAILTFHDPDIVTATVQLRVTGAQFEDDLNERPMGGYAVVDVSASRRLFWKLHVFGAVENLFDREYLAGRAGVDTLGPPLLARIGLRLRDAP

SEQ ID NO: 12465 - protein, 1048 aa, Klebsiella pneumoniae
MKILSLRLKNLNSLKGEWKIDFTREPFASNGLFAITGPTGAGKTTLLDAICLALYHETPRLSNVSQSQNDLMTRDTAECLAEVEFEVKGEAYRAFWSQNRARNQPDGNLQVPRVELARCADGKILADKVKDKLELTATLTGLDYGRFTRSMLLSQGQFAAFLNAKPKERAELLEELTGTEIYGQISAMVFEQHKSARTELEKLQAQASGVTLLTPEQVQSLTASLQVLTDEEKQLITAQQQEQQSLNWLTRQDELQQEASRRQQALQQALAEEEKAQPQLAALSLAQPARNLRPHWERIAEHSAALAHIRQQIEEVNTRLQSTMALRASIRHHAAKQSAELQQQQQSLNTWLQEHDRFRQWNNEPAGWRAQFSQQTSDREHLRQWQQQLTHAEQKLNALAAITLTLTADEVATALAQHAEQRPLRQHLVALHGQIVPQQKRLAQLQVAIQNVTQEQTQRNAALNEMRQRYKEKTQQLADVKTICEQEARIKTLEAQRAQLQAGQPCPLCGSTSHPAVEAYQALEPGVNQSRLLALENEVKKLGEEGATLRGQLDAITKQLQRDENEAQSLRQDEQALTQQWQAVTASLNITLQPLDDIQPWLDAQDEHERQLRLLSQRHELQGQIAAHNQQIIQYQQQIEQRQQLLLTTLTGYALTLPQEDEEESWLATRQQEAQSWQQRQNELTALQNRIQQLTPILETLPQSDELPHCEETVVLENWRQVHEQCLALHSQQQTLQQQDVLAAQSLQKAQAQFDTALQASVFDDQQAFLAALMDEQTLTQLEQLKQNLENQRRQAQTLVTQTAETLAQHQQHRPDDGLALTVTVEQIQQELAQTHQKLRENTTSQGEIRQQLKQDADNRQQQQTLMQQIAQMTQQVEDWGYLNSLIGSKEGDKFRKFAQGLTLDNLVHLANQQLTRLHGRYLLQRKASEALEVEVVDTWQADAVRDTRTLSGGESFLVSLALALALSDLVSHKTRIDSLFLDEGFGTLDSETLDTALDALDALNASGKTIGVISHVEAMKERIPVQIKVKKINGLGYSKLESTFAVK

SEQ ID NO: 12466 - protein, 731 aa, Klebsiella pneumoniae
MDMKKRLWVLHPLLLASTLPALAAQSDEDSIIVSANRTHRTVAEMAQTTWVIEGQEIEQQVQGGKEFKDVLAQLIPGIDVSSQGRTNYGMNMRGRAIVVLIDGVRLNSSRTDSRQLDAIDPFNIEHIEVISGATSLYGGGSTGGLINIVTKKGQQDRQVDLEVGGKSGFANSNDHDERVAAAVSGGTDHASGRLSVAYQRFGGWYDGNNDALILDNTQTGLQHSDRLDVMGTGTIEIDNNRQLQLVTQYYKSQGDDDYGLWLGKNMSAVTSGGKAYTTDGLNSDRIPGTERHLISLQYSDADFFGQNLVSQVYYRDESLTFYPFPTLTKGQVSSFSSSQQDTDQYGAKLTLNSQPLAGWDLTWGLDADHETFNANQMFFDLPQSMASGGLHNESIYTTGRYPGYSISNVAPFLQSSYDLNDIFTVSGGVRYQWTENRVDDFVGYAQQQDIANGKARSADAIKGGKTDYDNFLFNAGIVAHLTERQQTWFNFSQGVELPDPGKYYGIGKYGAAVNGHLPLISSVNVDDSPLQGIKVNSYELGWRYTGDNLRTQLAAYYSTSDKTIVVNRTDMTIDVQSDKRRIYGVEGAVDYFIPDSDWSVGGNFNVLKSQVQTDGRWQKWDVTLASPSKATAWVGWAPDPWSLRVQSQQVFDLSDAAGNKLEGYNTVDFIGSYALPVGKLTFSIENLLNEDYVTIWGQRAPLLYSPTYGSSSLYEYKGRGRTFGLNYALTF

SEQ ID NO: 12467 - protein, 752 aa, Klebsiella pneumoniae
MKYTSHFPLGIVIPLLACSVPLQAAENMTEQSTPDESAATAENHEETMVITAARQNLQAPGVSTITAEEIRKHPPARDVSELIRTQPGVNLTGNSTSGQRGNNRQIDIRGMGPENTLVLVDGKPVTSRNSVRYGWRGDRDSRGDTSWVPAEMIDHIDVIRGPAAARYGNGAMGGVVNIVTKPTTREWHGSWNTYMNAPQHRKEGATKRTNFSLNGPLSDSVSFNLWGNLSKTQADAQDINAGHEAERTGSYAGSYPAGREGVVNKDIHSKLRWEFAPMQALEFEAGYSRQGNLYAGDTQNTNTSALVKSMYGKETNRLYRQTYGVTWTGGWDNGVTSNSYAQYEHTRNSRMDEGLAGGTEGIFSSSEFSDIDLADVLLHSEVNIPFTLGVDQNLTLGTEWNQQRMKDGVSTTQALSYGTIDGVSATGRSPYSSAEIFSLFTEDNMALTDSTMLTPALRFDHHSIVGNNWSPSLNLSQELTDDWTLKLGIARAYKAPNLYQLNPNYILYSNGQGCYASSSACYLMGNSDLKAETSVNKEIGLEYKHDGYQAGITWFRNDYHNKIESGYAAVGTASNGTTNIYQWENVPKALVEGLEGTLNLPVGEAVNWSNNLTWMLQSKNKTTGDRLSVIPQFTLNSTLSWQVREDLSLQSTFTWYGRQKPKRFNYKGEAVSGSELNEVSPYSIVGLSATWEVNKNLSFTSGIDNLFDIRHYRAGNAQTTGNATTGAYLYGAGAETYNESGRTFFMSVNTHF

SEQ ID NO: 12468 - protein, 351 aa, Klebsiella pneumoniae
MKKTAIAIAVALAGFATVAQAAPKDNTWYAGGKLGWSQFHDTGWYNSSLNNDGPTHESQLGAGAFGGYQVNPYVGFEMGYDWLGRMPYKGDNVNGAFKAQGVQLTAKLGYPVTDDLDVYTRLGGMVWRADSSNSIAGDDHDTGVSPVFAGGVEWAMTRDIATRLEYQWVNNIGDGNTVGVRPDNGMLSVGVSYRFGQQEEAAPIVAPAPAPAPEVQTKHFTLKSDVLFNFNKATLKPEGQQALDQLYTQLSNLDPKDGSVVVLGYTDRIGSDAYNQGLSEKRAQSVVDYLVSKGIPANKISPRGMGESNPVTGATCDNVKPRAALIDCLAPDRRVEIEVKGIKDVVTQPAA

SEQ ID NO: 12469 - protein, 308 aa, Klebsiella pneumoniae
MMKRNILAVVIPALLVAGAANAAEIYNKNGNKLDFYGKMVGEHVWTTNGDTSSDDTTYARIGLKGETQINDQLIGYGQWEYNMDASNVEGSQTTKTRLAFAGLKAGEYGSFDYGRNYGAIYDVEAATDMLVEWGGDGWNYTDNYMTGRTNGVATYRNSDFFGLVDGLSFALQYQGKNDHDRAIRKQNGDGFSTAATYAFDNGIALSAGYSSSNRSVDQKADGNGDKAEAWATSAKYDANNIYAAVMYSQTYNMTPEEDNHFAGKTQNFEAVVQYQFDFGLRPSIGYVQTKGQGPAVACWLLRRRCGSG

SEQ ID NO: 12470 - protein, 171 aa, Klebsiella pneumoniae
MNKIARLSALAVVLAASVGTTAFAATSTVTGGYAQSDMQGKANKAGGFNLKYRYEQDNNPLGVIGSFTYTEKDNTSNGTYNKGQYYGITAGPAYRLNDWASIYGVIGVGYGKFQNNNFPNHKSDMSDYGFSYGAGMQFNPIENVALDFSYEQSRIRNVDVGTWIAGVGYRF

SEQ ID NO: 12471 - protein, 614 aa, Klebsiella pneumoniae
MIKKASLLTAFSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAYTHGFDVVAYGNTGMQAQPDKDGFLSKTLYGALEHNFTDVWSGFVRGYGYDNRTNYDAYYSLGSPLLDTRKLYSQSWDAGLRYNSELIKSQLITSYSHSKDYNYDPHYGRYDSSATLDEMKQYTIQWANNVTVGHGNIGAGVDWQKQTTTPGTGYVDEGYDQRNTGIYLTGLQQVGDFTFEGAARSDDNSQFGRHGTWQASAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 12472 - protein, 467 aa, Klebsiella pneumoniae
MRTFSGKRSTLALAIAAVTAMSGWVVAPQASAAGFIDDSTLTGGIYYWQRERDRKDVTDGDKYKTNLSHSTWNANLDFQSGYAADMFGLDIAAFTAIEMAENGDSGHPNEIAFSSRNKAYDEDYSGDKSGISLYKAAAKFKYGPAWARAGYIQPTGQTLLAPHWSFMPGTYQGAEAGANFDYGTAGALSFSYMWTNEYKAPWHIEMDDFYQNDKKTKVDYLHSVGAKYDFKNDLVLEAAFGQAQGYIDQYFAKASYKFDVAGAPLSTSYQFYGTRDKVSNGGVNDIYDGTAWLQALTFGYKVADVLDLRLEGTWVKADGQQGYFLQRMTPTYASSNGRLDIWWDNRSDFNANGEKAVFFGAMYDMKNWDMPGWAFGASYVYAWDAKPGRMSSPDAYYDPDYRLKESAYSLDAMYTVQEGRAKGTLFKLHFTQYDNHSDIPSWSGGYGNIFQDERDVKFMVIAPFTIF

SEQ ID NO: 12473 - protein, 711 aa, Klebsiella pneumoniae
MLRRFLFVMCILGLLPSSVQGAEVHGTGAIHGHVIAKDSESPIVGAMISLMGTTYGTVSDENGAFWLAHVHPGTYTLRVSYLGYKTHEKQVHLKNASDTLAIEFSLKPAQVDIDAIVVTATRQETALKDVPQLTEVITGEELQVTGAVTVQDALEMNIPGIEFSPDSHGANIQMQGLGSDYILILLDGERLAQQDRSNIDFNRLNTSDIERIEVTKGSASSLYGSNAIGGVINIITKKPQYPLEASASYRISKYGEQNINGMLGTKSDLWSAKLTINKKQSDGYDLTPETPTSYTQEKFEDLSLTPWLRMTPSDKLQLDFQGNYYQYERFDATTIPQHPRNYGFTLGSSANYYFSPEQSLKLSWHTDQYEQYDYYERLDEEELSAIHRYDNAKLIFATGFSKTHALTLGGEFLREKLVSDRITNGRKTTQNWIGFAQEEIQLIEKLRTVAGVQFVHHSTFGSHVSPRVSLLYQDLPFNIRLGYSHGFRTPTLKELYMDWDHFGMFFIEGTSDLEPETSNYFTGSLEFITERLNASILLYHNSLKNMIATVTTTEDGISTETYKNVSDARLQGFDLLLKVGIGRGLSLSGGYSFVDSKDLETDLEIEGVIRHTARLRAEYNYLFSRGFNLTLALQGKYNGGMIYESVNDDGEVERENYRPYWNWRLTASQQLFASITFTAGVDNIFDYTDTVDFSTITPGRRFFSVIQYSFN

SEQ ID NO: 12474 - protein, 742 aa, Klebsiella pneumoniae
MNNRIKSLALLVNLGIYGVAFPLSAAETATDDKNSAAEETMVVTAAEQNLQAPGVSTITADEIRKRPPARDVSEIIRTMPGVNLTGNSTSGQRGNNRQIDIRGMGPENTLILIDGKPVTSRNSVRLGWRGERDTRGDTSWVPPEMIERIEVIRGPAAARYGNGAAGGVVNIITKKTGDEWHGSWNTYMNAPEHKDEGSTKRTNFSLSGPLGGDFSFRLFGNLDKTQADAWDINQGHQSERTGIYADTLPAGREGVKNKNIDGLVRWEFAPMQSLEFEAGYSRQGNLYAGDTQNTNSNDLVKENYGKETNRLYRNTYSVTWNGAWDNGVTTSNWAQYERTRNSRKGEGLAGGTEGIFNSNQFTDIDLADVMLHSEVSIPFDYLVNQNLTLGSEWNQQRMKDNASNTQALSGGEIPGYDSTGRSPYSQAEIFSLFAENNMELTDTTMLTPALRFDHHSIVGNNWSPSLNLSQGLWDDFTLKMGIARAYKAPSLYQTNPNYILYSKGQGCYASKDGCYLQGNDDLKAETSINKEIGLEFKRDGWLAGVTWFRNDYRNKIEAGYAPVYQNNKGTDLYQWENVPKAVVEGLEGTLNVPVSETVNWTNNITYMLQSKNKETGDRLSIIPEYTLNSTLSWQVRDDVSLQSTFTWYGKQEPKKYNYKGQPVTGSEKNEVSPYSILGLSATWDVTKYVSLTGGVDNVFDKRHWRAGNAQTTGGATGTMYGAGAETYNESGRTWYLSVNTHF

SEQ ID NO: 12475 - protein, 736 aa, Klebsiella pneumoniae
MGQIMHTTHYSSFPLRKTLLALAIGAASQTAMAADAAAAKQPGEETLIVEANETSDFKSGGDLVVPAFLDGQIAHGGRLGMLGEQKAMDVPFNVIGYTSKLIQDQQAKTIADVVSNDAGVQAVQGYGNFAETYRIRGFKLDGDDMTMGGLAGVVPRQVMDTQMLERVEIFKGANSLLNGAASSGVGGMINLEPKRAEDLPTARVGVDYTSDSQVGGTLDLGRRFGDNNQFGARVNLVHREGEGAIDNDKRRTTLASLGLDYRGDRFRSSLDFGYQKKTFHGGTMGVNISGVDFIPALPDNSKNYSQKWGYSDIESEFGMAKAEYDLTDSWTVYSALGGQHSHEIGTYSAPKLLNKNGDATVGRLDTNRIIDAISGMGGVRGDFNTGAISHKVNLGYAAQVHTDATAWRMSARNPTTNIYDNHDVAMPDNAYFGGNYHDPLITSRSRTQGWLLSDTLGFFNDKVLFTAAARHQKVVVRNYSNATGLEDTSSRYTQSRWMPTFGLVYKPWEQLSLYANHTEALQPGSVAPTTAANAGQSTGIAHSKQDEVGVKIDYGTIGGSLALFEIKKPNAISDTAGNYGLDGEQRNRGVEMNVFGEPMLGLRLNASTVWLDAKQTKTAEGATDGKDAIGVANFYAVLGAEYDIKPVEGLTATARVNHSGSQYADAANTKKLDSYTTLDLGLRYRMRLNADQNEMIWRVGVTNVTNEKYWSGIDDTGTYLFEGDPRTVRVSMSYDF

SEQ ID NO: 12476 - protein, 708 aa, Klebsiella pneumoniae
MAHKIIYRTPYLLSPLVFLTSGLLSPLVFADDTSLEVIEVHGDAQNKHLALGSTESLLSDLGVDFSAAGGVSNLPILNGLMGDRVKVLVDGAEITAACANQMNPPLSYISANQVTSYHVVAGVSPVSAGGDNIAGVISVNSIAPQYTQNSDLAWHSGYVSAKYSTADNGRNFGVGARLASNTLSVNYQGSFSDANSYEDGNGDVVLDTLYRAQNHSLTAAIRDDKQQVVVKLSHQKIPYQGFANQYMDMTDNTSYGVTAQYKRAFASSEFAGQVNWHSVKHDMGFFSAEKIGMMPMKTDAEDISSQLKWRINLDNDSSILLAQEYYHYSIDDWWPSITGSAMMGPNDYKNINNGKRERIALVAEYESQNSKKLWLNTGVRIENINTQVSEVQAYNTGMHMGGMHIGLSDAIAANTFNAGSRNKTDTVVDANVLINYQITNVDELQLGIARKNRAPNLYERYSWGVSNMATTMIGWYGDGNGYIGTPDLGVETAHTMSATYTKLAKDDSWRLSTNIWYTDVSDYIDADIVRNFNSSGIDGNSRNILQFTNVDAILYGAKVDLRASIYQSEQLGQWQVKANITNTRGKRDGNSSTQPLYQIKPLQTQLGISQQVGNVENSLLWQWVDTKTRVDNNRFENQTDSYHLVNLSSKTVWDAFTLSVEVTNLFDQYYQLPLGGVSIAGFKQDNATGFTQLAGQGRSLNLALSYAF

SEQ ID NO: 12477 - protein, 284 aa, Klebsiella pneumoniae
MKKTLLAAGAVLALSSSFTVNAAENDKPQYLSDWWHQSVNVVGSYHTRFGPQLRNDTYLEYEAFAKKDWFDFYGYMDAPVFFGGNTNAKGIWNHGSPLFMEIEPRFSIDKLTGADLSFGPFKEWYFANNYIYDMGRNKSGRQSTWYMGLGTDIETGLPMSLSLNVYAKYQWQNYLADNENEWDGYRFKVKYFVPLTELWGGNLSYIGFTNFDWGSDLGDSQYRTSNSIASSHILALNYDHWHYSVVARYFHNGGQWENGAQPVWQSETVKATGWGGYLVVGYNF

SEQ ID NO: 12478 - protein, 448 aa, Klebsiella pneumoniae
MKKSTLALAVTVGVLAQQASAAGFLEDSKASVSSRTLYFNNDLREGFRASDQRETSTGLKFDYLSGFTQGTVGFGLDAQAVMGLHLGGGIEHHNANTANTVVPTDTDGSSVSDWSRVGANAKMRFSKTELKVGNALAPNLPILVSNDGRLLPQAFEGGILTSKDLDNVTFTAGQLNKSIGRASSNWTDLSVAGATQTADQFRFAGADWKVTKDLTLQYYYANLEDFYKQHFLGLVHVYQIDNDQSFKTDLRYFNSSADGKNSEAAAGYRFNNNGGYASHTGEVDNQTWSAMFTYALGGHSFMVGHQQVGDSGGMVYLGQGNVVDGRGRPEGNGGSSFYLFTDSMINGFNRAGENTTFGQYSYDFAKVGVPGLKAAIAYLSGDDIRDVNRNLGSHSEWERDMRVDYVIQSGPLKGFGTTVRHGSFRGDSATTADTDQTRILFNYTYSFM

SEQ ID NO: 12479 - protein, 733 aa, Klebsiella pneumoniae
MARPKPAAARATPDQVRARTALRRAARRAQPTQVQPVPFPNAGTLSADRNPYADAAAPYKVDRLSGTKFTEPVLNTPRTVTVLTKELLEDKNATSLREVARSTAGVTLGTGEGGNAFGDRFFIRGFDARNDVFIDGIRDPAISIRENFFTEQVEILRGPASTMAGRGTAGGAINIVTKQATTEGNFTKAETTFGSDATKRVTVDVNQVLSPTLAVRVDGLYQDAKVAGRNYVTDDRWGTLAAVKWTPTDAIKVTANYVHTDLDGLPDFGVPYNTALRRPSTDVNVPRETYYGFVNRDFQKAKQDFGTVTGEFAITPDLTLTNRSRAAHSVLNYIGTLPSNPTATTVSLASQSRYQTTDVLANQTDLTYKFDVGGVKHTMVGGAEISRESVMRDTYAGLTSELAGFQSGGRITVPLLAPPNLFEFATQPQRAYNPTFINVDTKSAYVIETANWNDVVILNGGLRYDDYNITGHTAATSTSVQSGMWNYNLGAVVKPLPYASLYAAYATSTNPVGAELDASGTAYGGLVVNNATFQALPPEMNKAAEVGTKWELFDRRLLLTASLFETQKSNARETVGNNILSTGVYRVRGIDLEAAGKITDRWSVFGGLVLMDTKVLQSIDPNSVGAQLANIAHQSFNLLTKYKFDDHWEVGGQAVYASKIYGGTFAAINGNVLPEHWRFDSFVEFKVDKHMTAKLSVNNIFNTTYYDAFYRSNSPFVFIAPGRSVWLTLRGAL

SEQ ID NO: 12480 - protein, 825 aa, Klebsiella pneumoniae
MRTKRPRNGPTGRCMRNQPAAYRAGPAPRIHFTLFQSTRDVPITMGHDRFRFSRPCWLKALLASNSICWMAGLYGPAHAADLPVKTAPPITAAPSTLWNWTGIYVGAHLGGAFGSSDWQTATGLQADFSNRGFPGSGNAEGLLGGGQIGVNYQFGTWVTGLEIAASAADVDGFAKCANRADNRYGVISFTCDNRVTSLGTIAGRLGQTWGNLLIYGKAGAAWATDESDARTSHYINKFNQSGTRWGWMGGLGLEYAFSPNLSAFVEYDHFDFGSKDSNYVDQFNNASTVGFRQRFDMIKAGVNYGLGGPILNARADAATTPVLLGGWTIEAGSRYFGSTGRMQKDLYGLRPTHLVSRLIYGDQTGHAAETFFRFDHKSGFFARGNLGLGPLVDGKLNDEDFPYINYSNTNSDMKSGRFTYGTADVGYNFINDDGRRLGAYVGYHSFYERANGFGIQQQATNGPPLEASKSFLVLSETETWRAAAIGINAQARLSDRLKLEVDAAYLPYASRSGFDNHWLRADINPTPDPGHGWGTQFEAVLSYAVSDRFSVGVGGRYWFFTTDSAYSQFPGGSPQTTKFYSERYGGFLQASYKSGELDTAQAKANGIDKEPPPVMPTNWAGVYLGGTIGAGKGRSHYADPFPTPVSGDYADLGGAMFGGQIGINYQTGSWVLGLEASGYWANVQGTNTCFGAFPSPQIAGFNCGSQIDALGALTGRVGYAFDRTLLYVKGGSAWDRQTNQFNTGGISGTILTNGNTNWGWTVGGGLEYALLPNWSMALEYKYYDFGKSPVFTTAGLGSVPLSPNSTTVQTVSLGVNYKLPILGAR

SEQ ID NO: 12481 - protein, 236 aa, Thermodesulfovibrio yellowstonii
MRKFLLAAATVAAFAAPGLAADLPPRPYTKAPTYTPPQQAVYNWTGFYVGGHLGGAFGGGLGGSDGRFLGGVQGGADYQFANQWVLGVEAQYSWLANYRGDVAFPGGSVVTGGNSGLGSVTGRLGYVWGPTLLYAKGGYAFRDGALGVTNAAGVPQAFTATGNRDSGYTVGAGLEYMFAPNWSAKAEYQYYNFGKTTFGAGSPADVVGASFRNDEHTVKAGVNYRFGWGGPPVPHY

SEQ ID NO: 12482 - protein, 799 aa, Thermodesulfovibrio yellowstonii
MRSLPRQHLLSLALATAFGSVSFWSTGAVAQATGQEAAQVFDIHVPAQALASAINELSRQTGTQMFAAGELVAGLSSRAVNGRLTSEQALRELLAGTSLEATRTHNGGFAIRRPAASGATLPTINVTDSETAAGPVQGYVARRSSTGTKTDTPILETPQSITVIGAQEIETLKSQSLQDALGYAAGVTRAEGLDRTSDSLYLRGFRTTGMYRDGSLFTANIYDGRQEPYGLERIELLKGASSVIFGSVSPGGVVNTVSKRPTTEKIRELNIDAGSFGRRQVSGDFAGALDDEGKWSYRLVALKRDSDSFIDHVPDDRTYIAPSLKWQPDANTSLTLLAEVQKDRTAYVYGLPAYGTLLPNINGQIPRNRFIGEAGRDKFDLDRYSIGYLFEHAFSEKLKLRNSMRYYNAKSSYFSTDGWGLSADQRSVVERYFQPRWDRSSAFVTDTSLQYQLDQGRVKHTMLVGFDYALPKHETERYEQQAADLDVFNPVYGKPVGPVSPYYRSSWKNDYKRLGIYAQDQIKIDDKWVVLLGGRYDKVRFNETNFFTGDVSAANEKSSAFTGRLGVVYLAANGLAPFFSYSESFEPTQGQDRLGSRFKPTTGQQYEAGVRYQPSGSRAMVSAAVFQLTRQNLLVPDPQDASRAFNIQAGEVRSRGFELEARSSIGRNVNIIAAYAYTDARTTQASPLQPDELGKRSIGVPYNQISLWGDYSFGDFGLAGLKVGMGARYLGQTRGLAYGVPVSLPAFTLVDAMVSYTTGPWRFALNLTNLTDKTYIASCSYGCFYGEPRKVIGTATYRW

SEQ ID NO: 12483 - protein, 713 aa, Thermodesulfovibrio yellowstonii
MIYLKFIIALLLWTVTSPLQAQTLISGMVTDEKGEALAGANVSVKNTYDGTSTNIDGQFQFNTPQQGEAILVVAYISFKTFEQKITLSGKPLQINVRLKEEANELNTVVITAGAFEASDEKRVVVLNSIDIATTAGGGAGDLVGALQTLPGAQTVGETEGLFVRGGAANETKTLIDGLVVQNPFYSSVPDVPQRGRFSPFLFKGTVFSTGGYSAQYGQALSSVLVLNSQDLAEKTQTNIDLMTVGVGAGHTQRWKNTSLSLNTRYTNLEPVFQLIPQNADWKRAPESVDGSIIFRQKTSKTGIFKLYSTYNQSNLAMNYQDISLENTTNALDLTNDNTYINTSWKEALSDRWFVQVGGSYSHDHDLILLNGNRIFQQERLQQGRITVQHLLGENSGLTFGGEVQRFNFDDGLNQLSRGLEENYLAGFVEADVFFTRKLAGRFGVRMEKSEVIGQQNIAPRLSLAYKTGKYSQVSAAYGQFFQTPQTNDLIQLKTARLSTDLQFEQSVHYLLNYQWMVPGKRTFRIEGYYKQYDDLVKNNQDLAQLEVNNNGYGFARGIELFWRDKQTFKNVDYWVSYSFLDTEREFQNFPTLARPGFAANHTLSMVYKQYFSDIHSYVGFTYTFSSGRAYFNPNNPEFHGDTTPAYHNLSLTYTYITSLFDNFTILFASINNVLGVQNVFGYRYAPDGTQRQAIGQAADRGVFIGMFVSIGKR

SEQ ID NO: 12484 - protein, 479 aa, Thermodesulfovibrio yellowstonii
MVFFCWHGCWNNGICSAWKGAYLVIPRITAMRSTVCYRTALSLAILLASPAFADSDDEGFIDGTRVHVLNRNFFFSQDYRNGDFTLNPNNGERQSLHREWGHGIIANLQSGFTRGTVGFGVDVQGLVGLKLDGGNGAVGNGVGVPGIVSRSGSNFDGEPKDSYGKVGTALKVRAFDTELRYGDVSPTSPVLHASDIRLLPQTLRGFIFNNNSLDGLSLQGGKLESSSDRNASNHRGDLGTVYAGRIKGANDVVYLGGDYRFNDQLTLRLHSSRLDDVWNQSFFSVDHVQPLGSELSLKTGLNYYRTRDSGQALAGQIDNDSWSVHAGLAAGAHGFKLSYTRIDGDTPFDYVWNTYDLQLDAASQVSDFNNPNERAWEARYDYDFAPLGVPGLSLTARYVRGTDIDGTRAGGAYSYFNGTEDGRHWERNLWLKYVLQSGPAKDLSFNLMQATHRVGGDHVAESNVDELRLIVQYPLDISL

SEQ ID NO: 12485 - protein, 199 aa, Escherichia coli O157:H7
MRKLYAAILSAAICLAVSGAPAWASEHQSTLSAGYLHVSTNVPGSDELNGINVKYRYEFTDTLGMVTSFSYAGDKNRQLTHYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 12486 - protein, 1565 aa, Escherichia coli O157:H7
MNTIHLRCLFRMNPLVWCLWADVAAKLRSLKRYSVFTFQRMKFMNRTSLHYCRRSVLSLWISALIYAPPGMAAFTPDVIGVVNDETVDGSQKVDERGTTNNTHIINHGQQNVYGGISNESLIESGGYQDIGRHNNYVGQANNTTINGGRQTIHDGGISTGTIIESGNQDVYTGGISNGTTIKGGNSHISGGTANGTIIDGGSQRVTTQGHVDSTTINKSGSQDVVQGSLATNTTINGGRQYVEQSTVETTTIKNGGEQRVYESRALDTTIEGGTQSLNSNSTAKNTQIYSGGTQIVDYTSTSDVIEIYSGGVLDVRGGMATNVTQHDGAALKVTTYDLTVSGTNSEGAFSIHNNVADNVLLENGGHLDVYGSATRTIIKDKGTMSVLTNAKADATRIDNGGVMDVAGNATNTIINGGTQNINNHGIATGTNINSGTQNIKSGGKADTTNISSGSRQIVEKDGTATGSNISAGGSLIVYTGGIAHGVNQETGSALVANTGAGTDIEGYNKLSRFTIIGGEANYVVLENTGELTVVAKTSAKNTTIDAGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSEKANIKGGKQTVYGLATEANIESGEQIVDGGSTDKTHIKGGTQTVQNYGKAINTDIVSGLQQIMANGTAEGSIINGGSQVVNEGGLAENSVLNDGGTLDVREKGSATGIQQSSQGALVATTRATRVTGTRADGVAFSIEQGAANNILLTNGGVLTVESDTSSAKTQVNAGGREIVKTKATATGTTLTGGEQIVEGVANETTINDGGIQTVSANGEAVKTTINEGGTLTVNDNGKATDIIQNSGAALQTSTANGIEISGTHQYGTFSIAGNLATNALLENGGNLLVLAGTEARDSTVGKGGAMQNLGQDSATKVNSGGQYTLGRSKDEFQALARAEDLQVAGGTAIVYAGTLADASVSGATGSLSLMTPRDNVTPVKLEGAIRITDSATLTIGNGVDTTLTDLTAASRGSVWLNSNNSCAGTSNCEYRVNSLLLNDGDVYLSAQTAAPATTNGIYNTLTTSELSGSGNFYLHTNVAGSRGDQLVVNNNATGNFKIFVQDTGVSPQSDDAMTLVKTGGGDASFTLGNTGGFVDLGTYEYVLKSDGNSNWNLTNDVKPNPDPNPNPKPDPKPDPKPDPKPDPTPDPTPTPVPEKRITPSTAAVLNMAATLPLVFDAELNSIRERLNIMKASPHNNNVWGTTYNTRNNVTTDAGAGFEQTLTGMTVGIDSRNDIPEGIATLGAFMGYSHSHIGFDRGGHGSVGSYSLGGYASWEHESGFYLDGIVKLNRFESNVAGKMSSGGAANGSYRSNGLGGHIETGMRFTDGNWNLTPYASLTGFTADNPEYHLSNGMESKSVDTRSIYRELGATLSYNMRLGNGMEVEPWLKAAVRKEFVDDNRVKVNNDGNFVNDLSGRRGIYQAGIKASFSSSLSGNLGVGYSHGAGVESPWNAVAGVNWSF

SEQ ID NO: 12487 - protein, 1050 aa, Helicobacter pylori
MKKVFLFSLLYLLSVVTVVAQQKDNKQQVQKTKVENSEVPSGYRAVFGKVVDQEGLQLIGVTIRLKGTDFGTTTDVNGEFKLFYPVRKHPVIIVSYIGMVTEEISLGDDASKDKARVIKLKEDAVMTDEVVITGYSNINKKSFTGNSVQIKKEDLLKVSKTNVFSALQAFDPSFRIQENSQWGSDPNAIPELYIRGRSGIGIKELDSETVSKSNLQNNPNLPLFIMDGFEVSATKLYDLDPNRIENITILKDAAATAMYGSRAANGIVVITTVPPKPGKLQIDYSMTGTLQMPDLSDYNLMNASEKLETERLAGFYIGKDAGEQYTLDREYYGKLQNVKRGVDTDWISQPVHSVFNHKHSLSLTGGTENLRFSVDLSYNKSDGVMRGSYRDRTGGGLALDYRIGRLQVRNYVSYSSTRSKESPYGSFSDYTTKLPYDTFRDDDGDYVTKTTEWHNLGMDNLANPLYEATLKSYDRSNADEFIDNLSANWYINDHWQIKGQFALTKSYSESRRFLDPLSAKNTDVLSSTNKISGELTTSSGNSLSWDMNAFLAYNRTIKEHNINLSVGINATSSSGTSTSARYMGFPSGDFDSPNYAQKIYEKPDWSDTKSRLFGALATLNYSYQNIYLLDASVRSDGSSEFGSDNKTALFWSFGLGLALHNYEFIKKLSFIDEFKIRGTYGSSGKVNFEPFAAKTVYEINGDEWYETGMGANMIAMGNVNLGWETTYQTDFGFELGLLKRLFYISFAYYNKRTVDLVNDVTIPSSTGFTSYKDNVGEMQNRGYEFNVRSNIIRRRDMQLSLFANLGHNENKLVKISNSLKAYNDLVDQKYAELGNYDADAAKPFRKYEEGVSTTAISAVKSHGIDPATGKEIFEKRDGTLTTKWDSADMISCGDTEPDIQGTFGFNFSWKKFSLYTTFMYEYGGQRYNSTLVSKVENADIYNSNVDKRVFSDRWKEPGDNARFKALYNGKNSIEITKSTTRFIEDYNLLSLNSITLGYTFGAEQIKKLGLSMLRLEIGANDLARFCTVKQERGLSYPYSRSVNFTVNASF

SEQ ID NO: 12488 - protein, 711 aa, Helicobacter pylori
MKKKFLSLTLGSLLVSALSAEDNGFFVSAGYQIGESAQMVKNTKGIQDLSDSYERLNNLLTSYSALNTLIRQSADPNAINNARGNLNASAKNLINDKKNSPAYQAVLLALNAAAGLWQVMSYSISVCGPGSDKNKNGGVQTFENVPSNGGTTIACDSFYEPGKWSGISTENYAKINKAYQIIQKAFGASGQDIPALSDTKELNFEIKGKKNDSVQPGERWKFPWTNGKFVSVKWVNGKYEEIKEDIKVSNNAQELLKQASTILTTLNEACPWLSNGGAGNVAGGNSLWAGIDKGDGSACGIFKNEISAIQDMIKNAEIAVEQSKIVTANAQNQHNLDTGKAFNPYKDANFAQSMFANARAQAEILNRAQAVVKDFERIPAAFVKDSLGVCHEKGSDGNLRGTPSGTVTSNTWGAGCAYVGETVTNLKNSIAHFGDQAERIHNARNLAYTLANFSGQYKKLGEHYDSITAALSSLPDAQSLQNVVSKKTNPNSPQGIQDNYYIDSNIHSQVQSRSQELGSNPFRRAGLIAASTTNNGAMNGIGFQVGYKQFFGKNKRWGARYYGFVDYNHTYNKSQFFNSDSDVWTYGVGSDLLVNFINDKATKHNKISFGAFGGIQLAGTSWLNSQYVNLANVNNYYKAKINTSNFQFLFNLGLRTNLARNKRIGADHSAQHGMELGVKIPTINTNYYSLLGTTLQYRRLYSVYLNYVFAY

SEQ ID NO: 12489 - protein, 668 aa, Helicobacter pylori
  misc_feature (451)..(451): Xaa can be any naturally occurring amino acid
MKKTLLLSLSLASSLLNAEDNGFFISAGYQIGEAAQMVKNTGELKKLSDTYENLSNLLNNFNNLNQAVTNASSPSEINAAIDNLKANTQGLIGEKTNSPAYQAVYLALNAAVGLWNVIAYNVQCGPGKSGQQSVTFEGQPGHNSSSINCNLTRYNNGVSGPLSIDNMKKLNNAYQTIQQALKQDSGFPVLDSKGKQVTISITTQTNGQSSKETTTTTTTNNAQTLLQEASKMIDVLTTNCPWVNHNPGQNGGAPWGLNTAGNVCQVFATEFSAVTSMIKNAQEIVAQAQSLNQQNNQTAPQDFNPYTSADRAFAQNMLNHAQAQAKMLELADQMKKDLNTIPSHFITNYLAACRNGGGTLPDAGVTNNTWGAGCAYVEETITALNNSLAHFGTQAEQIKQSELLARTILDFRGSLSTLNNTYNSITTTASNTPNSPFLKNLISQSTNPNNXGGLQAVYQVNQSAYSQLLSATQELGHNPFRRVGLISSQTNNGAMNGIGVQVGYKQFFGEKRKWGLRYYGFFDYNHAYIKSSFFNSASDVFTYGVGTDVLYNFINDKATKNNKISFGVFGGIALAGTSWLNSQYVNLATFNNFYSAKMNVANFQFLFNLGLRMNLAKNKKKASDHAAQHGVELGVKIPTINTNYYSLLGTQLQYRRLYSVYLNYVFAY

SEQ ID NO: 12490 - protein, 186 aa, Helicobacter pylori
MIKRIACILSLSTSLALAGEVNGFFMGAGYQQGRYGPYNSNYSDWRHGNDLYGLNFKLGFVGFANKWFGARVYGFLDWFNTSGTEHTKTNLLTYGGGGDLIVNLIPLDKFALGLIGGVQLAGNTWMFPYDVNQTRFQFLWNLGGRMRIGDRSAFEAGVKFPMVNQGSKDVGLIRYYSWYVDYVFTF

SEQ ID NO: 12491 - protein, 367 aa, Helicobacter pylori
MQKALLHSSFFLPLFLSFCIAEENGAYASVGFEYSISHAVEHNNPFLNQERIQIISNAQNKIYKLHQVKNEITSMPKTFAYINNALKNNSKLTPTEMQAEQYYLQSTFQNIEKIVMLSGGVSSNPQLVQALEKMQEPITNPLEFEENLRNLEVQFAQSQNRMLSSLSSQIAAISNSLNALDPNSYSKNISSMYGVSLSVGYKHFFTKKKNQGLRYYLFYDYGYTNFGFVGNGFDGLGKMNNHLYGLGIDYLYNFIDNAKKHSSVGFYLGFALAGSSWVGSGLSMWVSQTDFINNYLTGYQAKMHTSFFQIPLNFGVRVNVNRHNGFEMGLKIPLAMNSFYETHGKGLNTSLFFKRLVMFNVSYVYSF

SEQ ID NO: 12492 - protein, 172 aa, Helicobacter pylori
MKKIACLSAVAACVLAVTAGTAFAGQSTVSAGYAQGDLQGVANKADGFNLKYRYEFDNNPLGVIGSFTHVEKNGSENGYYGKAQYNSITAGPAYRFNDWASIYGVVGVGYGKNIDNAQNGSDRNGSSDYGFTYGAGLQFNPIQDVALDVGYEQSRIRSVDVGIWSVGVGYRF

SEQ ID NO: 12493 - protein, 3194 aa, Helicobacter pylori
MTYRNGKIDLKERFSKNRSFKGIKKKIAKKYTIKNSLSIIYSLKTHSNSSLSINKKIFLGLGFVSALSAQSEDYNSSVYWLNSVNENNNNKSYYISPLRTWAGGNRSFTQNYNNSQLYIGTKNASATPNHSSVWFGEKGYIGFITGVFKARDIFITGAVGSGNELKTGGGAILVFESSNELTTNGAYFQNNRAGTQTSWINLISNNSVNLTNTDFGNQTPNGGFNVMGRKITYNGGSVNGGNFGFDNVDSNGATTISGVTFNNNGALTYKGGNGIGGSITFTNSNINHYKLNLNANSVTFNNSTLGSMPNGNANTIGNAYILNANNITFNNLTFNGGWFVFNRSDAHVNFQGTTTINNPTSPFVNMTGKVTINPNAIFNIQNYTPTIGNAYTLFSMKNGNIAYDDVNNLWNIIRLKNTQATKDNSKNATSNNNTHTYYVTYNLGGTLYHFRQIFSPDSIVLQSVYYGANNLYYTNSVNIHDNVFNLKNINDDRADTIFYLNGLNTWNYTQARFAQTYGGKNSALVFNATTPWANGAIPKSNSTVRFGGYEGVNWGKTGYITGTFTADRVYITGNMMSGNGAQTGGGATLNFVGATEINIAGATFKNLKTTSQNSYMTFMALGNGSGSGKINVSQSDFYDWTDGGYDFTGNGVFDSVNFNKAYYKFQGAENSYNFKNTNFLAGNFKFQGKTTIEKSVLNDASYAFDGVNNAFNEDKFNGGSFNFNHAEQTNAFNNNSFSGGSFSFNAKQVDFNGNSFNGGVFNFNNTPKASFTNDTFNVNNQFKINGAQTDFTFSKGVVFNMQGLLSSLSVGTTYQLLNAKSVGYKDNNNALYQMLRWTSGENPSGKLVDENKTAPNSAKIYNVQFTDNGLTYYIKENFNNGITLTRLCTLGYTHCVNIDNDAFNLKNVNNNASNTVFYLNGMTTWKTAGTGVFTQDYSGTNSVLVFNQTTPFLAGANPTSNSVVGFGKTSGAEWGLVGYIQGVFKANQIDITGTIRSGNGAKTGGGATLVFNAQERLNIANANLNNDKAGLQNSWMNFIVNNGNLNVTNANFSNQTPHGGFNLKANNITWDKGSVSGGGNFGVDNANANGNAVIKNVNFSDNGTLIYKGGENSAGNSLTLENNTFNSYNINAKAQNLIFNNNSFNSGSYSFNDTKNVTFKGTNTLINSDPFSRLKGSVSIDNNSIFNIERDLTDKTTYTLLSGDNIKYNNQALADNVFSKNLWDLIHYDGEQGTLLRTDNNTYFVQFTQSNGQKFVFEETFNPGSITYKYFTIHSSPFHTEADSKDIWNQVRKQFDFIPGKTPVCVGVCYIAPYKNQDLIGSSAFAWSLNFGATVVGTLLLGSAQEKANNNGGSIWFGKNNLLYLHGNFNATNIFLTNNFNVGNPNAGGGATINFNADETLSADGLNYTNFQTVAMGLQTSASQHSWANFNSKLSMEIKNSNFRDFTWGGFRFNSGRITFENTTFSGWTNINGATESGSSYVNMVANTDLIFTDSILGGGIRYDLKANNIIFNNTQMVVDVSKNVNQSSLNGNVTFNHSRLSVKPNAAINIGGDQTQTTLENASSLSFYNDSVANFNGTTAFNGVSYLNLNPNAQVSFNQANFNNANVTFYGIPLFGKTPNFGNSVRLINFKGDAKFNQATLNLRAKNIHLNFQGASTFENNSTMNLAESSQASFNALSVEGETNFNLNGSSLLSFNGNSVFNAPVNFYANNSQISFTHSATFNADASFDLGNNSTLNFQSVLLNSALNLLGNGGNNLAINAKGNFSFGSQGILNLSYMNLFGGDKKASVYDVLQAQNIDGLRGNNGYEKIRFYGIQIEKADYSFNNGVHSWSFTNPLNTTETITETLHNNRLKVQISQNGASNNAMFNLAPSLYDYQQNPYDESENSYNHTSDKAGTYYLSSSIKGFGKNNEIPGTYNAQNQPLQALHIYNQAISKQDLNMIASLGKEFLPKVAKLIASGALDNLNLNSPDSFETIFSILKEYGITLNQANWKSLLKIINNFSNTANYHFSQGSLVVGAIKEGQTNTNSVVWFGGDGYKNPCAVGDNTCQMFRQTNLGQLLNSSVPYLGYINANFKAKNIYITGTIGSGNAWGSGGSANVSFESATNLVLNQANIDAQGTDKIFSYLGKEGIDKLFGEKGLGNVLSNIVYEESLNDNAIPKDLANMIPKDLGSKTLSSLLSPTEVNNLLGVSAFKNAIMEILNSKTVGDVFGENGLLNALDPVKRKEIDQMLLEQIQAHSSGFEKFIVKTLGIENVENFINNWYGKQSLSSFANNFVPGGLNQALDKIGSSSDAKDLQSFLDKTTFGDILNQMINQAPLINKLISWLGPQDLSVLVNIALNSITNPSKELLGAISGMGQKVLNDLLGEGVVNKIMSNQVLGQMINKIIADKGFGGVYHQGLGSILPKSLQDELKKLGMGSLLKPKGLHNLWQKGNFNFVAKNHVFVNNSLFSNATGGELNFVAGKSIIFNGKNTINFTQYQGRLSFVSKDFSNISLDTLNATNGLTLNASKNDISVQKGQICVNVLDCMTAKGKTTQTNSSSSATAPTNETLEVSANNFAFLGTIKANGLVDFSKVLQNTTIGTLDLGPNATFKANNLIVNNAFNNNSNYRANISGNFNVAKGATFSTNENGLNVGGNFNSEGPLIFNLNNPTHQTIINVTGTSTIMSYNNQALINFNTQLKQGAYTLINANRMVYGYDNQTILGGSLSDYLKLYTLIDFNGKRMQLNGDSLSYDNQPVSIKDGGLVVSFKDNQGQMVYSSILYDKIQVTVSDKPMSIQAPSLEYYVKRIQGSAGLNAIKSAGNNSIMWLSELFAAKGGNPLFAPYYLQDNPTEHIVTLMKDITSALGMLSNSNLKNNSTDVLQLNTYTQQMSRLAKLSNFASFDSTDFSERLSSLKNQRFADAVPNAMDVILKYSQRDKLKNNLWATGVGGVSFVENGTGTLYGVNVGYDRFVRGVIVGGYAAYGYSGFYERITSSKSDNVDVGLYARAFIKKSELTFSVNETWGANKTQISSNDALLSMINQSYKYSTWTTNAKVNYGYDFMFKNKSIILKPQIGLRYYYIGMSGLEGVMNNVLYNQFKANADPSKKSVLTIDFALENRHYFNTNSYFYAIGGVGRDLLVNSMGDKLVRFIGNNTLSYRKGDLYNTFANITTGGEVRLFKSFYANAGVGARFGLDYKMIDIIGNIGMRLAF

SEQ ID NO: 12494 - protein, 298 aa, Helicobacter pylori
MKKALLLTLSLSFWLHAERNGFYLGLNFAEGGYIQGQGSIGEKASAENALNQAINNAKNSLFPTTQNTKAIRDAQNALNAVKDSNKIASRFAGNGGSGGLFNELSFGYKYFLGKKRIIGFRHSLFFGYQLGGVGSVPGSGLIVFLPYGFNTDLLINWPTDKRASQKYVERRVKGLSLFYKDMTGRTLDANTFKKASRHVFRKSSGLVIGMELGGSTWFASNNLTPFNQVKSRTIFQLQGKFGVRWNNDEYDIDRYGDEIYLGGSSVELGVKVPAFKVNYYSDNYGDKLDYKRVVSVYL

SEQ ID NO: 12495 - protein, 270 aa, Helicobacter pylori
MKKFVVFKTLCLSVVLGNSLLAAEGSTEVQKQLEKPKEYKAVKGEQNAWYLGISYQVGQASQSVKNPPKSSEFNYPKFPVGKTDYLAVMQGLGLTVGYKQFFGEKRWFGARYYGFMDYGHAVFGANALTSDNGGVCELHQPCATKVGTMGNLSDMFTYGVGIDTLYNVINKENASFGFFFGAQIAGNSWGNTTGAFLETKSPYKHTSYSLDPAIFQFLFNLGIRTHIGRHQEFDFGVKIPTINVYYFNHGNLSFTYRRQYSLYVGYRYNF

SEQ ID NO: 12496 - protein, 767 aa, Helicobacter pylori
MKRILVSLAVLSHSAHAVKTHNLERVEASGVANDKEAPLSWRSKEVRNYMGSRTVISNKQLTKSANQSIEEALQNVPGVHIRNSTGIGAVPSISIRGFGAGGPGHSNTGMILVNGIPIYVAPYVEIGTVIFPVTFQSVDRISVTKGGESVRYGPNAFGGVINIITKGIPTNWESQVSERTTFWGKSENGGFFNQNSKNIDKSLVNNMLFNTYLRTGGMMNKHFGIQAQVNWLKGQGFRYNSPTNIQNYLLDSLYQINDSNKITAFFQYYSYFLTDPGSLGIEAYNQNRFQNNRPNNDKSGRAKRWGAVYQNFFGDTDRVGGDFTFSYYGHDMSRDFKFDSNYLNVNTNPKLGPVYTNQNYPGFFIFDHLRRYVMNAFEPNLNLVVNTNKVKQTFNVGMRFMTMDMFIRSDQSTCEKSDIIDGVCHMPPYVLSKKPSNNQEMFNNYTAVWLSDKIELFDSKLVITPGLRYTFLNYDNKEPEKNDFSVWTSKKQRQNEWSPALNIGYKPMENWIWYANYRRSFIPPQHTMVGITRTNYNQIFNEIEVGQRYSYKNLLSFNTNYFVIFANRYYAGGYSPQPVNARSQGVELELYYAPIRGLQFHVAYTYIDARITSNADDIAYYFTGIVNKPFDIKGKRLPYVSPNQFIFDMMYTYKHTTFGISSYFYSRAYSSMLNQAKSQTVCLPLNPEYTGGLEYGCNSVGLLPLYFVLNVQVSSVLWQSGRHKITGSLQINNLFNMKYYFRGIGTSPTGREPAPGRSITAYLNYEF

SEQ ID NO: 12497 - protein, 273 aa, Helicobacter pylori
MEFMKKFVALGLLSAVLSSSLLAEGDGVYIGTNYQLGQARLNSNIYNTGDCTGSVVGCPPGLTANKHNPGGTNINWHSKYANGALNGFGLNVGYKKFFQFKSLDMTSKWFGFRVYGLFDYGHATLGKQVYAPNKIQLDMVSWGVGSDLLADIIDNDNASFGIFGGVAIGGNTWKSSAANYWKEQIIEAKGPDVCTPTYCNPNAPYSTNTSTVAFQVWLNFGVRANIYKHNGVEFGVRVPLLINKFLSAGPNATNLYYHLKRDYSLYLGYNYTF

SEQ ID NO: 12498 - protein, 651 aa, Helicobacter pylori
MKKTILLSLSLSLASSLLHAEDNGFFVSAGYQIGEAVQMVKNTGELKNLNEKYEQLNQYLNQVASLKQSIQNANNIELVNSSLNYLKSFTNNNYNSTTQSPIFNAVQAVITSVLGFWSLYAGNYFTFFVGSGKQASRVQGNPHFKTIVENCSGPENCAMNQTTYDEMKKLAENLQAAQQNATTKGNNLCALSGCAATDSASNPPNSTVSNALNLAQQLMDLIANTKTAMMWKNIVISGVSNASGAITSTNYPTQYAVFNNIKAMIPILQQAVTLSQNNHTLSASLQAQATGTQTNPNFAKDIYTFAQNQKQIISYAKDIFNLFNSIPKDQYRYLEKAYLKIPNLGQTPTNPYRQEVNLNQEVQTIKNNVSYYGNRVDAALSVARDVYNLKSNQANIVTAYSNANNLSEEISKLPYNQVNTKDIVTLPHDKNAPAAGQYNYQINPEQQSNLNQALAAMSNNPFKKVGMISSQNNNGAMNGLGVQVGYKQFFGESKRWGLRYYGFFDYNHGYIKSSFFNSSSDIWTYGGGSDLLVNIINDSITRKNNKLSVGLFGGIQLAGTTWLNSQYVNLTAFNNPYSAKVNTSNFQFLFNLGLRTNLATAKKKDSEHSAQHGIELGIKIPTINTNYYSFLGTQLQYRRLYSVYLNYVFAY

SEQ ID NO: 12499 - protein, 638 aa, Helicobacter pylori
MKKTILLSLSLSLASSLLHAEDNGFFVSAGYQIGEAVQMVKNTGELKNLNDKYEQLSQSLAQLASLKKSIQTANNIQAVNNALSDLKSFASNNHTNKETSPIYNTAQAVITSVLAFWSLYAGNALSFHVTGLNDGSNSPLGRIHRDGNCTGLQQCFMSKETYDKMKTLAENLQKAQGNLCALSECSSNQSNGGKTSMTTALQTAQQLMDLIEQTKVSMVWKNIVIAGVTNKPNGAGAITSTGHVTDYAVFNNIKAMLPILQQALTLSQSNHTLSTQLQARAMGSQTNREFAKDIYALAQNQKQILSNASSIFNLFNSIPKDQLKYLENAYLKVPHLGKTPTNPYRQNVNLNKEINAVQDNVANYGNRLDSALSVAKDVYNLKSNQTEIVTTYNDAKNLSEEISKLPYNQVNVTNIVMSPKDSTAGQYQINPEQQSNLNQALAAMSNNPFKKVGMISSQNNNGALNGLGVQVGYKQFFGESKRWGLRYYGFFDYNHGYIKSSFFNSSSDIWTYGGGSDLLVNFINDSITRKNNKLSVGLFGGIQLAGTTWLNSQYMNLTAFNNPYSAKVNASNFQFLFNLGLRTNLATAKKKDSERSAQHGVELGIKIPTINTNYYSFLGTKLEYRRLYSVYLNYVFAY

SEQ ID NO: 12500 - protein, 314 aa, Helicobacter pylori
MGVLGAVACALMIASCGQNKVAEKPPEPGDTAVARVNGQVIWASDVKREAVAQGLISEGEPLDISSEVFRQRLDEVIDQKLLAAEAVKRKLDKDPLAQRRLAAARERILGDMLVEGVVEKAVTEDAIRKLYAEQQKLSKRSEEIRARQILVGSQAEAESIKKLLATGASFDALAMERSTDQATRFNGGDLGYFTLDVMPEAYGAALKDAQKGALIGPFAAEGGWVLVKVEDKRTEEPITLEAARPQIIRFLTYDQVRDILEKLRGSAKVEMMIGKSQELPAGSAQEPASAPPELQGAAPASAPPAAQPAQSAKQ

SEQ ID NO: 12501 - protein, 251 aa, Helicobacter pylori
MNKLLIGVVGALAIGLGAAPATAADLAPRPYTKAPPMIAAIYDWSGFYVGANGGWGSSRSCWDLTAPVAGGCHDATGGTIGGQIGYRWQSNNLVFGLEAQGNWADLNGRNVSIDFSRFTNHSRLDAFGLFTGQIGYSWDATLLYVKGGAAVTSNRYRSVDNVSGLQAADSVNDTRWGGVVGVGLEYGFAPNWSLGFEYDHIFMGNSSHTFINNGVIGAPGTTFGTDNIRQDVDLVTARINYRWGGPAIARY

SEQ ID NO: 12502 - protein, 792 aa, Helicobacter pylori
MNGYLRVKTPYFLALGVLIFWAFNSFMSAKDKHHFLKKVTTTEQKFNSSAPLSYQSEEVRNSTSSRTVISNKELKKTGNLNIENALQNVPGIQIRDATGTGVLPKISVRGFGGGGNGHSNTGMILVNGIPIYGAPYSNIELAIFPVTFQSVDRIDVIKGGTSVQYGPNTFGGVVNIITKEIPKEWENQAAERITFWGRSSNGNFVDPKEKGKPLAQTLGNQMLFNTYGRTAGMLGKHVGISMQGNWINGQGFRKNSPTKVQNYLLDAVYKINATNTFKAYYQYYQYNSYHPGTLSAQDYAYNRFINERPDNQDGGRAKRFGIVYQNYFGDPDRKVGGDFKFTYFTHDMSRDFGFSNQYQSVYMSSQNKILPFKGKGKISATNPNCGLYSYSDTNSPCWQFFDNLRRFVVNAFEPKLNLIVNTGKVKQTFNMGMRFLTEDLYRRSTTRKNPSVPNNGSGFDAGTSLNNFNNYTTVYASDEINFNNGMLTITPGLRYTFLNYEKKDAPPFKAGQTGKTIKDRYNQWNPALNIGYKPIKDWLFYFNYQKSYIPPQFSNIGNFVGTSTDYFQIFNVMEGGSRYYFNHQVSFNANYFVIFANHYFTGRYGDNKEPVNARSQGVELELYYTPIRGLNFHAAYTFIDANITSHTMVTNPANPKGPKKDIFGKKLPFVSPHQFILDASYTYAKTTIGLSSFFYSTAYSDVLNTVPFTEYAPTIKNGAITTKTAGMTPYYWVWNLQISSTLWERKKQSVNASLQINNIFNMKYWFSGIGTSPNGKEAAPPRSITAYVSYNF

SEQ ID NO: 12503 - protein, 587 aa, Helicobacter pylori
MKNFSPLCCFKKLKKRHLIALSLPLLSYANGFKIQEQSLNGTALGSAYVAGARGADASFYNPANMGFTNDWGENRSEFEMTTTVINIPAFSFKVPTTNQGLYSVTSLEIDKSQQNILGIINTIGLGNILKALSNTAATNGLSQAINRVQGLMNLTNQKVVTLASNPDSQIVNGWTGTTNFVLPKFFYKTRTHNGFTFGGSFTAPSGLGMKWNGKGGEFLHDVFIMMVELAPSMSYTINKRFSVGVGLRGLYATGSFNNTVYVPLEGASVLSAEQILNLPNNVFADQVPSNMMTLLGNIGYQPALNCQKAGGDMSDQSCQEFYNGLKKIMGYSGLIKASANLYGTTQVVQKSNGQGVSGGYRVGSSLRVFDHGMFSVVYNSSVTFNMKGGLVAITELGPSLGSVLTKGSLNINVSLPQTLSLAYAHQFFKDHLRIEGVFERTFWSQGNKFLVTPDFANATYKGLSGTVASLDSETLKKMVGLANFKSVMNMGAGWRDTNTFRLGVTYMGKSLRLMGAIDYDQAPSPQDAIGIPDSNGYTVAFGTKYNFRGFDLGVAGSFTFKSNRSSLYQSPTIGQLRIFSASLGYRW

SEQ ID NO: 12504 - protein, 791 aa, Helicobacter pylori
MFLRSYPKLRYALCFPLLAETCYSSDHTLGKVTTQAKRIFTYNNEFKVTSKELDQRQSNEVKDLFRTNPDVNVGGGSVMGQKIYVRGVEDRLLRVTVDGAAQNGNIYHHQGNTVIDPGMLKSVEVTKGAANASAGPGAIAGVIKMETKGAADFIPRGKNYAASGAVSFYTNFGDRETFRSAYQNAHFDIIAYYTHQNIFYYRSGATAMKNLFNPTQADKEPGTPSEQNNALIKMNGYLSDRDTLTFSWNMTRDNATRPLRSNAIGLAYPCEAPFSPDGAQGCPNVLDSFTRYMYHSINSANNLSLQYKREAGNSFGDPRLDFTLYTSIRNAQFDPLFDPNGVYAKFPTSQASAWERENYPCVEGAYCTPSFSDVDKPSSQPRDLFLNNTGLNLKVAHVIDEATDSLFEYGFNYQNLSVFDARIPKSELYRPNQVYTDDKGQKQIACSLVDNNPNDPTLCQRGKANGNIYGGYVQANYSPHKIITFGAGVRWDAYTLYDKDWNHRYTQGFSPSAALVLSPIEPLSLKITYSQVTRGVMPGDGVYMRQNDLRYAKNIKPEVGSNAEFNIDYSSQYFSGRAAAFYQALDNFISQYAQNLIVTNLSQAIRIYGYEVGGTFRYKGVSLNVGVSRTWPTTRGYLMADSYELAASTGNVFIIKLDYTIPKTGINLAWLSRFVTGLDYCGFDIYLPDYGTAEKPKTPTDLAKCGSKLGLVHMHKPGYGVSNFYINWSPKTKSRWKGLLLSAVFNNVFNKFYVDQTSPYVMSPDMPGTDAVKRAIAEPGFNARFEVAYKW

SEQ ID NO: 12505 - protein, 1295 aa, Helicobacter pylori
MEIQQTHRKMNRPLVSLVLAGALISAIPQESHAAFFTTVIIPAIVGGIATGTAVGTVSGLLGWGLKQAEEANKTPDKPDKVWRIQAGRGFNEFPNKEYDLYRSLLSSKIDGGWDWGNAARHYWVKGGQQNKLEVDMKDAVGTYKLSGLRNFTGGDLDVNMQKATLRLGQFNGNSFTSYKDAANRTTRVNFNAKNISIDNFVEINNRVGSGAGRKASSTVLTLQASEGITSSKNAEISLYDGATLNLASNSVKLMGNVWMGRLQYVGAYLAPSYSTINTSKVTGEVNFNHLTVGDKNAAQAGIIASNKTHIGTLDLWQSAGLNIIAPPEGGYKDKPNNTPSQSGTKNDKNESAKNDKQNSAQNNSNTQVINPPNSAQKTEIQPTQVIDGPFAGGKDTVVNIDRINTNADGTIRVGGFKASLTTNAAHLNIGKGGVNLSNQASGRTLLVENLTGNITVDGPLRVNNQVGGYALAGSSANFEFKAGTDTKNGTATFNNDISLGRFVNLKVDAHTANFKGIDTGNGGFNTLDFSGVTGKVNINKLITASTNVAVKNFNINELLVKTNGISVGEYTNFSEDIGNQSRINTVRLETGTRSIYSGGVKFKGGEKLVINDFYYAPWNYFDARNIKNVEITNKLAFGPQGSPWGTAKLMFNNLTLGPNAVMDYSQFSNITIQGNFVNNQGTINYLVRGGKVATLNVGNAAAMMFNNDIDSATGFYKPLIKINSAQDLIKNTEHVLVKAKIIGYGNVSTGTNGISNVNLEEQFKERLALYNNNNRMDTCVVRNTDDIKACGMAIGNQSMVNNPDNYKYLIGKAWKNIGISKTANGSKISVYYLGNSTPTEKGGNTTNLPTNTTSNVRSANNALVQNAPFAHSATPNLVAINQHDFGTIESVFELANRSKDIDTLYTHSGAKGRDLLQTLLIDSHDAGYARQMIDNTSTGEITKQLNAATTTLNNVASLEHKQSGLQTLSLSNAMILNSRLVNLSRRHTNNINSFAQRLQALKGQRFASLESAAEVLYQFAPKYEKPTNVWANAIGGASLNSGGNASLYGTSAGVDPYLNGNVEAIVGGFGSYGYSSFNNRANSFNSGANNANFGVYSRIFANQHEFDFEAQGALGSDQSSLNFKSALLRDLNQSYNYLAYSATARASYGYDFAFFRNALVLKPSVGVSYNHLGSTNFKSNSQSQVALKNGASSQHLFNANANVEARYYYGDTSYFYLHAGVLQEFAHFGSNDVASLNTFKINAARSPLSTYARAMMGGELQLAKEVFLNLGVVYLHNLISNIGHFASNLGMRDSF

SEQ ID NO: 12506 - protein, 734 aa, Helicobacter pylori
MKKHILSFALGSLLVSTLSAEDDGFYMSAGYQIGEASQVVKNTKGVQQLSDNYENLSKLLTRYSTLNTLIKLSADPSAINAARENLGASAKNLIGDTKNSPAYQAVLLAINAAVGFWNVLGYATQCGGNANGQESTSSTTIFNNEPGYRSTSITCSLNRHSPGYYGPMSIENFKKLNEAYQILQTALKKGLPALKENNGTVNVTYTYTCSGNGNDNCSSQTTGVNEQNGGTVTKTQTIDGKSVTTTISSKVVDSTASGNKSGVSYTEITNNLNNVPDNAQALLAQASTLINTINTACPFFNVTNKEGGPQMHPTTGKLCDFTDEISAIQKMITDAQELVNQTSAINSNEQTTPVGGSNGKPFNPFTDAQFAQSMLANAQAQAKMLNLSEQVGQTLNPDRLTGNFQNFVKNFLATCNNPSTAGTGGTQGSAPGEVTTQTFASGCAYVEQTITNLNNSIAHFGTQEQQIEQAENIADTLVHFKSRYSELGNTYNSITTALSKVPNAQSLQNVVSQKNNPYSPQGIETNYYLNPNAYNQIQTINQELGRNPFRKVGIVSSQTNNGAMNGIGIQVGYKQFFGQKRKWGSRYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHAAQHGIELGLKIPTINTNYYSFMGAELKYRRLYSVY

SEQ ID NO: 12507 - protein, 517 aa, Helicobacter pylori
MIKKNRTLFLSLALCASISYAEDDGGFFTVGYQLGQVMQDVQNPGGAKSDELARELNADVTNNILNNNTGGNVAGALSNAFSQYLYSLLGAYPTKLNGNDVSANALLSGAVGSGTCAAAGTAGSTFLNTQSACTAAGYYWLPSLTDRILSTIGSQTNYGTNTNFPNMQQQLTYLNAGNVFFNAMNKALEKNRTATTSGTSGATGSDGQIYSQQAIQYLQDQQNILNNAANLLKQDELLLEAFNSAVAANIGNKEFNSAAFTGLVQGIIDQSQLVYNELTKNTISGSAVNSATINSNQANAVQGRASQLPNALYNAQVTLDKITALNNQVKSMPYLPQFRAGNSRATNILNGFYTKIGYKQFFGKKRNIGLRYYGFFSYNGASVGFRSTQNNVGLYTYGVGTDVLYNIFSRSYQNRSVDMGFFSGIQLAGETFQSTLRDDPNVKLHGKINNTHFQFLFDFGMRMNFGKLDGKSNRHNQHTVEFGVVVPTIYNTYYKSAGTTVKYFRPYSVYWSYGYSF

SEQ ID NO: 12508 - protein, 529 aa, Helicobacter pylori
MKQNLKPFKMIKENLMTQSQKVRFLAPLSLALSLSFNPVGAEEDGGFMTFGYELGQVVQQVKNPGKIKAEELAGLLNSNTTNNTNINIAGTGGNVAGTLGNLFMNQLGNLIDLYPTLNTSNIHQCGATNNSNGATAAATSSTSSSPCFQGNLALYNEMVGSIKTLSQNISKNIFQGNNNTTSQNLSNQLSELNTASVYLTYMNSFLNANNQAGGIFQNNTNRAYGNGVTAQQIAYILKQASITMGPSGDSGAAAAFLDAALAQHVFNSANAGNDLSAKEFTSLVQNIVNNSQNALTLANNANISNSTGYQVSYGGNIDQARSTQLLNNTTNTLAKVTALNNELKANPWLGNFAAGNSSQVNAFNGFITKIGYKQFFGENKNVGLRYYGFFSYNGAGVGNGPTYNQVNLLTYGVGTDVLYNVFSRSFGSRSLNAGFFGGIQLAGDTYISTLRNSPQLASRPTATKFQFLFDVGLRMNFGILKKDLKSHNQHSIEIGVQIPTIYNTYYKAGGAEVKYFRPYSVYWVYGYAF

SEQ ID NO: 12509 - protein, 814 aa, Helicobacter pylori
MNDKRFRKYCSFSIFLSLLGMFEAEAKEEKEERKTERKKDKKENTQHTLGKVTTQAVKIFNYNNQTTISSKELERRQANQISDMFRRNPNINVGGGAVMAQKIYVRGIEDRLTRVTVDGAAQMGASYGHQGNTIIDPGMLKSVVVTKGAAQASAGPMALIGAIKMETKSANDFIPRGKDYAMSGAATFLTNFGDRETVMGAYRNNHFDVLLYYTHQNIFYYRDGDNATKDLFKPKESNKVSGSPSEQNNVMAKINGYLSERDILTLSYNMTRDNANRPLRANFTGTFLPYSCGDFNAFPNEKNPSDCLFENDASLFKTYSVNLVHNVSLNYEREGGSRFGDPKLKINGYTSIRNVKIDPLFRSTDIATIISFTPNPQLSQGEENRCVAQGGIYDAIKQTCAITFKSLGGGSVVANKDLFIINSGFNANVIHTIDHKNDNLFEYGLNYQNLTTFDKAIPNSELVKPGDAPDACLRVTGPNDPNMNGRCQRNGATANVIGVYAQANYTLHPMVTLGAGTRYDVYTLMDKDWQLHVTQGFSPSAALNVSPLEDLNFRLSYAYVTRGPMPGGLVWMRQDNLRYNRNLKPEIGQNVEFNTEYGSKYFDFRAAGFVQLISNYINQFSSTLFVTNLPPKDIIYVPGYEVSGTAKYKGFSLGLSVARSWPSLRKHLIADVYELAATVGNVFILTASYTVPRIGLSITWLSRFVTDLDYCSYSPYRNGPTDIDRRPSNCPKTPGIFHVHKPGYGVSSFFITYKPTYKKLEGLSLNAVFNNVFNKQYIDQASPVMSPDEPNQDKYARGMAEPGFNARFEIAYKF

SEQ ID NO: 12510 - protein, 2399 aa, Helicobacter pylori
MAFKKARLISRFISKGSFKLNKISKKFFTLNQILKREKPLKRHKKTKSIEKPFNKNKSFLKASVLLIGALGGLSHLRANECRYWSWSSWSYQDNIESGPNSPTHNSYCLFSSAQGSGTYYLNTLTTYSAGGASFTQKFNGGTLDIGGNIRFGGTGINGGDVGYITGTYNAQTMNFNSSHITTGNSYADGGGTTLNFNATNNITINQASFDNSDAGTQKSYMNFKGSNIKISGSSFTDDTNGGFNFSGNNNNSTISFNQTSFNQGTYNFSNSATLSFNNSNFNQGTYHFNSAQSTFENSNFNQGTYNFNDNTSFNNDTFNQGTYNFNSSKVSFSGANTLNSSSPFASLKGSVSFNSGAIFNLNQTLNNNQTYDILTTNGAIQYGVYQSYLWDLINYKGDKAISHVEVSNNTYDVTFDINGQDETLQETFSNQSIITQFLGDDLQQQAQQTYQEDVANSQNALNKVASDNTIANNDTSYTQSSNPTILKDAQGLENTNQQIQQDEKALEKDLAQIKQLANSTTGFNEQAFTQAQKQEQQDEQALQNDENAFNTEQEGLEQAIANAKHANPTPNPTPSPTPTPIKHTAPNTPPSQVPPTPPSQNLPKTNVWNGVYWLQNKTYSNKGIYYIDPNLSGQSGQSGNTLSTYTANLLGRSFGVNANNGTLIIGNNTESVNDNGLIWIGHGGFGYITGTFSAANIYLTNNFKTGEGVSNSDGGGANITFKASDNITMDGLNYNNAETVTKMIQTGASQHSYTTFDATNNISVTDSDFSDMTWGKFSFSAKNISFSNASFSGFTNPGGSSTISTNASNSLSFTDSRLNGGAIYNLQANSLIFNNTQAVFNVLYSRGTSNFNATTQLLGNTSFTLSSQSLLNFNGDTTLQNNANITLGNKSQAAFKNSLTLDNNSNLSLDNQSVLNANGTSAFNNQASLNIYNGSQAAFSSLFFNGGTLSLNANSKLNASSASFSNNTTINLDDSVLNANNTSSLNANINFQGASQADFGGNTTIDTASFNFDSASSLNFNNLTANGALNFNGYAPSLTKALMNVSGQFVLGNNGDINLSDINIFDNITKSVTYNILNAQKGITGISGANGYEKILFYGMKIQNATYSDNNNIQTWSFINPLNSSQIIQESIKNGDLTIEVLNNPNSASNTIFNIAPELYNYQDSKQNPTGYSYDYSDNQAGTYYLTSNIKGLFTPKGSQTPQTPGTYSPFNQPLNSLNIYNKGFSSENLKTLLGILSQNSATLKEMIESNQLDNITNINEVLQLLDKIKITQAQKQALLETINHLTDNINQTFNNGNLVIGATQDNVTNSTSSIWFGGNGYSSPCALDSATCSSFRNTYLGQLLGSTSPYLGYINADFKAKSIYITGTIGSSNAFESGGSADVTFQSANNLVLNKANIEAQATDNIFNLLGQEGIDKIFNQGNLANVLSQMAMEKIKQAGGLGNFIENALSPLSKELPASLQDETLGQLIGQNNLDDLLNNSGVMNEIQNIISQKLSIFGNFVTPSIIENYLAKQSLKSMLDDKGLLNFIGGYIDASELSSILGVILKDITNPPTSLQKDIGVVANDLLNEFLGQDVVKKLESQGLVSNIINNVISQGGLSGVYNQGLGSVLPPSLQNALKENDLGTLLSPRGLHDFWQKGYFNFLSNGYVFVNNSSFSNATGGSLNFVANKSIIFNGDNTIDFSKYQGALIFASNGVSNINITTLNATNGLSLNAGLNNVSVQKGEICINLANCPTTKNSSPANSSVTPTNESLSVHANNFTFLGTIISNGAIDLSQVTNNSVIGTLNLNENATLQANNLTITNAFNNASNSTANIDGNFTLNQQATLSTNASGLNVMGNFNSYGDLVFNLSHSVSHAIINTQGTATIMANNNPLIQFNASSKEVGTYTLIDSAKAIYYGYNNQITGGSSLDNYLKLYALIDINGKHMVMTDNGLTYNGQAVSVKDGGLVVGFKDSQNQYIYTSILYNKVKIAVSNDPINNPQAPTLKQYIAQIQGVQSVDSIDQAGGNQAINWLNKIFETKGSPLFAPYYLESHSTKDLTTIAGDIANTLEVIANPNFKNDATNILQINTYTQQMSRLAKLSDTSTFARSDFLERLEALKNKRFADAIPNAMDVILKYSQRNRVKNNVWATGVGGASFISGGTGTLYGINVGYDRFIKGVIVGGYAAYGYSGFHANITQSGSSNVNVGVYSRAFIKRSELTMSLNETWGYNKTFINSYDPLLSIINQSYRYDTWTTDAKINYGYDFMFKDKSVIFKPQVGLSYYYIGLSGLRGIMDDPIYNQFRANADPNKKSVLTINFALESRHYFNKNSYYFVIADVGRDLFINSMGDKMVRFIGNNTLSYRDGGRYNTFASIITGGEIRLFKTFYVNAGIGARFGLDYKDINITGNIGMRYAF

SEQ ID NO: 12511 - protein, 735 aa, Helicobacter pylori
MFLILRNRLPRRALLPAALLSSLTLLAAPSAFAAADGTADAKTLDRVSVRAEQSAPPSSTTRLPITLQETPQSATAISLQRLQDESLFSINDVMRNVTGVSVSFYDTQRPLYYARGFAITDFQVDGIPTYSGSTNQEYDTAFYDRIEVIRGANGLLSGAGVPSATVNLLRKRPGKEFDASFAVSAGSWDYRRMEADVTAPLTADGRFRSRVVAAYTERGLYYDRYDENKMAGMAVLEGDVTDSTTITLGYQSQDNNPTGSTWGTVPFFDNQGHFAHLPRSTNLSPKWSYWKRESNTAFANLEQRFGDNWLLKINTAYTRGNVQNVRLYGTGEPDPVTGSGIFLRAAAGDSKDTRRNVDAYLTGSFDLFGRDHDVTLGAQWSDLEGTTNTLALNFPSDWATCVSATGARERCYYIPNVYNWNGDISEVTYRRTGARRVAKTTQSGVYLATRLRLADPLSLIAGARLSRWETLTRSYNAAGAYTGTSGAYKVSDEVTPYVGLVYDITPSVSAYASYTEIFNPQNFKDRNENLLAPVQGSNLEAGIKTQWLDGRLTANAAVFEAKQDNYAVRDMGVPEGSLSDGTSAYIGVNGTKARGWEVDVNGEILPGWTVNAGYTHVKVTRAATDLLYANPPKDLLQLNTQLQLRGALERLSVGGGVQWQSKVQGYNIAYPLGGTVTVNQPAYMLVQFNANYRISDSWTATLSVRNALDKTYWANLDYNNYGEPRFVSASLRWTF

SEQ ID NO: 12512 - protein, 742 aa, Helicobacter pylori
MLRFVSKTICLSLIGLFNPLEAFQKHQKDGFFIEAGFETGLLEGAQTKEEATAQNTQKIQKNPLTHPQTNEQPKEQSKSDTATPQSVYGRYYILQSTILEKATELFTAANINGNGLTFYSQNPVYVMAYNKDNAEFEGYGNNSVVVIQNFLPYNLNNIELSYTDAQGKVVNLGVIETIPKDSQIILPASLFNNFSNDSPFNSDGLQQLQTTTTPFSDANTQSLFEKLSQITTNLQMTYENTDPFSSGNNDPSGPLASPKPHYECPGYKKSCQVASVSFTPQTAEELTNLMLDMIAVFDSKSWEEAVLNAPFQFANSPSECGIDYPKCVNPFNNGLVDPKNEKYVLTPEEVINSYRVANELTVNLLNAAKGFLGLGSQLGSANAPGDNGFNQGVLGIAPFALNPEKLFGKNLNKVVILALRDIIHEYGHTLGYTHNGNMTYQRVRLCQEGNGPEVRCEGGHEVEKNGKEELEFNNGHEVKDHDGYDYNVCSRFGGKNQPAFPSNYPNSIYTNCAQVPAGLIGVTTAVWQQLINQNALPINFANLSSQANYLDASLNARAFVGSVFNAFNQSFSTSSAQQSFRSPILGVNVKIGYQHYFNDYIGLAYYGIIKYNYAQANDEKNQQLSYGGGMDVLFDFITTYTNKKQGNPTKKVFASSFGVFGGLRGLYNSYYVFNQVKGSGNLDIVTGFNYRYKHSKYSVGISVPLIQSDIKIASNNGIYADSVVLNEGGSHFKVFFNYGWIF

SEQ ID NO: 12513 - protein, 220 aa, Helicobacter pylori
MNKTTIKILMGMALLSSLQAAEAELDEKSKKPKFADRNTFYLGVGYQLSAINTSFSTSSIDKSYFMTGNGFGVVLGGKFVAKTQAVEHVGFRYGLFYDQTFSSHKSYISTYGLEFSGLWDAFNSPKMFLGLEFGLGIAGATYMPGGAMHGIIAQYLGKENSLFQLLVKVGFRFGFFHNEITFGLKFPVIPNKKTEIVDGLSATTLWQRLPVAYFNYIYNF

SEQ ID NO: 12514 - protein, 277 aa, Helicobacter pylori
MKRALYLILGLFYTLNAESFKDVLTKVDYTFFNKKVVSPIKRYADRSAFYLGLGYQLGSIQHNSSNLNLSQQFNKSQIIFSDSLSPVFKNSYVSNGLGVQVGYKWVGKHEETKWFGFRWGLFYDLSASLYGQKESQSVIISTYGTYMDLLLNAYNGDKFFAGFNLGIAFAGVYDKVSDALLYQALLLDTFGGKVDPNGFQFLVNLGVRLGNKHNQFGFGIKIPTYYFNHYYSMNNISNNSEDVLKVLRFLEYGINSLLYQVDFRRNYSVYFNYTYIF

SEQ ID NO: 12515 - protein, 696 aa, Helicobacter pylori
MQNFIFNKKWLIYSSLLPLFFLNPLAAEDDGFFMGVSYQTSLAIQRVDNSGLNASQDASTYIRQNAIALESAAVPLAYYLEAMGQQTRVLMQMLCPDPSKKCLLYAGGYQQNAQNGDTGNNPPRGNVNATFDMQSLVNNLNKLTQLIGETLIRNPENLSNAKVFNVKFGNQSTVIALPEGLANTMNALNDDITNALTTLWYNQTLTNKSFNSGNSVSFSPQVLQHLLQDGLAIASSNQTICSTQNQCTATNEAKSIAQNAQNIFQALMQAGILGGLANEKQFGFTYNKAPNGSDSQQGYQSFSGPGYYTKNGNTTQAPLKALPAGATIGSGNGQYTYHPSSAVYYLADSIIANGITASMIFSGMQNFANKAAKLTGTSSYSQMQDTINYGESLLSNTVSYGDFITNWVAPYLDLNNKGLNFLPSYGGQLNGANSQTPQNTLTPQQAQQEQKVIMNQLEQATNAPTPAQIDKILANPYSPTAKTLMAYGLYRSKAVIGGVIDEMQTKVNQVYQMGFARNFLEHSSNSNNMNGFGVKMGYKQFFGKKRMFGLRYYGFYDFGYAQFGTGSSLVKATLSSYGAGTDFLYNVFTRKRGTEAIDIGFFAGIQLAGQTWKTNFLDQVDGNHLKPKDTSFQFLFDLGIRTNFSKIAHQKRSRFSQGVEFGLKIPVLYHTYYQSEGVTAKYRRAFSFYVGYNIGF

SEQ ID NO: 12516 - protein, 641 aa, Helicobacter pylori
MKKTKKTILLSLTLAASLLHAEDNGVFLSVGYQIGEAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSSSGTNTLKADKNVSLSIEQYEKIHEAYQILSKALKQAGLAPLNSKGEKLEAHVTTSKPENNSQTKTTTSVIDTTNDAQNLLTQAQTIVNTLKDYCPMLIAKSSSESSGAATTNAPSWQTAGGGKNSCATFGAEFSAASDMINNAQKIVQETQQLSANQPKNITQPHNLNLNTPSSLTALAQKMLKNAQSQAEILKLANQVESDFNKLSSGHLKDYIGKCDASAISSANMTMQNQKNNWGNGCAGVEETLSSLKTSAADFNNQTPQINQAQNLANTLIQELGNNPFRNMGMIASSTTNNGALNGLGVQVGYKQFFGEKKRWGLRYYGFFDYNHAYIKSNFFNSASDVWTYGVGSDLLFNFINDKNTNFLGKNNKISVGFFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 12517 - protein, 693 aa, Helicobacter pylori
MLHAEDDGFYMSAGYQIGEAAQMVTNTKGIQELSDNYEKLNNLLNNYSTLNTLIKLSADPSAINDARDNLGSSSRNLLDVKTNSPAYQAVLLALNAAVGLWQVTSYAFTACGPGHNENANGGIQTFNNVPGQNTTTITCNSYYEPGHGGPISTENYAKINQAYQIIQKALTANGSNGDGVPVLSNTTTKLDFTIRGDKRTGGTPNQPLIYQWSHGKAISTSWNGGTQTPTTENINTENNAQELLKQASIIITTLNEACPNFQNGGSGYWQGISGNGTMCGMFKNEISAIQGMIANAQEAVAQSKIVSENAQNQNNLDTGKPFNPYTDASFAQSMLKNAQAQAEILNQAEQVVKNFEKIPKNFVSDSLGVCYEVQGGERRGTNPGQVTSNTWGAGCAYVGQTITNLKNSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHVAQHGIELGLKIPTINTNYYSFMGAELKYRRLYSVYLNYVFAY

SEQ ID NO: 12518 - protein, 297 aa, Helicobacter pylori
MDALPWRATSTRSQRYGAYLQDELTLTPRWYAMAGLRWDGFKDDDLLTGSRVTGNDRSWRVGSTVVLRDGINAYASYASGFLPQDAANQDSSVGGPFAPERSTQWEVGLKTALNDGGLTLNTALYRIERSNIVQANGRVVDGVNQLSALGLVRSEGLEVDLLADLTERWVLNLTYAYNDARVLDAGTNGITNASGDRFANAPRNTFGLWTRYDLPAWRSAIAFGADYVGERVSLDGQRVKPYAIYDISWQTQWNAWKLQINIKNLFDKVYAVSGFNTRAGHFPGEPRRLYAQLAYSF

SEQ ID NO: 12519 - protein, 688 aa, Helicobacter pylori
MLKLTVPALAVGALAASAAAAETAPAAGATANDAAMLLPPVEVVAAPLSTPLVVVTDPKAPRQPLPASDGADYLKTIPGFTSIRSGGTNGDPVLRGMFGSRLNILANGMPTLGACPNRMDAPTSYIAPESYDKVTVVKGPQTVLYGPGASAGTVLFERVTPRFERPGMRFEGSLVGGSFGRNDQNIDLTAGTPDVYGRVTANHAHSQDYQDGNGNTVPSQWDKWNADAALGWTPDDHTRVELTAGTGDGYARYAGRGMDGAHFRRETFGLSFDKRHLGDVLDRIEARVYYNEADHVMDNYTLRQPDPASSMPMRMAADVRRRTVGARAAATFRFGDDFKFVTGVDAQSNRLDSRSSMGQQNYRDQPWDAQATMWNAGVFSELTWYASDVSRVIGGARVDYASARDKRAMKRGMMMSKPNPTFDDDRTKVLPSGFVRYERDLASLPVTWYAGIGHAERYPDYWELFSATRGPTGSVNAFSAVRPEKTTQLDIGAQYKSDRFDAWVSAYAGYVQDFILFDYATGMMGPTTQATNVNAQIMGGEAGVSWRPVAPLRVETSLAYAWGRNVASGDPLPQMPPLEARIGLEYTRGAWSAGGLWRIVASQHRYALNEGNVVGKDFGPSAGFGVLSLHTQYNVSKTVQISVGVDNVLNKAYTEHLNLAGNAGFGYPANAPVMEPGRTAWVRVSAKL

SEQ ID NO: 12520 - protein, 231 aa, Helicobacter pylori
MFKKIIFFCVFLMGGFVVFPLDAMPILHDKTPKKNYQEAHEKLYRSIINRQKLTRKKSGWYFLGGFGAVEAIKDYQGQEMKDWIATLNLKTGVQSFFKKYIGIRGVFAWDLGSGKANYQSHKDPTNSFFTMLAVGLDVIMEFPLGSYKHYLGAFGGARGALVVYTDKQNFKFFKHSVVSGGLAINGGVMLTLFLRHRIELGFKILPTARLLSSSKRFETSPLFYAAYSYKF

SEQ ID NO: 12521 - protein, 248 aa, Helicobacter pylori
MLKRIILLGALGVLANAEESAAFVGVNYQVSMIQNQTKMVNDNGLQKPLIKFPPYAGAGFEVGYKQFFGKKKWFGVRYYGFFDYAHNRFGVMKKGIPVGESGFIYNSFSFGGTTLTERDSYQGQYYVNLFTYGVGLDTLWNFVNKENMVFGFVVGIQLAGDSWATSISKEIANYARHHSNSSYSPANFQFLWKFGIRTHIAKHNSLELGIKVPTITHQLFSLTNEKGYTLQADVRRVYAFQISYLRDF

SEQ ID NO: 12522 - protein, 1036 aa, Helicobacter pylori
MQDARDLVRYETGITAVEKGRFGTSGYAMRGVDENRVAITIDGLHQAETLSSQGFKELFEGYGNFNNTRNGAEVETLKQVQLAKGANSLKVGSGALGGAVIFKTKDARDFLTEKNWYVSYKKGYNSADRQHIDSMTLAGRYKWFDALLVKTKRDGHELQNYGYNHFDAAVQGKRREKADPYHKHLDSTLLKLSFQPTENHRFTVTADLYDSRSKGADLSYTLKATGLQKSNDPPELEYRHNNDQVKRTNYAFSYENYSSNPLWDTMKFTYSEQKIKTRARNEDYCDGNDKCNSSLNPLGIKYNKNNELVDKDGNPITYKYSNQKQTYYEYVSQDVFDTWNEKIPDDIKEKYEKLGVLKDVPTSVTSCYKDISSEHPDKCRIPIYATIITEQLISNGQVYSDLTLKENSKWIEKYQTNSPLLLSCDGISCDTKDKDRDGDSTIAVIDEHNQPKRLGFKVDKERNLAILKIGGEALHSDRLFLPSSKGHNTNLWTDRSLNTNTKQFNLDFTKYLILGKTDHNISYGGSLSKSQKEMVNQSGDSAINVKWWALYPENCKTSYSSLCGKSNIFSFLVPVKATSRALYFADDFKLNDRISFELGYRYDQIKYQPSYTAGVTPKIPDDIVGGFAHDFKDPYKPVELPKKLPEPKFSDYGYQKVNEYNKEKSKYDDSVVAYNEAVVQNKKIAEKNKLARHQANIDAFVKEKSFAAHSYSLGVNTDPFDFMLLQFKHSKGFRAPTSDEIYFAFKMGDFNPKYGDTLHVVPNIQLKPELAKTNQIALTFYKDFGFITFNYFETKYKNFIDFARTIGYHKNSNGGKTPYEIRQNINRESAKSSGIEINARLNLSILHKALSEFEFSYKFSKQKGRVKVKEYLNPANPNEFINITAPMNAIQPKTSIYGLSYHNTNGKFGVDLYVTRVAAKKASDTYNDTWRETQNEEKITNPTNIGNTNVTTDSSIRWRSDAYTLVDVIAYAKPIKNLILQFGVYNLTNRKYVTWDSARSIRQFGTSNKIDYVTGKGLNRFNAPGRNFKLSAELTF

SEQ ID NO: 12523 - protein, 879 aa, Helicobacter pylori
MLRNQFRIVFVSCIVASSLQAQENTHTLGKVTTKGERTFEYNNKMYIDRKELQQRQSNQIRDIFRTRADVNVASGGLMAQKIYVRGIESRLLRVTIDGVAQNGNIFHHDANTVIDPNMIKEVEVIKGAANASAGPGAVAGKLSFTTIDANDFLRKNQTYGAKAEAAFYTNFGYRMNATAAYRGKNWDILAYYNHQNIFYYRDGNNAFRSLFHPNYDLQDPSNSEMSVGTPSEVNSVLAKINGYINETDSISVSYNLTRDNSTRLLRPNTTSALSKANDPGSQPAPFVIDFGKELAHTINFNHNLSLKYKHEGGPNFNQPRVESTAFLGVRGGNYNPVVNPFAYNSNEPANPDYIPEVKEWCNNPDNISQCTQGAIRPSNGGYQIGYGAPNFINWQGDSDSSGGAQAGYGQLSATMLSASANVYHGLVPKNPDYDMTPPNAQNPSANDWTLGNADAEGTLARRIFLINSGVNVKVTHPISEDYGNVFEYGMIYQNLSVFSGLDKGKNGYYKNNIDPNDPNGPGLPYRHYYTDQSSQYPQNLNTPNPLYRNMPQNSHAIGNIIGGFVQANYNILSNVVVGAGTRYDIYTLLDKNGRTHVTSGFSPSATVLYNPIESIGLKVSYAYVTKGALPGDDVLMRDPTVIYQRNLRPSIGQNVEFNVDYNSKYFNVRGAAFYQVINNFINSYGQDTSKNGGGNATAKNMSGNLPETINVYGYEVSGNVKYKNFLGTFSVARSWPTARGHLLADTYALAATTGNVFILKADYDIRRWGLTLTWLSRFVTNMYYEGYSIYYPQYGLIKIHKPGYGVHNIFINWTPPSKKWQGLRISAVFNNILNKQYVDQTSVFQASADAPASDMIPKGKRMALPAPGFNARFEVSYQF

SEQ ID NO: 12524 - protein, 1097 aa, Helicobacter pylori
MASQKNNLFKKNKKYLWRKIKSHSSLFSVWPKTIHKEYVHLPLCLPIYVLVFSLFTTEVKASPVNDKAVFNIPRQRADLSLINFAEQADITLLFPLDKIQQLQTNTIAGEYSIINALQILLDGTGLQPHVSEDGQISILIDPSFERTDNMANYKKNGVSSAVLAVLSTMATLPAVAETAAQEPEIIEVRGIRGSLGRAMDAKREAGGVVDSISAEDIGKFPDTNLAESLQRITGVSIDRSGGEGQLITVRGFGPQFNTVLVNGRQMASENQSRAFSFDTIASELVKSLDVFKTSTATKQSGGIGSTVNVNTARPFAINGFKVAGSVKGIYDENSEETTPEISGLISNTFNDDTLGVLFAVSRQERETRLNQAQVDGWLENVGVPNPQTQSGQAYTGNIFSPRNYDHKVTTETRTRTNANLVIQYAPSDDLVITADGLYSDFDVEADTTSYGHWFTAPNLEGFGGAAGPTVDENGTVVDLYQEVGLATDMHAKKFDRLTNSSALGLNFDWHVNDNLNMKFDLSHSKAEREANNGGGDQLSLIGYANRVRFEVDGGILPYASEFASANPNIYSGQQELDGVAYNPAVTPDGVSNHLDTANSRAHVMLRRGWAVEDTVDQFRWDNIWYNDGTSGLVSVKFGAMYSTETKNLDRWDNEGVGIHCTFCGYPDDPSMDGLAQFVFDAGDDFLGDVSGSGRMPTSWLAHDGEANFAYLEQIAAANGQPISFDAVKRNKSFEITEDTFSFYTEFDFEAELAGMPLYATAGFRYESTDVKVKGTDEPVSALTILDKTEMLANFGAVENISASSDYEAILPNFSVKLEISDGIIARAAVSQTITRPTLDSMSPVTVIETTRQGGNLTSSSGNPALEPFTSDNLDLSLEWYYADASYLSAGYFRKNVANFIINTTEDLTFELSDGGLLTDPSTGNDVDNPDAADSTAVFTNTLPNNSESAIVGGWEVALQHSFDSGFGFMVNATFVDSDAELDSADITQVFALTGLSDSYNVVGFYENGPFQARLAYNWRDSFVQSLTQLNGDGVTIVEDYAQLDASGSYDITENVSVFFEGINLTEEYVHKRGRFSNQLLLVEDSGRRFALGIRGSF

SEQ ID NO: 12525 - protein, 663 aa, Helicobacter pylori
MHKRPTVFPQPRFPLPFLAAAFLLPALPATAAADDASPVEEIVVTATRTPTPIDRIPASVSVIDREEIRRNAWQTLPDALRTLPGAALTRSGGPGGNSSLFLRGTNSDHVLVLLDGLPVNDPAMTAGAFNFGDDLLEGVSRIEVVRGPASTLYGSNAIGGVINMITRAGGPTAATAEVDAAAGTDKTWRGSAGLYGTLDNLDYGVSVQGFTTDGDNATPSRMAGNLGEDDGFDALTATGKAVVRLENGRLEALLRWRRAESDLDNVPQDEPNSTGESDHLAWQLAGERLFFGGALNSRLSVGQSRYDRTYRNDPDSVSADYSRDTYDSVRTQADWQNNLTLPATAAVKDGVLGFGASFVRDEVDFDTRSVSAYGPYTSAVDADADSLALYVHAQARLFDAVDVTAGLRNEHPDDFGTTTTWRLGAVVPLPSLATRLKAAAGSAFKAPTLYDRFGTNNYGYRGNPDLDPEKSVGWEAGFETDLPGAGRSNLATLSVTWFQSDIDDLITYRYNPDFTSTVVNVNEAHTKGVETILTLRPADWAELTASWTWTDARNEQTDARLLRRPEHALAFTAALEPVAGLTVAPEVSFIGRRRDYIYPDGSGYGAEGTAGGYWLANLSLTWQAREDLQLYARGSNLFDRTIEDPNGFAQPDRGILVGLRATY

SEQ ID NO: 12526 - protein, 1120 aa, Helicobacter pylori
MKKIFSLLALVLFINLFTYQAQAQTAVVNINKTSVSLKELIQEVEKQAGYLFVYGKDINIEQKVKINARNKQVKALLENVLPQIGLTYEYADNYISLKKTQVEKKSIGKKIIVKGTVVDKSGEPIIGANIMEQGSASNGTITDIDGKFTLSLPSNSVLAVTYVGFSTKNIPVNNQNAIQIVMEEDSEILEEVVVVAYGTQKKISSTAAVSSMKTKDVAQKPVINISNSLAGRMAGVIAKQGSGEPGADGSDLRIRGVATLGNQSPLVVVDGVPRDFSRIDPNMIEDITILKDAAAVAPYGMAGANGVVLVTTKKGKSGAPVLSYNGYIGFQNPTRITDQVNSYEYALMKNEAAMNAGYPNYYAYSQHDLEMYRKTCAGDPDADPDRYPNSNGLRDLVQNNSVITNHNLQLSGGSDKFQYYVSLGYSYQEGMWSTTDYQRFNLLANLSVDATKYTKISLSLGGWHEKKNYPGADTGDIMYQAYRTPPISAIQYSNGLWGQYVGKSLFGLTYRSGYRQEPADQLNTSLSIEQQLPFIQGLSIKGVINYDPYRVKKKKYLTPIPVYTLDASQTPYQFVEGFQGPEKPNLEQSFEESVSMTYQGMINYSRTFGKHTVTGLGVIEARERNVWNMSAKRLNYNINIDEINAGSSDPADISNGGTSWKERQVGYAFRLGYNYDNRYMAEVSGRYDGHYYFAPGKRFGFFPAFSLGWNLREESFMKDVEWMDKLKLRLSYGESGNLAGSSYQYMSDYGFGNAVNFGGVPMMGMWENLQGNPNITWEKAKKFDFGVEFSVLNGMFSLEADYFYEKRSNMLMAPNALVPAEYGIPLSQVNAGSMHNQGIDLSLNFNKRIGKDWMISAKGTFTFARNILDEVFETEATFNNPNRRRTGRPDGTMFGYNALGYFTYDDFNPDGSLKAGIATQPWGQVYPGDLRYEDLSGPNGVPDGKIDEHDQTVIGFSNWAPEIIFGLAPTVQWKNFDLNALIQGATRTSISLGETLVMPFFDSGSATKLQFSDHWTPDNTNAPYPRLTSEVTVNNHRQPSSWWVRDATYIRLKSIEIGYTLPRSALNFIGISSARVYASGQNLWTWTPFMKELIDPEAKSANGKYYMQQAVYAFGLNITF

SEQ ID NO: 12527 - protein, 253 aa, Helicobacter pylori
MKTLFSIYLFLSLNPLFLEANEITWSKFLENFKNKNDDDKPKPLTIDKNNEKQQILDKNQQILKRALEKSLKFFFIFGYNYSQATFSTSNQTLTFVANSIGFNTATGLEHFLRNHPKVGFRIFSVYNYFHSVSLSQPQTLMVQNYGGALDFSWIFVDKNIYRFRSYLGIALEQGVLLVDTIKPGAITTIIPRTKKTFFQAPLRFGFIVDFIGYLSLQLGIEMPLVRNVFYTYNNHQERFKPRFNANLSLIVSF

SEQ ID NO: 12528 - protein, 286 aa, Helicobacter pylori
MKKSVIVGAISLAMTSLLSAETPKQEKAIKTSPTKKGERNAAFIGIDYQLGMLSTTAQNCSHGNCNGNQSGAYGSNTPNMPTASNPTGGLTHGALGTRGYKGLSNQQYAINGFGFVVGYKHFFKKAPQFGMRYYGFFDFASSYYKYYTYNDYGMRDARKGSQSFMFGYGAGTDVLFNPAIFNRENLHFGFFLGVAIGGTSWGPTNYYFKDLADEYRGSFHPSNFQVLVNGGIRLGTKHQGFEIGLKIQTIRNNYYTASADNVPEGTTYRFTFHRPYAFYWRYIVSF

SEQ ID NO: 12529 - protein, 695 aa, Helicobacter pylori
MKIKKSLLLSLSLMLSLSRAEDDGFYMSVGYQIGEAVQKVKNTGALQNLADRYDNLNNLLNQYNYLNSLVNLASTPSAITGAINNLSSSAINLTSATTTSPAYQAVALALNAAVGMWQVIAFGISCGPGPNLGPEHLENGGVRSFDNTPNYSYNTSSGTTTTTCNGASNVGPNGILSSSEYQVLNTAYQTIQTALNQNQGGGMPALNSSKNMVVNINQTFTRNPTTEYTYPNGNGNYYSGGSSIPIQLKISSINDAENLLQQAATIINVLTTQNPHVNGGGGAWGFSGKTGNVVDIFGDSFNAINEMIKNAQAVLEKTKQLNANENTQITQPDNFNPYTSKNKQFAQEMLNRANAQAEILSLAQQVANNFHSIQGPIQGDLEECKAGSAGVINDNTYGSGCAFVKETLNSLEQHTAYYGNQVNQDKALSQTILNFKEALNTLNKDSTAINSGISSLPNAKSLQNMTHSTQNPNSPEGLLTYSLNADKYNQLQNIRQELGKNPFRRFGVIDYQNNNGAMNGIGVQMGYKQFFGKKRNWGLRYYGFFDYNHAFIKSSFFNSASDVWTYGVGMDALYNFINDKNTNFLGKNNKLSVGLFGGFALAGTSWLNSQQVNLTMMNGIYNANVSTSNFQFLFDLGLRMNLARPKKTDSDHTAQHGIELGFKIPTINTNYYSFMGAKLEYRRMYSLFLNYVFAY

SEQ ID NO: 12530 - protein, 487 aa, Helicobacter pylori
MKKTILLSLMASSLLAENDGVFMSVGYQIGEAVQQVKNTGEIQKVSNAYENLNNLLTRYNELKQTASNTDSSTAQAINNLKESASRLKTTPNNANQAVSSALSSAVGMWQVIASNLANNSLPTSEYNKINAISQLLQNTLENKNTANNNTTIGNDYEYLLTQAKTIISTLQSQCPGIDGGNGKPWGINASGNACAIFGNTFNAINSMIDSAKKAAEQFRRTDPSQPQNQQSAFTDADFTKNLNQVSSVINDTISYLKGDNLETIYNTLQKTPDSKGFHSLVSRSSYSYSLNETQYSQFQTTTKEFGHNPFRSVGLINSQSNNGAMNGVGVQLGYKQFFGKNKFFGIRYYAFFDYNHAYIKSNFFNSASNVFTYGAGSDLLLNFINGGSDKNRKVSFGIFGGIALAGTTWVNSQLVNLKATTSIYSVKINNTNFQFLFNTGLRLQGIHHGIELGVKIPTINTNYYSFMGAKLAFRRLYSVYFNYVLAY

SEQ ID NO: 12531 - protein, 479 aa, Helicobacter pylori
MKNHSFKKTIALSLLASMSLCNAEEDGAFFVIDYQTSLARQELKNPGFTQAQELKQLIRDGAVRLQTSAIPLSYYLDILGNKTKTLLSESLKNNPQQPNGQPNQALVNLEQSLGILGKLLDLSQQYASEGVIKPLVVDVGKEQIGITDSMLLVAQNIVLALGQVDLSKIQQNNGNQQLYENIMKVMLLGTGGTNGAYNGVSVGDIATGMQNFPSQTGLIGANSTVSELNALIKSGISLDRETLGLGSFIEKNICSGASSCFSGNQLIYKKGLDRTINIINAVLGQFESSASSLYKISYIPNLFSLKDYQSASMNGFGAKMGYKQFFTHKKNIGLRYYGFLDYGYANFGDTNLKVGANLVTYGVGTDFLYNVYERSRRRERTTIGLFFGAQIAGQTWSTNVTNLLSGQRPDVKSSSFQFLFDLGVRTNFAKTNFNKHRLDQGIEFGVKIPVIAHKYFATQGSSASYMRNFSFYVGYSVGF

SEQ ID NO: 12532 - protein, 470 aa, Helicobacter pylori
MKNTNTKEIKNTRMKKGQYHALKKGLLKTALLFSLPLSMALAEDDGFYMGVGYQIGGTQQNINNKGSTLRNNVIDDFRQVGVGMAGGNGLLALATNTTMDALLGIGNQIVNTNTTVGNNNTELTQFKKILPQIEQRFEANKNAYSVQALQVYLSNMLYNLVNNSNNGSNNGVVPEYVGIIKVLYGSQNEFSLLATESVALLNALTRVNLDSNSVFLKGLLAQMQLFNDTSAAKLGQIAESLNKSGGAGAMLQKDVKTISDRIATYQENLKQLGGMLKNYDEPYLPQFGPGESSQHGVINGFGIQVGYKQFFGSKKNIGLRYYAFFDYGFTQLGSLNSAVKANIFTYGAGTDFLWNIFRRVFSDQSLNVGVFGGIQIAGNTWDSSLRGQIENSFKEYPTPTNFQFLFNLGLRAHFASTMHRRFLSASQSIQHGMEFGVKIPAINQRYLRANGADVDYRRLYAFYINYTIGF

SEQ ID NO: 12533 - protein, 2898 aa, Helicobacter pylori
MKKFKKKPKKITRKQKTILKRPLWLAPLLISGFASGVYADGTDILGLSWGEKSQKVCVHRPWYALWSCDKWEEKTQQFTGNQLITKTWAGGNAANYYHSQNNQDITANLKNDNGTYFLSGLYNYTGGENNGGNLNIELGSNATFDLGAHSGNSFTSWYPNGHTNVTFSAGTINVNNSVEVGNRVGSGAGTHTGTATLNLNANKVNINSNISAFKTSQVNVGNANSTITIGSVFLSGNTCSSLASVGVGANCSTSGPSYSFKGTTNATNTAFSNANGSFTFEENATFSGAKWNGGTYTFNKEFSATNNTAFNSGSFNFKGASSFNGASFSNASYTFNNQATFQNSSFSGGTFTFNNQNNQSAQHPQIQNSSFSGSAITLKGFVNFQQAFNNSNHQLTIQNASFNNANFNNTGKITIEKDASFNDTTFNTSINTNNMAITGSVTLSGKNDLKNGSTLDFGSSKITLTQGTTFNLTSLGDKNSVTILNSSGGITYNSLLNHALNSLTNALKTNESSSKPQSFAQGLWEMITYNGVTGQLLNENAATSKNTDSSPSKSSSNSTQVYQVGYKIGDTIYKLQETFGPNSIIIQALESGTYTPPPVISGSKFDLSASNYINADMPWYDHKYYIPKSQNFTESGTYYLPSVQIWGSYTNSFKQTFSTNGSNLVIGYNATWTGNSVSSSDTVSFGDTSGSALNGHCGPWPYYQCTGTTNGTYSAYHVYITANLRSGNRIGTGGAANLIFNGVDSINIANATITQHNAGIYSSSMTFSTQNMDSSQHLNGLNSNGKLLVYGTTFTNQAKDGKFIFNAGQAVFENTNFNGGSYQFSGDSLNFSNNNQFNSGSFEISTKNASFNNANFNNSASFNFNNSDATTSFVGDFTNAHSNLQIAGNAVFGNSANGSQNTANFNNTGSVNISGNATFDNVVFNSPTNTSVKGQVTLNNITLKNLNAPLSFGDGTITFNAHSVINIAEAITNGNPITLVSSSKEIEYNNAFSKNLWQLINYQGHGASSEKLVSSVGNGVYDVVYSFNNQTYNFQEVFSQNSISIRRLGVGMVFDYMDMEKSDHLYYKDVVGFMTYMPNSYNNNLGNSNNTIYYYDNSIDFYASGKTLFTKAEFSQTFTGQNSAIVFGAKNIWTSVSDAPQSNTIIRFGDNKGAGSNDASGHCWNLQCIGFITGHYEAQKIYITGSIESGNRISSGGGASLNFNGLQGILLTNATLYNRAAGTQSSSMNFVSNSANIQAQNSYFIDDTAQNGGNPNFSFNALNLDFSNSSFRGYVGQTQSVFKFNATNAISFTNSTNLSSGLYQISAQSVLFDNSNLSVSVGTSSIKANAISLSQNASINASNHSTLDLQGGLNVNDTSSLNLNQSTINVSNNATINDHASLIASNNAHINFNGTTNFNSANTTTSLSNSSIVFKGASFLGGQFNLSNNSSLDFQGSSAITSNTAFNFYDNAFSQSPITFHQALDIKAPLSLGGNLLNPNNSSVLDLKNSQLVFSDQGSLNIANIDLLSDLNDNKNRVYNIIQAGMNSNWYERISFFGIRINDGIYDAKNQTYSFTNPLNNALKITESFKNNQLSVTLSQIPGIKNTLYNIGSEIFNYQKVYNNANGVYSYSDDAEGVFYLTSNVKGYYNPNQSYQANGSNNTTKNNNLTSDSSIISQTYNAQGNPISALHIYNKGYSFNNIKALGQMALKLYPEIKKVLGNDFSLSSLSGLNSNALNQLIKLITPNDWKNINELIDNANNSVVQNFNNGALIVGATKIGQTDTNSAVVFGGLGYQTPCDYTDIVCQKFRGTYLGQLLESSSADLGYIDTTFNAKEIYLTGTLGSGNAWGTGGSASVTFNSQTSLILNQANIVSSQTDGIFSMLGQEGINKIFNQAGLANILGEVAVQSINKAGGLGNLIVNTLGSGSVIGGYLTPEQKNQTLSQLLGQNNFDNLMNDSGLNTAIKDLIRQKLGFWTGLVGGLAGLGGIDLQNPEKLIGSMSINDLLSKKGLFNQITGFISANDIGQVISVMLQDIVKPSNALKNDVVALGKQMIGEFLGQDTLNSLESLLQNQQIKSVLDKVLAAKGLGPIYEQGLGDLIPNLGKKGLFAPYGLSQVWQKGDFNFNAQGNVFVQNSTFSNANGGTLSFNAGNSLIFAGNNHISFTNHAGLLQLLSNQVSNINITTLDASNGLKINAANNNVSASQGNLFVNASCAQQSDPTAANATNPCTTAQNNASSNNASNNAPIALNNNDESLMVTANDFNFSGNIYANGVVDFSKIKGSANVKNLYLYNNAQFQANNLTISNQAVLEKNASFTANNLNIQGAFNNNATQKIEVLQNLVIASNASLSTGTYGLGVGGALNNFGAIHFNLENSQTPVNPLIQAEGIINLNTAQTPFINVNNVMANNTTYTLLKSSRYIDYNINPNSLQSYLKLYTLININGDHIEEKNGVLTYLGQRVLLQDKGLLLSVALPNSNNASQNNILSLSVLYNQIKMSYGDKAMDFTPPTLQDYIVGIQGQSALNQIEAVGGNAIKWLSTLMMETKENPLFAPIYLKNHSLNEILGVTKDLLNTASLISNPNFRNNATNLLELASYTQQTSRLTKLSDFRSREGESDFSERLLELKNKRFSDPNPGEVFVKYSQLSKHQNNLWVQGIGGASFISGGNGTLYGLNAGYDRLVKNVILGGYVAYGYSDFNGNIMRSLANNVDVGMYARAFLKRNEFTLSANETYGGNANNINSSNPLLSVLNQRYNYNTWTTSVNGNYGYDFMFKQKSVVLKPQVGLSYHFIGLSGMKGNDAAYKQFLMHSNPSNESVLTLNMGLESRKYFGQNSYYFVTARLGRDLLIKSKGDNVVRFVGENTLLYRKGEVFNTFASVITGGEMHLWRLMYVNAGVGLKMGLQYQDINITGNVGMRVAF

SEQ ID NO: 12534 - protein, 744 aa, Helicobacter pylori
MKKHILSLTLGSLLVSALSAEDDGFYTSVGYQIGEAAQMVTNTKGIQELSDNYEKLNNLLNNYSTLNTLIKLSADPSAVNAARENLGASAKNLIGDTKNSPAYQAVLLAINAAVGFWNVVGYVTQCGGNANGQTSTSSTTIFNNEPGYRSTSITCSLNGYTPGYYGPMSIENFKKLNEAYQILQTALKQGLPALKENNGTVSVTYTYTCSGKGNDNCSPQTTGVNQQNDGTKTETQTIDGKQVNTTISSKVVDSKASGNTSHVSYTEITNKLEGVPDNAQFLLAQASTLINTINTACPFFHANNSSEANAPKFSTTTGKICGAFSEEISAIQKMITDAQDLVNQTSVINEHEQSTPVGNNNGKPFNPFTDASFAQGMLANASAQAKMLNLAHQVGQTLNPENLTGTFKNFVTDFLATCNNKSTAGTGGTQGSPPGTVTTQTFASGCAYVEQTITNLENSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVSSQTNNGAMNGIGIQVGYKQFFGQKRKWGARYYGFFDYNHAFIKSSFFNSASDVWTYGFGADALYNFINDKATNFLGKNNKLSVGLFGGIALAGTSWLNSEYVNLATVNNVYNAKMNVANFQFLFNMGVRMNLARSKKKGSDHVAQHGIELGLKIPTINTNYYSFMGAELKYRRLYSVYLNYVFAY

SEQ ID NO: 12535 - protein, 245 aa, Helicobacter pylori
MRTLLKMLVGASLLTHALIAKEESAAPSWTKNLYMGVNYQTGSINLMTNIHEVREITNYQTGYTNIITSVNSVKKLTNMGSNGIGLVMGYNHFFHPDKVLGLRYFAFLDWQGYGMRYPKGYYGGNNMITYGVGVDAIWNFFQGSFYQDDISVDIGVFGGIAIAGNSWYIGSKGQELLGITNSRAVDNTSFQFLFNFGLKALFVDEHEFEIGFKFPTINNKYYTTDALKVQMRRVFAFYVGYNYHF

SEQ ID NO: 12536 - protein, 712 aa, Helicobacter pylori
MSFKRSFKYSSISVAVLSALATIPAIAEELTGEPGIANIERISVTGRNFNDYKVGSASGAMRGDISLMDTPQSVTVIPDFVTDEQLATNLSEVLVNDSSVTGGSEKWNRQVFSIRGFELSSGSGYLINGQQQWSHYVQPIETLQQVEVLKGPSSMLYGQSGPGGLINMVTKKPTYDTMFELGFDTDEHGSTRYQLDAGGSLNEDQTIRYRTVLVKQDTQYWREYQDGSNQERDRWLGYLNLEFDITDDLLLSLKYDHTQDKTGIDRGGWLDSSGELIGGNDIIWDQPWAFTDNTISNMGVDLTYHINDDWKVKAGYNDQQFNRQRLDSSPSMISSSDDPMTNGYYVSPFDRYDDWQHKTSYVDFVGNFSTGGLEHQFLLGANMLDYYYGQLKDSGEKKQLVMPGQPLPKPDLDYNRDETLYESEYKHYGFYIQDLISINDQWQVLAGVRYDEQKKEGAGNNSYAVSPKFGVIYSPAANGSIYVNYSKSFTPQGIVNDEDDVNNKMNLDPEYGEQYEIGTKWELFDGSLLLTGAVFDITVSNVTVTEDLTTPIGDDTKITTQGGEQRHKGFEMGAQGQVSEKWFMTGSMMYLDAQYETGANDRDNLDGMTPVDAPEWSANVWTRYEMTDDLALNFGAIYVGERFANTDNTISKDSYVRFDMGAAYSMDVMGSDVSVRLNIKNLFDVDYLAGGTTTDVTVGEGRHFGLALEAKF
